(12) United States Patent
Vinocur et al.

(10) Patent No.: US 9,018,445 B2
(45) Date of Patent: Apr. 28, 2015

(54) USE OF CAD GENES TO INCREASE NITROGEN USE EFFICIENCY AND LOW NITROGEN TOLERANCE TO A PLANT

(75) Inventors: Basia J. Vinocur, Rechovot (IL); Sharon Ayal, Kiryat-Ekron (IL); Alex Diber, Rishon-LeZion (IL); Eyal Emmanuel, Rechovot (IL); Gil Ronen, Emek Hefer (IL); Michael Gang, Jerusalem (IL); Dotan Dimet, Tel-Aviv (IL); Hagai Karchi, Moshav Sitriya (IL); Yoav Herschkovitz, Givataim (IL)

(73) Assignee: Evogene Ltd., Rechovot (IL)

( * ) Notice: Subject to any disclaimer, the term of this patent is extended or adjusted under 35 U.S.C. 154(b) by 426 days.

(21) Appl. No.: 13/059,231

(22) PCT Filed: Aug. 18, 2009

(86) PCT No.: PCT/IB2009/053633
§ 371 (c)(1),
(2), (4) Date: Feb. 16, 2011

(87) PCT Pub. No.: WO2010/020941
PCT Pub. Date: Feb. 25, 2010

(65) Prior Publication Data
US 2011/0145946 A1 Jun. 16, 2011

Related U.S. Application Data

(60) Provisional application No. 61/136,189, filed on Aug. 18, 2008.

(51) Int. Cl.
C12N 15/87 (2006.01)
C12N 9/02 (2006.01)
C12N 5/14 (2006.01)
C07H 21/04 (2006.01)
C12N 15/82 (2006.01)
C07K 14/415 (2006.01)

(52) U.S. Cl.
CPC .......... *C12N 15/8271* (2013.01); *C07K 14/415* (2013.01); *C12N 15/8261* (2013.01); *C12N 15/8269* (2013.01); *C12N 15/8273* (2013.01)

(58) Field of Classification Search
None
See application file for complete search history.

(56) References Cited

U.S. PATENT DOCUMENTS

| | | |
|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Su et al 2004 Plant Physiology 136: p. 3104-3113.*

(Continued)

*Primary Examiner* — Brent T Page
*Assistant Examiner* — Matthew Keogh

(57) ABSTRACT

Provided are methods of increasing nitrogen use efficiency, fertilizer use efficiency, yield, growth rate, vigor, biomass, oil content and/or abiotic stress tolerance of a plant by expressing within the plant an exogenous polynucleotide comprising a nucleic acid sequence at least 80% identical to SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522; and of increasing nitrogen use efficiency, fertilizer use efficiency and/or oil content of a plant by expressing within the plant an exogenous polynucleotide comprising a nucleic acid sequence at least 80% identical to SEQ ID NO: 3, 5, 6, 9, 10, 14, 15, 288, 294, 2398-2412 or 2413. Also provided are isolated polynucleotides and polypeptides which can be used to increase nitrogen use efficiency, fertilizer use efficiency, yield, growth rate, vigor, biomass, oil content and/or abiotic stress tolerance of a plant of a plant.

18 Claims, 3 Drawing Sheets

(56) References Cited

U.S. PATENT DOCUMENTS

| | | | |
|---|---|---|---|
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,961,466 A | 10/1999 | Anbar |
| 5,981,834 A | 11/1999 | John et al. |
| 6,080,914 A | 6/2000 | Conner |
| 6,084,153 A | 7/2000 | Good et al. |
| 6,094,198 A | 7/2000 | Shashua |
| 6,167,151 A | 12/2000 | Albeck et al. |
| 6,201,541 B1 | 3/2001 | Shalom et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,442,419 B1 | 8/2002 | Chu et al. |
| 6,472,588 B1 | 10/2002 | Haigler et al. |
| 6,670,528 B1 | 12/2003 | Shinozaki et al. |
| 6,701,081 B1 | 3/2004 | Dwyer et al. |
| 6,720,477 B2 | 4/2004 | Da Costa e Silva et al. |
| 6,765,607 B2 | 7/2004 | Mizusawa et al. |
| 6,801,257 B2 | 10/2004 | Segev et al. |
| 6,850,862 B1 | 2/2005 | Chidichimo et al. |
| 6,965,690 B2 | 11/2005 | Matsumoto |
| 7,072,504 B2 | 7/2006 | Miyano et al. |
| 7,214,786 B2 | 5/2007 | Kovalic et al. |
| 7,292,719 B2 | 11/2007 | Arnon |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2001/0046316 A1 | 11/2001 | Miyano et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1 | 6/2004 | La Rosa et al. |
| 2004/0172684 A1 | 9/2004 | Kovalic et al. |
| 2004/0181830 A1 | 9/2004 | Kovalic et al. |
| 2004/0236225 A1 | 11/2004 | Murphy et al. |
| 2005/0096515 A1 | 5/2005 | Geng |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 * | 6/2006 | Kikuchi et al. ............... 800/278 |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 * | 7/2006 | Alexandrov et al. ......... 800/288 |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalik et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0196120 A1 | 8/2008 | Wu et al. |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| CN | 1823168 | 8/2006 |
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 7/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |

(56) References Cited

FOREIGN PATENT DOCUMENTS

| | | |
|---|---|---|
| WO | WO 2005/095614 | 10/2005 |
| WO | WO 2005/108422 | 11/2005 |
| WO | WO 2005/121364 | 12/2005 |
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |

OTHER PUBLICATIONS

TAIR p. At1g58030, 2013.*
TAIR p. At5g15080, 2013.*
Hirner et al 2006 The Plant Cell 18: p. 1931-1946.*
The Plant Energy Biology Database 2007 At1g58030.*
Rolletschek et al Apr. 2005 Plant Physiology 137: p. 1236-1249.*
Seki et al 2002 The Plant Journal 31:3 p. 279-292.*
Chow 2005 Planta 220: p. 678-688.*
Soderlund et al 2008 (Genbank BT037402.1).*
Flexas and Medrano 2002 Annals of Botany 89: p. 183-189.*
Examiner's Report Dated Mar. 31, 2011 From the Australian Government, IP Australia Re.: Application No. 2005252469.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7O18 Genomic Sequence, Complete Sequence", GenBank Accession No. AC011437, Oct. 30, 2002.
Patent Examination Report Dated Dec. 12, 2012 From the Australian Government, IP Australia Re. Application No. 2008236316.
International Search Report and the Written Opinion Dated Dec. 6, 2011 From the International Searching Authority Re. Application No. PCT/IB2011/051843.
Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.
Notice of Allowance Dated Nov. 19, 2012 From the US Patent and Trademark Office Re. U.S. Appl. No. 13/450,547.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Communication Pursuant to Rules 70(2) and 70a(2) EPC and Reference to Rule 39(1) EPC Dated Nov. 7, 2011 From the European Patent Office Re. Application No. 11172514.9.
Official Action Dated Dec. 21, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics, 7(3): 225-242, 2006.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Examination Report Dated Jun. 11, 2012 From the Instituto Mexicano de la Propiedad Industrial Re. Application No. MX/a/2011/007294 and Summary in English.
Examiner's Report Dated Jan. 13, 2012 From the Australian Government, IP Australia Re. Application No. 2011239323.
Response Dated Dec. 22, 2011 to Official Action of Aug. 22, 2011 From the US Patent and Trademark Office Re. U.S. Appl. No. 12/457,199.
Supplementary European Search Report and the European Search Opinion Dated Jan. 2, 2012 From the European Patent Office Re. Application No. 09807983.3.
Translation of Decision of Rejection Dated Dec. 9, 2011 From the State Intellectual Property Office of the People's Republic of China Re.: Application No. 200580027481.4.
Adachi et al. "*Oryza sativa japonica* Group cDNA Clone:J023021L06, Full Insert Sequence", Database EMBASE [Online], XP002665608, Retrieved From EBI, Database Accession No. AK099270, Jul. 19, 2003.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 31, 2012 From the Thai Patent Office, Department of Intellectual Property Office Re. Application No. 0901000235.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.

(56) References Cited

OTHER PUBLICATIONS

International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.
International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA, Aug. 30-Sep. 3, 2006, XP031235634, p. 953-956, Aug. 30, 2006. p. 953, § 2, 3.
Aksenov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig. 1.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Kaczmarek et al. "Optical Excitation Methods in Active Dynamic Thermography in Medical Diagnostics", Proceedings of the SPIE—The International Society for Optical Engineering SPIE, XP002519609, 5566(1): 120-126, 2004. p. 121, Last §, p. 123, First §, Fig.3.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Moderhak et al. "Problems of 3D Breast Imaging", Gdansk University of Technology, Department of Biomedical Engineering, 2 P.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig.5.
Restriction Official Action Dated Feb. 1, 2012 From the US Patent and Trademark Office Re. U.S. Appl. No. 12/669,975.
International Search Report and the Written Opinion Dated Aug. 22, 2011 From the International Searching Authority Re: Application No. PCT/IB2010/56023.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examiner's Report Dated Jan. 31, 2012 From the Australian Government, IP Australia Re. Application No. 2006281018.
Office Action Dated Jan. 2, 2012 From the Israel Patent Office Re. Application No. 206118 and Its Translation Into English.
Restriction Official Action Dated Feb. 13, 2012 From the US Patent and Trademark Office Re. U.S. Appl. No. 12/594,853.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Translation of Office Action Dated Feb. 25, 2013 From the State Intellectual Property Office of the People's Republic of China Re. Application No. 200910217137.1.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Invitation to Pay Additional Fees Dated Dec. 18, 2008 From the International Searching Authority Re.: Application No. PCT/IL08/01024.
Communication Pursuant to Article 94(3) EPC Dated Nov. 8, 2010 From the European Patent Office Re.: Application No. 04734072.4.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC Dated Nov. 19, 2010 From the European Patent Office Re.: Application No. 06809784.9.
Communication Pursuant to Article 94(3) EPC Dated Nov. 27, 2009 From the European Patent Office Re.: Application No. 06809784.9.
Communication Pursuant to Rule 70(2) EPC and Reference to Rule 39(1) EPC Dated Sep. 13, 2010 From the European Patent Office Re.: Application No. 09163033.5.

(56) References Cited

OTHER PUBLICATIONS

Communication Relating to the Results of the Partial International Search Dated Jul. 8, 2009 From the International Searching Authority Re.: Application No. PCT/IL2008/001657.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
European Search Report and the European Search Opinion Dated Aug. 9, 2010 From the European Patent Office Re.: Application No. 09163033.5.
Examination Report Dated Nov. 3, 2010 From the Government of India, Patent Office Re.: Application No. 158/CHENP/2007.
Examination Report Dated Nov. 13, 2007 From the Government of India, Patent Office Re.: Application No. 3482/CHENP/2005.
Examination Report Dated Feb. 17, 2010 From the Instituto Mexicano de la Propriedad Industrial Re. Application No. PA/a/2005/012565 and Its Summary in English.
Examination Report Dated Sep. 22, 2010 From the Instituto Mexicano de la Propriedad Industrial Re. Application No. MX/a/2008/005280 and Its Summary Into English.
Examiner's Report Dated Jan. 13, 2011 From the Australian Patent Office Re.: Application No. 2005252469.
Examiner's Report Dated Dec. 17, 2009 From the Australian Patent Office Re.: Application No. 2005252469.
International Preliminary Report on Patentability Dated Dec. 2, 2010 From the International Bureau of WIPO Re. Application No. PCT/IL2009/000508.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jan. 14, 2010 From the International Bureau of WIPO Re.: Application No. PCT/IL2008/000489.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 2, 2010 From the International Searching Authority Re. Application No. PCT/IB09/53633.
International Search Report and the Written Opinion Dated Feb. 17, 2010 From the International Searching Authority Re.: Application No. PCT/IL09/00508.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated Sep. 8, 2006 From the International Searching Authority Re.: Application No. PCT/IL05/00627.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Grant Dated Jan. 14, 2011 From the Instituto Mexicano de la Propriedad Industrial Re. Application No. MX/a/2008/005280.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and Its Translation Into English.
Office Action Dated May 13, 2010 From the Israel Patent Office Re. Application No. 180022 and Its Translation Into English.
Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Partial European Search Report Dated Apr. 19, 2010 From the European Patent Office Re.: Application No. 09163033.5.
Response Dated Jan. 4, 2010 to Official Action of Sep. 2, 2009 From the US Patent and Trademark Office Re.: U.S. Appl. No. 11/629,411.
Response Dated Dec. 5, 2010 to Office Action of Aug. 4, 2010 From the Israel Patent Office Re.: Application No. 172135.

(56) References Cited

OTHER PUBLICATIONS

Response Dated Jan. 7, 2010 to Communication Pursuant to Article 94(3) EPC of Sep. 9, 2009 From the European Patent Office Re.: Application No. 04734072.4.
Response Dated Dec. 12, 2010 to Examiner's Report of Dec. 17, 2009 From the Australian Patent Office Re.: Application No. 2005252469.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Oct. 14, 2010 to Office Action of Jun. 17, 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated May 17, 2010 to Office Action of Jan. 22, 2010 From the State Intellectual Property Office of the People's Republic of China Re.: Application No. 200580027481.4.
Response Dated Jan. 19, 2011 to Supplementary European Search Report and the European Search Opinion of Jul. 1, 2010 From the European Patent Office Re. Application No. 07849616.3.
Response Dated Sep. 21, 2010 to Notice of Allowance of Apr. 16, 2010 From the US Patent and Trademark Office Re.: U.S. Appl. No. 11/629,411.
Response Dated Feb. 22, 2010 to Official Action of Oct. 22, 2009 From the US Patent and Trademark Office Re.: U.S. Appl. No. 11/990,386.
Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Response Dated Jun. 29, 2010 to Examination Report of Feb. 17, 2010 From the Instituto Mexicano de la Propriedad Industrial Re. Application No. PA/a/2005/012565.
Response Dated May 31, 2010 to Office Action of Jan. 31, 2010 From the Israel Patent Office Re.: Application No. 172135.
Summary of Office Action Dated Sep. 2, 2010 From the ROSPATENT, Federal State institution, Federal Institute for Industrial Property of the Federal Service for Intellectual Property, Patents and Trademarks of the Russian Federation Re. Application No. 2008120395.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Aug. 11, 2010 From the European Patent Office Re. Application No. 08738191.9.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.

Translation of Notice of Payment of the Restoration Fee for Unity of Invention Dated Mar. 20, 2009 From the State Intellectual Property Office of the People's Republic of China Re.: Application No. 200580027481.4.
Translation of Office Action Dated Oct. 19, 2010 From the State Intellectual Property Office of the People's Republic of China Re. Application No. 200680038391.X.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/Il04/00431.
Written Opinion Dated Aug. 27, 2008 From the International Searching Authority Re.: Application No. PCT/IL06/00947.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Fran?ois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proceedings of the National Academy of Sciences USA, 101(25): 9205-9210, 2004.

(56) References Cited

OTHER PUBLICATIONS

Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2-p. 1153, col. 1, § 1, Table 1.
Hill et al. "Functional Analysis of Conserved Histidines in ADP-Glucose Pyrophosphorylase From *Escherichia coli*", Biochemical and Biophysical Research Communications, 244(2): 573-577, 1998.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Ji et al. "*Gossypium hirsutum* Expansin mRNA, Complete CDs", XP002474936, Retrieved From EBI Accession No. EMBL:AY189969, Database Accession No. AY189969.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Keskin et al. "A New, Structurally Nonredundant, Diverse Data Set of Protein-Protein Interfaces and Its Implications", Protein Science, 13: 1043-1055, 2004.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "*Lycopersicon esculentum* Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
Li et al. "Isolation of Genes Preferntially Expressed in Cotton Fibers by cDNA Filter Arrays and RT-PCR", Plant Science, 163: 1113-1120, 2002. & GenBank Nucleotide "*Gossypium hirstutum* Dehydration-Iduced Protein RD22-Like Protein (RDL0 mRNA, Complete CDS", GenBank Accession No. AY072821, Dec. 4, 2002.
Liu et al. "Root-Specific Expression of a Western White Pine PR10 Gene Is Mediated by Different Promoter Regions in Transgenic Tobacco", Plant Molecular Biology, 52: 103-120, 2003.
Maurel "Plant Aquaporins: Novel Functions and Regulation Properties", FEBS Letters, XP022078418, 581(12): 2227-2236, May 25, 2007. p. 2230, col. 2, Last §-p. 2231, col. 1, § 2, Fig. 1.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.

S?ez-V?squez et al. "Accumulation and Nuclear Targeting of BnC24, a *Brassica napus* Ribosomal Protein Corresponding to a mRNA Accumulating in Response to Cold Treatment", Plant Science, 156(1): 35-46, 2000.
Smart et al. "MIP Genes Are Down-Regulated Under Drought Stress in *Nicotiana glauca*", Plant and Cell Physiology, XP002455682, 42(7): 686-693, 2001. Retrieved From EBI Accession No. EMBL: AF290618, Database Accession No. AF290618, p. 686, p. 692, 1-h col., § 2.
Smart et al. "*Nicotiana glauca* Putative Delta TIP (MIP2) mRNA, Complete Cds", Database EMBL [Online], Retrieved From EBI Accession No. EMBL: AF290618, Database Accession No. AF290618.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218814, Database Accession No. AW218814. Abstract.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, Database Accession No. AW218815. Abstract.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004.
Wang et al. "Control of Plant Trichome Development by a Cotton Fiber MYB Gene", The Plant Cell, 16: 2323-2334, Sep. 2004. GenEmbl Database, Accession No. AY641990.
Wells "Additivity of Mutational Effects in Proteins", Biochemistry, 29 (37): 8509-8517, 1990.
Wing et al. "An integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Communication Pursuant to Article 94(3) EPC Dated Mar. 8, 2011 From the European Patent Office Re.: Application No. 06809784.9.
Communication Pursuant to Article 94(3) EPC Dated Mar. 14, 2011 From the European Patent Office Re. Application No. 07849616.3.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Yamada e tal. "*Arabidopsis thaliana* Clone RAFL14-87-A16 (R20399) Unknown Protein (Atlg60770) mRNA, Complete Cds", GenBank Accession No. BT002876, Retrieved From the internet, Jan. 21, 2010.
Response Dated Feb. 9, 2011 to Communication Pursuant to Article 94(3) EPC of Nov. 19, 2010 From the European Patent Office Re.: Application No. 06809784.9.

(56) References Cited

OTHER PUBLICATIONS

Examiner's Report Dated Mar. 15, 2012 From the Australian Government, IP Australia Re. Application No. 2011239323.
International Preliminary Report on Patentability Dated Mar. 14, 2013 From the International Bureau of WIPO Re. Application No. PCT/IB2011/053697.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Restriction Official Action Dated Apr. 4, 2013 From the US Patent and Trademark Office Re. U.S. Appl. No. 13/125,047.
Communciation Pursuant to Rules 70(2) and 70a(2) EPC Dated Aug. 30, 2011 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communciation Pursuant to Rules 70(2) and 70a(2) EPC of Aug. 30, 2011 From the European Patent Office Re. Application No. 08738191.9.
Communication Pursuant to Rule 55 EPC Dated Mar. 16, 2012 From the European Patent Office Re. Application No. 11190921.4.
Restriction Official Action Dated Apr. 11, 2012 From the US Patent and Trademark Office Re. U.S. Appl. No. 12/834,106.
Response Dated Mar. 8, 2011 to Examiner's Report of Jan. 13, 2011 From the Australian Government, IP Australia Re.: Application No. 2005252469.
Communication Pursuant to Article 94(3) EPC Dated Apr. 3, 2012 From the European Patent Office Re.: Application No. 06766224.7.
Invitation to Pay Additional Fees Dated May 8, 2012 From the International Searching Authority Re. Application No. PCT/IB11/53697.
Translation of Office Action Dated Apr. 9, 2012 From the State Intellectual Property Office of the People's Republic of China Re. Application No. 200880017707.6.
Official Action Dated May 14, 2012 From the US Patent and Trademark Office Re. U.S. Appl. No. 12/457,199.
Communication Pursuant to Article 93(3) EPC Dated Jun. 15, 2012 From the European Patent Office Re. Application No. 11154193.4.
Communication Pursuant to Article 94(3) EPC Dated Jun. 21, 2012 From the European Patent Office Re. Application No. 11154213.0.
Official Action Dated Jun. 13, 2012 From the US Patent and Trademark Office Re. U.S. Appl. No. 12/594,853.
Blast "BLAST Results", 1 P.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Pursuant to Article 94(3) EPC Dated Jun. 29, 2011 From the European Patent Office Re. Application No. 08738191.9.
Response Dated Jun. 2, 2011 to Office Action of Feb. 3, 2011 From the Israel Patent Office Re.: Application No. 172135.
Examiner's Report Dated Dec. 20, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Office Action Dated Jun. 19, 2011 From the Israel Patent Office Re. Application No. 199391 and Its Translation Into English.
Response Dated Jun. 9, 2011 to Examiner's Report of Dec. 20, 2011 From the Australian Government, IP Australia Re. Application No. 2005234725.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:HV067703, Database Accession No. HV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99,6% Identity to Present SEQ ID No. 7 Over 488 Nucleotides. Abstract, Sequence.
La Rosa et al. "*Oryza sativa* Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Office Action Dated Jun. 20, 2011 From the Israel Patent Office Re. Application No. 190918 and Its Translation Into English.
Partial European Search Report Dated Jul. 12, 2011 From the European Patent Office Re. Application No. 10194223.3.
Response Dated Jun. 15, 2011 to Examiner's Report of Mar. 31, 2011 From the Australian Government, IP Australia Re.: Application No. 2005252469.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Communication Pursuant to Article 94(3) EPC DAted Jul. 13, 2012 From the European Patent Office Re. Application No. 11172514.9.
Official Action Dated Jul. 8, 2011 From the US Patent and Trademark Office Re. U.S. Appl. No. 12/083,978.
Response Dated Jun. 17, 2011 to Examiner's Report of Mar. 31, 2011 From the Australian Government, IP Australia Re.: Application No. 2005252469.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
International Search Report and the Written Opinion Dated Aug. 6, 2012 From the International Searching Authority Re. Application No. PCT/IB11/53697.

(56) References Cited

OTHER PUBLICATIONS

Daniell et al. "*Solanum bulbocastanum* Chloroplast, Complete Genome", GenBank NCBI, Accession No. NC 007943, Mar. 26, 2010. p. 1, Source, p. 10-11, Nucleotides 46590-47195, Gene 'RPS4'.

Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.1.

Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.

Payne et al. "GL3 Encodes a bHLH Protein That Regulates Trichome Development in *Arabidopsis* Through Interaction With GL1 and TTG1", Genetics, 156: 1349-1362, Nov. 2000.

Response Dated Aug. 11, 2011 to Examination Report of Aug. 1, 2011 From the Government of India, Patent Office Re.: Application No. 158/CHENP/2007.

Translation of Office Action Dated Jul. 1, 2011 From the State Intellectual Property Office of the People's Republic of China Re. Application No. 200880017707.6.

Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.

International Search Report and the Written Opinion Dated Sep. 7, 2010 From the International Searching Authority Re. Application No. PCT/IB10/50871.

Invitation to Pay Additional Fees Dated Jun. 9, 2011 From the International Searching Authority Re. Application No. PCT/IB10/56023.

Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.

Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.

Hattori et al. "An Acetohydroxy Acid Synthase Mutant Reveals a Single Site Involved in Multiple Herbicide Resistance", Molecular and General Genetics, 246: 419-425, 1995. Abstract!

Holmström et al. "Drought Tolerance in Tobacco", Nature, 379: 683-684, 1996. Abstract!

Jiao et al.

Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!

Pilon-Smits et al. "Improved Performance of Transgenic Fructan-Accumulating Tobacco under Drought Stress", Plant Physiology, 107: 125-130, 1995.

Quesada et al. "Genetic Architecture of NaCl Tolerance in *Arabidopsis*", Plant Physiology, 130: 951-963, 2002. Abstract!

Saijo et al. "Over-Expression of a Single Ca 2+-Dependent Protein Kinase Confers Both Cold and Salt/Drought Tolerance on Rice Plants", The Plant Journal 23(3): 319-327, 2000.

Skriver et al. "Cis-Acting DNA Elements Responsive to Gibberellin and Its Antagonist Abscisic Acid", Proceedings of the National Academy of Sciences USA 88: 7266-7270, 1991.

Tarczynski et al. "Stress Protection of Transgenic Tobacco by Production of the Osmolyte Mannitol", Science, 259: 508-510, 1993. Abstract!

van Haaren et al. "A Functional Map of the Fruit-Specific Promoter of the Tomato 2A11 Gene", Plant Molecular Biology, 21: 625-640, 1993. Abstract!

Vigcolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!

Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716 - 729, 2007. Abstract!

Xu et al. "Expression of a Late Embryogenesis Abundant Protein Gene, HVA1 , From Barley Confers Tolerance to Water Deficit and Salt Stress in Transgenic Rice", Plant Physiology, 110: 249-257, 1996.

Yanagisawa et al. "Diversity and Similarity Among Recognition Sequences of Dof Transcription Factors", The Plant Journal, 17(2): 209-214, 1999.

Zabrouskov et al. "Oxidative Metabolism and the Physiological Age of Seed Potatoes Are Affected by Increased Alpha-Linolenate Content", Physiologia Plantarum, 116: 172-185, 2002.

International Preliminary Report on Patentability Dated Feb. 21, 2013 From the International Bureau of WIPO Re. Application No. PCT/IB2011/051843.

Official Action Dated Feb. 8, 2013 From the US Patent and Trademark Office Re. U.S. Appl. No. 12/594,853.

Supplementary European Search Report and the European Search Opinion Dated Feb. 14, 2013 From the European Patent Office Re. Application No. 10785834.2.

Translation of Notification of the Office Action Dated Dec. 1, 2011 From the State Intellectual Property Office of the People's Republic of China Re. Application No. 200680047610.0.

Communication Pursuant to Article 94(3) EPC Dated Dec. 19, 2012 From the European Patent Office Re.: Application No. 04734072.4.

Official Action Dated Dec. 18, 2012 From the US Patent and Trademark Office Re. U.S. Appl. No. 12/834,106.

Benfey et al. "The CaMV 35S Enhancer Contains at Least Two Domains Which Can Confer Different Development and Tissue-Specific Expression Patterns", The EMBO Journal, 8(8): 2195-2202, 1989.

Benfey et al. "The Cauliflower Mosaic Virus 35S Promoter: Combinatorial Regulation of Transcription in Plants", Science, 250(4983): 959-966, Nov. 16, 1990.

Response Dated Dec. 19, 2011 to Examiner's Report of Oct. 19, 2011 From the Australian Government, IP Australia Re. Application No. 2006281018.

Response Dated Jun. 29, 2011 to Communication Pursuant to Article 94(3) EPC of Mar. 8, 2011 From the European Patent Office Re.: Application No. 06809784.9.

Translation of Office Action Dated Jan. 4, 2012 From the State Intellectual Property Office of the People's Republic of China Re. Application No. 200880109464.9.

Translation of Office Action Dated Jan. 17, 2012 From the State Intellectual Property Office of the People's Republic of China Re. Application No. 201110104274.1.

Translation of Office Action Dated Dec. 31, 2011 From the State Intellectual Property Office of the People's Republic of China Re. Application No. 200910217137.1.

Office Action Dated Feb. 3, 2011 From the Israel Patent Office Re.: Application No. 172135 and Its Translation Into English.

Official Action Dated Feb. 15, 2011 From the US Patent and Trademark Office Re. U.S. Appl. No. 12/448,359.

International Preliminary Report on Patentability Dated Mar. 3, 2011 From the International Bureau of WIPO Re.: Application No. PCT/IB2009/053633.

Restriction Official Action Dated Mar. 1, 2013 From the US Patent and Trademark Office Re. U.S. Appl. No. 13/254,183.

Official Action Dated Apr. 10, 2012 From the US Patent and Trademark Office Re. U.S. Appl. No. 12/669,975.

Response Dated Mar. 9, 2011 to Office Action of Nov. 11, 2010 From the Israel Patent Office Re. Application No. 206118.

Response Dated Mar. 23, 2011 to Official Action of Nov. 23, 2010 From the US Patent and Trademark Office Re. U.S. Appl. No. 12/083,978.

Response Dated Mar. 24, 2011 to Examination Report of Nov. 3, 2010 From the Government of India, Patent Office Re.: Application No. 158/CHENP/2007.

Official Action Dated May 10, 2011 From the US Patent and Trademark Office Re. U.S. Appl. No. 12/457,199.

(56) References Cited

OTHER PUBLICATIONS

Official Action Dated Apr. 29, 2011 From the US Patent and Trademark Office Re. U.S. Appl. No. 12/448,359.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Payne et al. "Heterologous MYB Genes Distinct From GL1 Enhance Trichome Production When Overexpressed in Nicotiana tabacum", Development, 126: 671-682, 1999.
Sunkar et al. "Small RNAs as Big Players in Plant Abiotic Stress Responses and Nutrient Deprivation", Trends in Plant Science XP022148764, 12(7): 301-309, Jul. 1, 2007.
Communication Pursuant to Rules 70(2) and 70a(2) EPC Dated May 24, 2011 From the European Patent Office Re. Application No. 09750276.9.
Examination Report Dated Apr. 19, 2011 From the Instituto Mexicano de la Propriedad Industrial Re. Application No. MX/a/2008/002262 and Its Summary Into English.
Requisition by the Examiner Dated Jun. 15, 2011 From the Canadian Intellectual Property Office Re. Application No. 2,526,440.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Examiner's Report Dated Jul. 21, 2011 From the Australian Government, IP Australia Re. Application No. 2005234725.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Jun. 6, 2011 to Official Action of May 10, 2011 From the US Patent and Trademark Office Re. U.S. Appl. No. 12/457,199.
Response Dated Jul. 25, 2011 to Examiner's Report of Jul. 21, 2011 From the Australian Government, IP Australia Re. Application No. 2005234725.
Examination Report Dated Aug. 1, 2011 From the Government of India, Patent Office Re.: Application No. 158/CHENP/2007.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Response Dated Jul. 6, 2011 to Examiner's Report of Dec. 20, 2010 From the Australian Government, IP Australia Re. Application No. 2005234725.
Response Dated Jul. 20, 2011 to Examination Report of May 25, 2011 From the Government of India, Patent Office Re.: Application No. 158/CHENP/2007.
Translation of Notification of the First Office Action Dated Jun. 30, 2011 From the State Intellectual Property Office of the People's Republic of China Re. Application No. 200680047610.0.
Van der Hoeven et al. "EST312975 Tomato Root During/After Fruit Set, Cornell University Solanum lycopersicum cDNA Clone cLEX14O20 5-, mRNA Sequence", GenBank, GenBank Accession No. AW622177.1.
Applicant-Initiated Interview Summary Dated Aug. 6, 2012 From the US Patent and Trademark Office Re. U.S. Appl. No. 12/669,975.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
Advisory Action Before the Filing of an Appeal Brief Dated Aug. 5, 2011 From the US Patent and Trademark Office Re. U.S. Appl. No. 12/083,978.
Invitation to Pay Additional Fees Dated Aug. 18, 2011 From the International Searching Authority Re.: Application No. PCT/IL08/00489.
Katavic et al. "Utility of the Arabidopsis FAE1 and Yeast SLC1-1 Genes for Improvement in Erucic Acid and Oil Content in Rapeseed", Biochemical Society Transaction, 28(6): 935-937, Dec. 2000.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
International Preliminary Report on Patentability Dated Sep. 15, 2011 From the International Bureau of WIPO Re. Application No. PCT/IB2010/050871.
Official Action Dated Aug. 22, 2011 From the US Patent and Trademark Office Re. U.S. Appl. No. 12/457,199.
Johansson et al. "The Role of Aquaporins in Cellular and Whole Plant Water Balance," Biochimica et Biophysica Acta 1465: 324-342, 2000.
Whisstock et al. "Prediction of Protein Function from Protein Sequence and Structure," Quarterly Reviews of Biophysics 36 (3): 307-340, Aug. 2003.
Response Dated Sep. 25, 2011 to Examiner's Report of Jun. 30, 2011 From the Australian Government, IP Australia Re. Application No. 2006307457.
European Search Report and the European Search Opinion Dated Oct. 6, 2011 From the European Patent Office Re. Application No. 11172514.9.
Taliercio et al. "GH_TMIRS_129_G10_F Cooton Normalized Library dT Primed Gossypium hirsutum cDNA, mRNA Sequence", EMBL-Bank, XP002659970, Retrieved From EBI Accession No. EM EST:DW508992, Database Accession No. DW508992.
Taliercio et al. "GH_TMIRS_129_G10_R Cotton Normalized Library dT Primed Gossypium hirsutum cDNA, mRNA Sequence", EMBL-Bank, XP002659971, Retrieved From EBI Accession No. EM_EST:DW508993, Database Accession No. DW508993.
Official Action Dated Sep. 19, 2011 From the US Patent and Trademark Office Re. U.S. Appl. No. 12/810,855.
Response Dated Oct. 3, 2011 to Examiner's Report of Jun. 24, 2011 From the Australian Government, IP Australia Re. Application No. 2006281018.
Response Dated Oct. 4, 2011 to Official Action of Jul. 8, 2011 From the US Patent and Trademark Office Re. U.S. Appl. No. 12/083,978.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.

(56) References Cited

OTHER PUBLICATIONS

Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Bautista et al. "*Arabidopsis thaliana* At5g06690 mRNA, Complete Cds", Unpublished, The Salk Institute for Biological Studies, La Jolla, CA, USA, GenBank: BT029447, Nov. 15, 2006.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM PL: BT022032.1, Database Accession No. BT022032, May 4, 2005.
Matsumoto et al. "*Hordeum vulgare* Subsp. *vulgare*, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Translation of Office Action Dated Sep. 13, 2012 From the State Intellectual Property Office of the People's Republic of China Re. Application No. 200910217137.1.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA, PNAS, XP002967292, 97(14): 7969-7974, Jul. 5, 2000.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus *Solanum lycopersicum* cDNA Clone cLEC80A19 5-end, mRNA Sequence", GenBank: BI923254.1, GenBank Accession No. BI923254, Oct. 17, 2001.
European Search Report and the European Search Opinion Dated Nov. 2, 2011 From the European Patent Office Re. Application No. 10194223.3.
Examiner's Report Dated Oct. 19, 2011 From the Australian Government, IP Australia Re. Application No. 2006281018.

Examiner's Report Dated Oct. 28, 2011 From the Australian Government, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Restriction Official Action Dated Nov. 13, 2012 From the US Patent and Trademark Office Re. U.S. Appl. No. 12/992,902.
Backhaus et al. "Nucleotide Sequence of a cDNA for a P2 60S Acidic Ribosomal Protein From *Parthenium argentatum*", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Response Dated Oct. 18, 2011 to Official Action of Sep. 19, 2011 From the US Patent and Trademark Office Re. U.S. Appl. No. 12/810,855.
Communication Under Rule 71(3) EPC Dated Nov. 19, 2012 From the European Patent Office Re. Application No. 08738191.9.
Communication Pursuant to Article 94(3) EPC Dated May 8, 2013 From the European Patent Office Re. Application No. 08776651.5.
Patent Examination Report Dated May 31, 2013 From the Australian Government, IP Australia Re. Application No. 2008278654.
Patent Examination Report Dated Jun. 27, 2013 From the Australian Government, IP Australia Re. Application No. 2012216482.
Matz et al. "*Gossypium hirsutum* GHDEL65 (ghdel65) mRNA, Complete CDS", GenBank Nucleotide, GenBank Accession No. AF336280, Mar. 15, 2001.
Examination Report Dated May 23, 2013 From the Instituto Mexicano de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
International Search Report and the Written Opinion Dated May 12, 2013 From the International Searching Authority Re. Application No. PCT/IL2013/050172.
Official Action Dated May 8, 2013 From the US Patent and Trademark Office Re. U.S. Appl. No. 13/125,047.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [*Medicago truncatula*]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in *Arabidopsis*", The Plant Cell, 24: 4555-4576, Nov. 2012.
Official Action Dated Jul. 26, 2013 From the US Patent and Trademark Office Re. U.S. Appl. No. 13/254,183.

(56) References Cited

OTHER PUBLICATIONS

Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
Examiner's Report Dated Dec. 20, 2010 From the Australian Government, IP Australia Re. Application No. 2005234725.
International Preliminary Report on Patentability Dated Jul. 4, 2013 From the International Bureau of WIPO Re. Application No. PCT/IB2011/055854.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
Office Action Dated Apr. 1, 2013 From the State Intellectual Property Office of the People's Republic of China Re. Application No. 200880127757.X and Its Translation Into English.
Communication Pursuant to Article 94(3) EPC Dated May 29, 2013 From the European Patent Office Re. Application No. 09823171.5.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
*Arabidopsis* Genome Initiative "Analysis of the Genome Sequence of the Flowering Plant *Arabicopsis thaliana*" Nature, 408: 796-815, Dec. 14, 2000.
Ciddi et al. "Elicitation of *Taxus* Sp. Cell Cultures for Production of Taxol", Biotechnology Letters, 17(12): 1343-1346, Dec. 1995.
Kikuchi et al. "*Oryza sativa* Japonica Group cDNA Clone:J023131O04, Full Insert Sequence", GenBank Database Accession No. AK072531, Jul. 2, 2013.
Lurin et al. "Genome-Wide Analysis of *Arabidopsis* Pentatricopeptide Repeat Proteins Reveals Their Essential Role in Organelle Biogenesis", The plant Cell, 16: 2089-2103, Aug. 2004.
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Advisory Action Before the Filing of an Appeal Brief Dated Nov. 19, 2013 From the US Patent and Trademark Office Re. U.S. Appl. No. 12/834,106.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Applicant-Initiated Interview Summary Dated Nov. 20, 2013 From the US Patent and Trademark Office Re. U.S. Appl. No. 13/125,047.
Examination Report Dated Oct. 1, 2013 From the Instituto Mexicano de la Propiedad Industrial Re. Application No. MX/a/2010/000975 and Its Translation Into English.
Examination Report Dated Dec. 16, 2013 From the Government of India, Patent Office, Intellectual Property Building Re. Application No. 2570/CHENP/2008.
International Preliminary Report on Patentability Dated Nov. 14, 2013 From the International Bureau of WIPO Re. Application No. PCT/IL2012/050154.
International Search Report and the Written Opinion Dated Nov. 19, 2013 From the International Searching Authority Re. Application No. PCT/IL2013/050725.
Requisition by the Examiner Dated Oct. 28, 2013 From the Canadian Intellectual Property Office Re. Application No. 2,570,195.

Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Li et al. "Dehydration-induced Protein RD22-Like Protein [*Gossypium hirsutum*]", NCBI Database [Online], GenBank: AAL67991.1, GenBank Accession No. AAL67991, Dec. 4, 2002.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Examination Report Dated Dec. 2, 2013 From the Instituto Mexican de la Propiedad industrial Re. Application No. MX/a/2011/001741 and its Translation Into English.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propiedad Industrial Re. Application No. MX/a/2011/009044 and Its Translation Into English.
Office Action Dated Oct. 28, 2013 From the State Intellectual Property Office of the People's Republic of China Re. Application No. 201110104274.1 and Its Translation Into English.
Communication Pursuant to Article 94(3) EPC Dated Oct. 9, 2013 From the European Patent Office Re. Application No. 08869158.9.
Communication Pursuant to Article 94(3) EPC Dated Aug. 20, 2013 From the European Patent Office Re. Application No. 11172514.9.
International Search Report and the Written Opinion Dated Sep. 1, 2013 From the International Searching Authority Re. Application No. PCT/IB2013/054374.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Official Action Dated Sep. 16, 2013 From the US Patent and Trademark Office Re. U.S. Appl. No. 13/125,047.
Official Action Dated Sep. 20, 2013 From the US Patent and Trademark Office Re. U.S. Appl. No. 12/669,975.
Supplementary European Search Report and the European Search Opinion Dated Oct. 15, 2013 From the European Patent Office Re. Application No. 10840687.7.
Translation of Office Action Dated Aug. 28, 2013 From the State Intellectual Property Office of the People's Republic of China Re. Application No. 200880109464.9.
Bennetzen et al. "*Setaria italica* Strain Yugul SETITScaffold_2_Cont751, Whole Genome Shotgun Sequence", Database NCBI [Online], GenB ank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
Clontech "Genome Walker™ Universal Kit User Manual", Clontech Laboratories Inc., Cat. No. 638904, PT3042-1 (PR742239), p. 1-30, Apr. 25, 2007.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
NCBI "PREDICTED: Nudix Hydrolase 16, Mitochondrial-Like [*Setaria italica*]", Database NCBI [Online], NCBI Reference Sequence: XP_004955808, Jun. 26, 2013.
Paterson et al. "*Sorghum bicolor* Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.

(56) References Cited

OTHER PUBLICATIONS

Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Notice of Allowance Dated Nov. 15, 2013 From the US Patent and Trademark Office Re. U.S. Appl. No. 12/669,975.
Requisition by the Examiner Dated Aug. 27, 2013 From the Canadian Intellectual Property Office Re. Application No. 2,526,440.
Communication Pursuant to Article 94(3) EPC Dated May 19, 2014 From the European Patent Office Re. Application No. 09807983.3.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Examination Report Dated Aug. 15, 2014 From the Instituto Mexicano de la Propiedad industrial Re. Application No. MX/a/2011/001741 and its Translation Into English.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
Examination Report Dated Mar. 23, 2013 From the Government of India, Patent Office, Intellectual Property Building Re. Application No. 2570/CHENP/2008.
Communication Pursuant to Rules 70(2) and 70a(2) EPC and Reference to Rule 39(1) EPC Dated Dec. 5, 2011 From the European Patent Office Re. Application No. 10194223.3.
Examiner's Report Dated Jan. 10, 2012 From the Australian Government, IP Australia Re. Application No. 2005234725.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.

\* cited by examiner

USE OF CAD GENES TO INCREASE NITROGEN USE EFFICIENCY AND LOW NITROGEN TOLERANCE TO A PLANT

RELATED APPLICATIONS

This application is a National Phase of PCT Patent Application No. PCT/IB2009/053633 having International filing date of Aug. 18, 2009, which claims the benefit of priority of U.S. Provisional Patent Application No. 61/136,189 filed on Aug. 18, 2008. The contents of the above applications are all incorporated herein by reference.

FIELD AND BACKGROUND OF THE INVENTION

The present invention, in some embodiments thereof, relates to isolated polypeptides and polynucleotides, nucleic acid constructs comprising same, transgenic plants expressing same and methods of using same for increasing nitrogen use efficiency, yield, biomass, vigor, growth rate, oil content, fertilizer use efficiency, water use efficiency and abiotic stress tolerance of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is the only one that usually needs to be replenished every year, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat.

Nitrogen is an essential macronutrient for the plant, responsible for biosynthesis of amino and nucleic acids, prosthetic groups, plant hormones, plant chemical defenses, etc. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 2005010879 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

The global shortage of water supply, desertification, abiotic stress (ABS) conditions (e.g., drought, salinity, osmoticum, flood, suboptimal temperatures such as cold and heat, toxic chemical pollution, radiation, nutrient deficiencies, and the like) together with the presence of limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Extreme temperatures such as suboptimal or heat temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

SUMMARY OF THE INVENTION

According to an aspect of some embodiments of the present invention there is provided a method of increasing nitrogen use efficiency, fertilizer use efficiency, yield, growth rate, vigor, biomass, oil content and/or abiotic stress tolerance of a plant, comprising expressing within the plant an exogenous polynucleotide comprising a nucleic acid sequence at least 80% identical to SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522, thereby increasing the nitrogen use efficiency, fertilizer use efficiency, yield, growth rate, vigor, biomass, oil content and/or abiotic stress tolerance of the plant.

According to an aspect of some embodiments of the present invention there is provided a method of increasing nitrogen use efficiency, fertilizer use efficiency, yield, growth rate, vigor, biomass, oil content and/or abiotic stress tolerance of a plant, comprising expressing within the plant an exogenous polynucleotide comprising the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 and 2457, thereby increasing the nitrogen use efficiency, fertilizer use efficiency, yield, growth rate, vigor, biomass, oil content and/or abiotic stress tolerance of the plant.

According to an aspect of some embodiments of the present invention there is provided a method of increasing nitrogen use efficiency, fertilizer use efficiency, yield, growth rate, vigor, biomass, oil content and/or abiotic stress tolerance of a plant, comprising expressing within the plant an exogenous polynucleotide comprising a nucleic acid sequence encoding a polypeptide at least 80% identical to SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2562 or 2563, thereby increasing the nitrogen use efficiency, fertilizer use efficiency, yield, growth rate, vigor, biomass, oil content and/or abiotic stress tolerance of the plant.

According to an aspect of some embodiments of the present invention there is provided a method of increasing nitrogen use efficiency, fertilizer use efficiency, yield, growth rate, vigor, biomass, oil content and/or abiotic stress tolerance of a plant, comprising expressing within the plant an exogenous polynucleotide comprising a nucleic acid sequence encoding a polypeptide selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543, thereby increasing the nitrogen use efficiency, fertilizer use efficiency, yield, growth rate, vigor, biomass, oil content and/or abiotic stress tolerance of the plant.

According to an aspect of some embodiments of the present invention there is provided a method of increasing nitrogen use efficiency, fertilizer use efficiency and/or oil content of a plant, comprising expressing within the plant an exogenous polynucleotide comprising a nucleic acid sequence at least 80% identical to SEQ ID NO: 3, 5, 6, 9, 10, 14, 15, 288, 294, 2398-2412 or 2413, thereby increasing the nitrogen use efficiency, fertilizer use efficiency, and/or oil content of the plant.

According to an aspect of some embodiments of the present invention there is provided a method of increasing nitrogen use efficiency, fertilizer use efficiency and/or oil content of a plant, comprising expressing within the plant an exogenous polynucleotide comprising the nucleic acid sequence selected from the group consisting of SEQ ID NOs: 3, 5, 6, 9, 10, 14, 15, 288, 294, 2398-2413, thereby increasing the nitrogen use efficiency, fertilizer use efficiency and/or oil content of the plant.

According to an aspect of some embodiments of the present invention there is provided a method of increasing nitrogen use efficiency, fertilizer use efficiency and/or oil content of a plant, comprising expressing within the plant an exogenous polynucleotide comprising a nucleic acid sequence encoding a polypeptide at least 80% identical to SEQ ID NO: 138-153, 1334-1350, 1352-1364, 1458, 1460, 2523-2531 or 2532, thereby increasing the nitrogen use efficiency, fertilizer use efficiency and/or oil content of the plant.

According to an aspect of some embodiments of the present invention there is provided a method of increasing nitrogen use efficiency, fertilizer use efficiency and/or oil content of a plant, comprising expressing within the plant an exogenous polynucleotide comprising a nucleic acid sequence encoding a polypeptide selected from the group consisting of SEQ ID NOs: 138-153, 1334-1350, 1352-1364, 1458, 1460, 2523-2532, thereby increasing the nitrogen use efficiency, fertilizer use efficiency and/or oil content of the plant.

According to an aspect of some embodiments of the present invention there is provided an isolated polynucleotide comprising a nucleic acid sequence at least 80% identical to SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522, wherein the nucleic acid sequence is capable of increasing nitrogen use efficiency, fertilizer use efficiency, yield, growth rate, vigor, biomass, oil content and/or abiotic stress of a plant.

According to an aspect of some embodiments of the present invention there is provided an isolated polynucleotide comprising the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 and 2457.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2562 or 2563, wherein the amino acid sequence is capable of increasing nitrogen use efficiency, fertilizer use efficiency, yield, growth rate, vigor, biomass, oil content and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543.

According to an aspect of some embodiments of the present invention there is provided a nucleic acid construct comprising the isolated polynucleotide of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2562 or 2563, wherein the amino acid sequence is capable of increasing nitrogen use efficiency, fertilizer use efficiency, yield, growth rate, vigor, biomass, oil content and/or abiotic stress tolerance of a plant.

According to an aspect of some embodiments of the present invention there is provided an isolated polypeptide comprising the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543.

According to an aspect of some embodiments of the present invention there is provided a plant cell exogenously expressing the polynucleotide of the invention, or the nucleic acid construct of the invention.

According to an aspect of some embodiments of the present invention there is provided a plant cell exogenously expressing the polypeptide of the invention.

According to some embodiments of the invention, the nucleic acid sequence is as set forth in SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522.

According to some embodiments of the invention, the polynucleotide consists of the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522.

According to some embodiments of the invention, the nucleic acid sequence encodes an amino acid sequence at least 80% homologous to SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2562 or 2563.

According to some embodiments of the invention, the nucleic acid sequence encodes the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563.

According to some embodiments of the invention, the nucleic acid sequence is as set forth in SEQ ID NO: 3, 5, 6, 9, 10, 14, 15, 288, 294, 2398-2412 or 2413.

According to some embodiments of the invention, the polynucleotide consists of the nucleic acid sequence selected from the group consisting of SEQ ID NOs: 3, 5, 6, 9, 10, 14, 15, 288, 294, 2398-2413.

According to some embodiments of the invention, the nucleic acid sequence encodes an amino acid sequence at least 80% homologous to SEQ ID NO: 138-153, 1334-1350, 1352-1364, 1458, 1460, 2523-2531 or 2532.

According to some embodiments of the invention, the nucleic acid sequence encodes the amino acid sequence selected from the group consisting of SEQ ID NOs: 138-153, 1334-1350, 1352-1364, 1458, 1460, 2523-2532.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 3A—An image of a photograph of plants taken following 10 days on agar plates. FIG. 3B—An image of root analysis in which the length of the root measured is represented by a red arrow.

DESCRIPTION OF SPECIFIC EMBODIMENTS OF THE INVENTION

Figure 1:
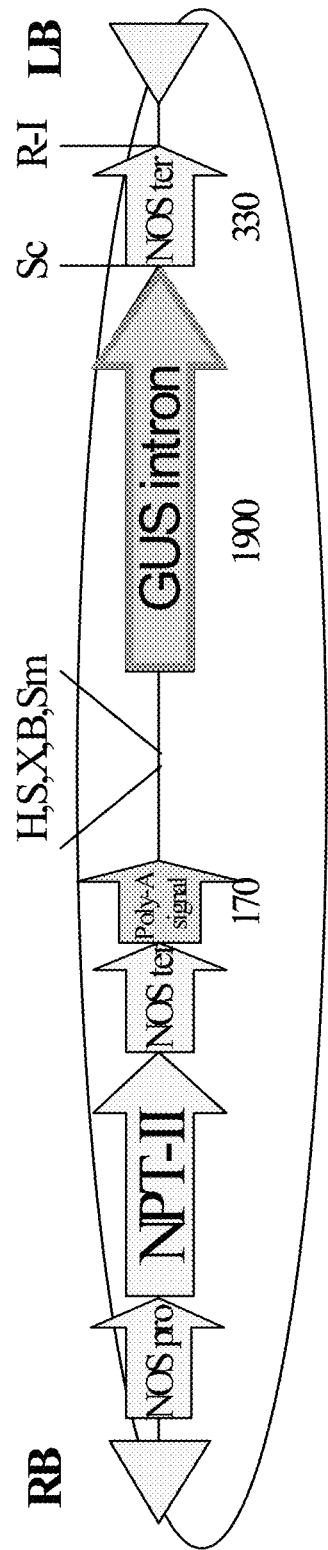
FIG. 1 is a schematic illustration of the pGI binary plasmid used for expressing the isolated polynucleotide sequences of some embodiments of the invention. RB—T-DNA right border; LB—T-DNA left border; H—HindIII restriction enzyme; X—XbaI restriction enzyme; B—BamHI restriction enzyme; S—SalI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene
Figure 2:
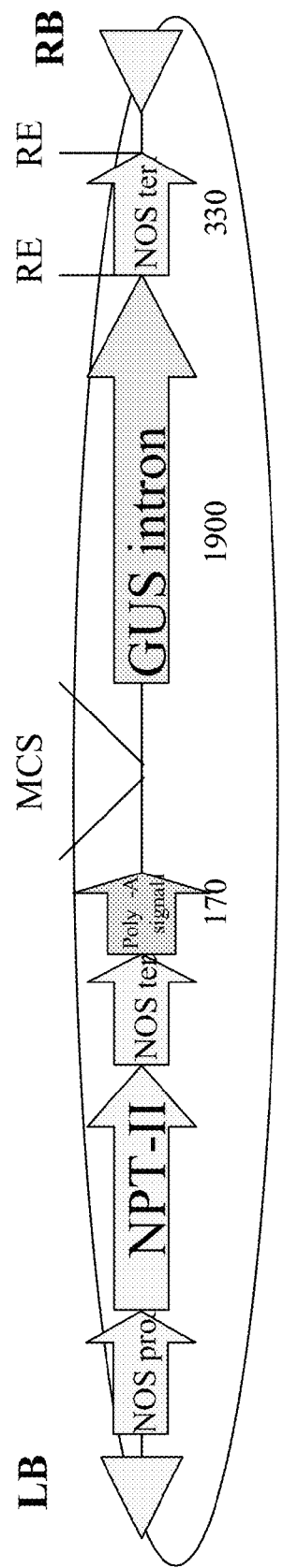
FIG. 2 is a schematic illustration of the modified pGI binary plasmid used for expressing the isolated polynucleotide sequences of the invention. RB—T-DNA right border; LB—T-DNA left border; MCS—Multiple cloning site; RE—any restriction enzyme; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene.

The present invention, in some embodiments thereof, relates to isolated polynucleotides and polypeptides, expression vectors comprising same and transgenic plants expressing same and, more particularly, but not exclusively, to methods of increasing nitrogen use efficiency, yield, biomass, vigor, growth rate, oil content and abiotic stress tolerance of a plant using same.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the present inventors have identified novel polypeptides and polynucleotides which can be used to increase nitrogen use efficiency, fertilizer use efficiency, water use efficiency, yield, growth rate, biomass, oil content, vigor and/or abiotic stress tolerance of a plant.

Thus, as shown in the Examples section which follows, the present inventors have utilized bioinformatics tools to generate digital expression profiles of gene clusters which expression level is associated with various conditions and stresses such as nutrient deficiency, cold, salinity, drought, heat stress, etiolation, waterlogging and oxidative stress (Tables 1-19; Example 1 of the Examples section which follows), and based on the expression profiles have identified genes which are expected to enhance nitrogen use efficiency, biomass, growth rate, yield, vigor, oil content and/or abiotic stress tolerance of a plant (Table 20; polynucleotide SEQ ID NOs:1-137; polypeptides SEQ ID NOs:138-269; Example 1 of the Examples section which follows). Homologous polypeptides and polynucleotides having the same function were also identified (Table 21, polynucleotide SEQ ID NOs:270-1333;

polypeptide SEQ ID NOs:1334-2397; Example 2 of the Examples section which follows). To test the effect of the isolated genes on the trait-of-interest, the polynucleotides were cloned into binary vectors (Table 23, polynucleotide SEQ ID NOs:2398-2522; Example 3 of the Examples section which follows) and the predicted proteins were identified (Table 23, Example 3). Transgenic plants over-expressing the identified polynucleotides were found to exhibit increased nitrogen use efficiency, yield, biomass, photosynthetic areas and growth rate (Tables 24-521 Examples 5, 6 and 7 of the Examples section which follows), as well as increased abiotic stress tolerance (e.g., under salinity stress; Tables 53-55, Example 8 of the Examples section which follows). Altogether, these results suggest the use of the novel polynucleotides and polypeptides of the invention and homologous sequences thereof for increasing nitrogen use efficiency, fertilizer use efficiency, yield (including oil yield, seed yield and oil content), growth rate, biomass, vigor and/or abiotic stress tolerance of a plant.

Thus, according to an aspect of some embodiments of the invention, there is provided method of increasing fertilizer use efficiency, nitrogen use efficiency, yield, growth rate, vigor, biomass, oil content and/or abiotic stress tolerance of a plant, comprising expressing within the plant an exogenous polynucleotide comprising a nucleic acid sequence at least 80% identical to SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522, thereby increasing the nitrogen use efficiency, fertilizer use efficiency, yield, growth rate, vigor, biomass, oil content, water use efficiency and/or abiotic stress tolerance of the plant.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

As used herein the phrase "plant yield" refers to the amount (as determined by weight or size) or quantity (numbers) of tissue produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "plant biomass" refers to the amount (measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ size or mass per time (can be measured in $cm^2$ per day, day or as the regression coefficient of along time course).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) result with improved field stand.

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

It should be noted that a plant yield can be determined under stress (e.g., abiotic stress, nitrogen-limiting conditions) or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), which enable normal metabolism, growth, reproduction and/or viability of a plant at any stage in its life cycle (from seed to mature plant and back to seed again). It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in nitrogen use efficiency, fertilizer use efficiency, yield, growth rate, vigor, biomass, oil content, water use efficiency and/or abiotic stress tolerance of a plant as compared to a native plant [i.e., a plant not modified with the biomolecules (polynucleotide or polypeptides) of the invention, e.g., a non-transformed plant of the same species which is grown under the same growth conditions).

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical to the polynucleotide selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522.

According to some embodiments of the invention the exogenous polynucleotide is set forth by SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2521 or 2522.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2562 or 2563.

According to an aspect of some embodiments of the invention there is provided a method of increasing nitrogen use efficiency, fertilizer use efficiency, yield, growth rate, vigor, biomass, oil content and/or abiotic stress tolerance of a plant. The method is effected by expressing within the plant an exogenous polynucleotide. comprising the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 and 2457, thereby increasing the nitrogen use efficiency, fertilizer use efficiency, yield, growth rate, vigor, biomass, oil content and/or abiotic stress tolerance of the plant.

According to some embodiments of the invention the exogenous polynucleotide is set forth by SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 or 2457.

According to some embodiments of the invention, the exogenous polynucleotide of the invention encodes a polypeptide having an amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543, thereby increasing the nitrogen use efficiency, fertilizer use efficiency, yield, growth rate, vigor, biomass, oil content and/or abiotic stress tolerance of the plant.

According to an aspect of some embodiments of the invention there is provided a method of increasing nitrogen use efficiency, fertilizer use efficiency and/or oil content of a plant. The method is effected by expressing within the plant an exogenous polynucleotide comprising a nucleic acid sequence at least 80% identical to SEQ ID NO: 3, 5, 6, 9, 10, 14, 15, 288, 294, 2398-2412 or 2413, thereby increasing the nitrogen use efficiency, fertilizer use efficiency, and/or oil content of the plant.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 3, 5, 6, 9, 10, 14, 15, 288, 294, 2398-2413.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 3, 5, 6, 9, 10, 14, 15, 288, 294, 2398-2413.

According to some embodiments of the invention the exogenous polynucleotide is set forth by SEQ ID NO: 3, 5, 6, 9, 10, 14, 15, 288, 294, 2398-2412 or 2413.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 138-153, 1334-1350, 1352-1364, 1458, 1460, 2523-2532.

According to some embodiments of the invention, the exogenous polynucleotide encodes a polypeptide consisting of the amino acid sequence set forth by SEQ ID NO: 138-153, 1334-1350, 1352-1364, 1458, 1460, 2523-2531 or 2532.

Nucleic acid sequences encoding the polypeptides of the present invention may be optimized for expression. Non-limiting examples of optimized nucleic acid sequences are provided in SEQ ID NOs: 2415, 2420, 2428, 2430, 2431, 2436, 2437, 2441, 2444, 2445, 2446, 2451, 2456, 2468, 2471, 2478, 2481, 2484, 2520 and 2522 (Table 23). Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

According to a specific embodiment the non-coding polynucleotide comprises the nucleic acid sequence of SEQ ID NO:64 or 2459 (NUE512).

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522.

According to some embodiments of the invention the nucleic acid sequence is capable of increasing nitrogen use efficiency, fertilizer use efficiency, yield, growth rate, vigor, biomass, oil content, abiotic stress tolerance and/or water use efficiency of a plant.

According to some embodiments of the invention the isolated polynucleotide comprising the nucleic acid sequence selected from the group consisting of SEQ ID NOs: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 and 2457.

According to some embodiments of the invention the isolated polynucleotide is set forth by SEQ ID NO: 2506, 2512, 2442, 2496, 2446, 1, 2, 4, 7, 8, 11, 12, 13, 16-19, 21-60, 63-128, 130-137, 270-287, 289-293, 295-306, 308-362, 364-666, 671, 673-1333, 2414-2441, 2443-2445, 2447-2455, 2458-2495, 2497-2505, 2507-2511, 2513-2522, 3, 5, 6, 9, 10, 14, 15, 20, 61, 62, 129, 288, 294, 307, 363, 667, 668, 669, 670, 672, 2398-2413, 2456 or 2457.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563.

According to some embodiments of the invention the amino acid sequence is capable of increasing nitrogen use efficiency, fertilizer use efficiency, yield, growth rate, vigor, biomass, oil content, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563.

According to some embodiments of the invention, the polypeptide comprising an amino acid sequence selected from the group consisting of SEQ ID NOs: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 and 2543.

According to some embodiments of the invention, the polypeptide is set forth by SEQ ID NO: 2557, 2560, 184, 238, 188, 154-156, 158-161, 163-183, 185-187, 189-197, 200-237, 239-264, 266-269, 1351, 1365-1425, 1429-1457, 1459, 1461-1730, 1735, 1739-2397, 2533-2541, 2544-2556, 2558, 2559, 2561-2563, 138-143, 146, 148, 150-152, 157, 162, 198, 265, 1334-1350, 1352-1364, 1426-1428, 1458, 1460, 1732-1734, 1737-1738, 2523-2532, 2542 or 2543.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the super-family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Raphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

According to some embodiments of the invention, there is provided a nucleic acid construct comprising the isolated polynucleotide of the invention, and a promoter for directing transcription of the nucleic acid sequence of the isolated polynucleotide in a host cell.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

Suitable constitutive promoters include, for example, CaMV 35S promoter (SEQ ID NO:3063; Odell et al., Nature 313:810-812, 1985); *Arabidopsis* At6669 promoter (SEQ ID NO:3064; see PCT Publication No. WO04081173A2); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase oil content, yield, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

In addition, the endogenous homolog of the exogenous polynucleotide or polypeptide of the invention, or a fragment of the endogenous homolog (e.g. introns or untranslated regions) in the plant can be used as a marker for marker assisted selection (MAS), in which a marker is used for indirect selection of a genetic determinant or determinants of a trait of interest (e.g., biomass, growth rate, oil content, yield, abiotic stress tolerance). These genes (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Following is a non-limiting description of assays which can be used to determine the effect of the transgene (the exogenous polynucleotide of some embodiments of the invention) or is encoded polypeptide on the trait-of-interest in a plant.

The main parameters of efficiency used to define plant Nitrogen (N) metabolism include nitrogen-uptake efficiency, nitrogen utilization efficiency, and nitrogen-use efficiency The Nitrogen-uptake efficiency [the amount of N in above ground biomass (grams of nitrogen)/N applied (grams/hectare)] is the total amount of nitrogen incorporated by the plant and is a function of the "uptake" (the plant's transport capacity), the metabolic efficiency of the assimilation process and the rate of plant size development, since the mass of stalk and leaves created during growth are the actual Nitrogen-storage organs. The fraction of the assimilated Nitrogen found in a shoot that is ultimately transferred to the grain (yield) is controlled enzymatically, and thus can be affected by transgenic manipulation. This parameter is, in effect, equal to the Nitrogen Use efficiency (NUE). Better grain-to-shoot N-partitioning most likely will improve yield and protein content of the grain.

Similarly, the same calculations of use and utilization efficiencies can be made for other macronutrients such as Phosphorous (P) and Potassium (K), which have a direct correlation with yield and general plant tolerance.

Fertilizer Use Efficiency—

To analyze whether the transgenic plants are more responsive to fertilizers, plants are grown in agar plates or pots with a limited amount of fertilizer, as described, for example, in Examples 5-7 of the Example section which follows and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—

To analyze whether the transgenic *Arabidopsis* plants are more responsive to nitrogen, plant are grown in 0.75-1.5 mM (nitrogen deficient conditions) or 6-15 mM (optimal nitrogen concentration). Plants are allowed to grow for additional 20-40 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Determination—

The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—

The plant vigor can be calculated by the increase in growth parameters such as leaf area, fiber length, rosette diameter, plant fresh weight and the like per time.

Growth Rate—

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula I.

$$\text{Relative growth area rate} = (\Delta \text{Area}/\Delta t)*(1/\text{Area } t_0) \quad \text{Formula I}$$

$\Delta t$ is the current analyzed image day subtracted from the initial day (t–t0). Thus, the relative growth area rate is in units of 1/day and length growth rate is in units of 1/day.

Alternatively, the relative growth rate of the area can be calculated as the regression coefficient along time course.

Seed Yield—

Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula II:

$$\text{1000 Seed Weight} = \text{number of seed in sample/sample weight} \times 1000 \quad \text{Formula II}$$

The Harvest Index can be calculated using Formula III $$\text{Harvest Index} = \text{Average seed yield per plant/Average dry weight} \quad \text{Formula III}$$

Grain Protein Concentration—

Grain protein content (grams grain protein $m^{-2}$) is estimated as the product of the mass of grain N (nitrogen) [grams grain Nitrogen $m^{-2}$] multiplied by the N/protein conversion ratio of k–5.13 (Mosse 1990, supra). The grain protein concentration is estimated as the ratio of grain protein content per unit mass of the grain (grams grain protein $kg^{-1}$ grain).

Fiber Length—

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://WorldWide Web (dot) cottoninc (dot) com/ClassificationofCotton/?Pg=4#Length).

Oil Content—

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

The effect of the transgene or its encoded polypeptide on abiotic stress tolerance can be determined using known methods.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants. Quantitative parameters of tolerance measured include, but are not limited to, the average wet and dry weight, the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol, 500 mM sorbitol or 15 g (grams) PEG [Polyethylene Glycol 8000].

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—

Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency— can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula IV:

$$RWC=[(FW-DW)/(TW-DW)]\times 100 \qquad \text{Formula IV}$$

Thus, the invention is of high agricultural value for promoting the yield of commercially desired crops (e.g., biomass of vegetative organ such as poplar wood, or reproductive organ such as number of seeds or seed biomass) under normal or growth-limiting conditions (e.g., nitrogen-deficient conditions, abiotic stress).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil and/or a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identifying Genes which Increase Nitrogen Use Efficiency, Fertilizer Use Efficiency, Yield, Oil Content, Biomass and/or Abiotic Stress Tolerance Genes which can increase nitrogen use efficiency (NUE), fertilizer use efficiency (FUE), yield, oil content, biomass and/or abiotic stress tolerance (ABST) were identified using several data mining and bioinformatics tools.

All nucleotide sequence datasets used here were originated from publicly available databases. Sequence data from 76 different plant species was introduced into a single, comprehensive database. Other information on gene expression, protein annotation, enzymes and pathways were also incorporated. Major databases used include:

Genomes
  Arabidopsis genome [TAIR genome version 6 (Hypertext Transfer Protocol://World Wide Web (dot) arabidopsis (dot) org/)]
  Rice genome [IRGSP build 4.0 (Hypertext Transfer Protocol://rgp (dot) dna (dot) affrc (dot) go (dot) jp/IRGSP/)].
  Poplar [Populus trichocarpa release 1.1 from JGI (assembly release v1.0) (Hypertext Transfer Protocol://World Wide Web (dot) genome (dot) jgi-psf (dot) org/)]
  Brachypodium [JGI 4× assembly, Hypertext Transfer Protocol://World Wide Web (dot) brachpodium (dot) org)]
  Soybean [DOE-JGI SCP, version Glyma0 (Hypertext Transfer Protocol://World Wide Web (dot) phytozome (dot) net/)]
  Grape [French-Italian Public Consortium for Grapevine Genome Characterization grapevine genome (Hypertext Transfer Protocol://World Wide Web (dot) genoscope (dot) cns (dot) fr/)]
  Castobean [TIGR/J Craig Venter Institute 4× assembly [(Hypertext Transfer Protocol://msc (dot) jcvi (dot) org/ r_communis]
  Sorghum [DOE-JGI SCP, version Sbi1 [Hypertext Transfer Protocol://World Wide Web (dot) phytozome (dot) net/].
  Partially assembled genome of Maize [Hypertext Transfer Protocol://maizesequence (dot) org/]

Expressed EST and mRNA Sequences were Extracted from the Following Databases:
  GenBank (Hypertext Transfer Protocol://World Wide Web (dot) ncbi (dot) nlm (dot) nih (dot) gov/Genbank/).
  RefSeq (Hypertext Transfer Protocol://World Wide Web (dot) ncbi (dot) nlm (dot) nih (dot) gov/RefSeq/).
  TAIR (Hypertext Transfer Protocol://World Wide Web (dot) arabidopsis (dot) org/).

Protein and Pathway Databases
  Uniprot (Hypertext Transfer Protocol://World Wide Web (dot) expasy (dot) uniprot (dot) org/).
  AraCyc (Hypertext Transfer Protocol://World Wide Web (dot) arabidopsis (dot) org/biocyc/index (dot) jsp).
  ENZYME (Hypertext Transfer Protocol://expasy (dot) org/enzyme/).

Microarray Datasets were Downloaded from:
  GEO (Hypertext Transfer Protocol://World Wide Web (dot) ncbi (dot) nlm (dot) nih (dot) gov/geo/)
  TAIR (Hypertext Transfer Protocol://World Wide Web (dot) arabidopsis (dot) org/).
  Proprietary cotton fiber micro array data (PCT Publication No. WO2008/075364)
  Proprietary microarray data on Arabidopsis ecotypes (PCT Publication No. WO2008/122980).

QTL (Quantitative Trailt Locus) Information
  Gramene (Hypertext Transfer Protocol://World Wide Web (dot) gramene (dot) org/qtl/).

Database assembly was performed to enable to build a wide, rich, reliable annotated and easy to analyze database comprised of publicly available genomic mRNA, and ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly—

For clustering and assembly Arabidopsis, rice, grape, sorghum, brachypodium and soybean genes the present inventors used "genomic LEADS" version. This tool allows most accurate clustering of ESTs and mRNA sequences on genome, and predicts gene structure as well as alternative splicing events and anti-sense transcription.

Gene Annotation—

Predicted Genes and Proteins were Annotated as Follows:
Sequences blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene Expression Profiling—

Few data sources were exploited for gene expression profiling, namely microarray data and digital expression profile (as mentioned above). According to gene expression profile, a correlation analysis was performed to identify genes which are co-regulated under different developmental stages and environmental conditions.

Publicly available microarray datasets were downloaded from NCBI GEO sites, renormalized, and integrated into the database. Expression profile was one of the most important resource data for identifying genes important for NUE, ABST, yield, biomass increment and/or FUE. Moreover, when homolog genes from different crops were found to be associated with increase of NUE, ABST, FUE, biomass, yield or oil content, the genes were marked as "highly predictive" to improve the trait.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool can provide the expression profile of a cluster in terms of plant anatomy (e.g. tissues/organs in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations the following parameters were taken into consideration: a) the number of ESTs in the cluster; b) the number of ESTs of the implicated and related libraries; and c) the overall number of ESTs available, representing the species. Thereby clusters with low probability values are highly enriched with ESTs from the group of libraries of interest indicating a specialized expression.

The results of the digital and microarray gene expression data are provided in Tables 1-19, hereinbelow.

Below are summarized the key criteria used to select the genes which expression thereof in a plant can be used to increase NUE, FUE, biomass, yield, oil content and ABST. The overexpression Fold ("Fold") is calculated as the ratio between the number of ESTs found in a gene or an orthologue group for a certain category ("Keyword") and the number of expected ESTs according to a normal distribution. A probabilistic value (P-value) was estimated for the calculated overexpression folds. Genes were selected based on the results presented in Tables 1-19 below and other computational filtering combined with manual curation as detailed below.

NUE242, NUE244, NUE234, NUE239, NUE240, NUE514, NUE523, NUE533, NUE538, NUE548, NUE549, NUE241, NUE235, NUE251, NUE587 and NUE582 were selected since they are highly expressed in roots and under nutrient deficient conditions (as shown in Tables 1 and 2, hereinbelow).

TABLE 1

Digital expression of NUE242, NUE244, NUE234, NUE239, NUE240, NUE514, NUE523, NUE533, NUE538, NUE548, NUE549, NUE241, NUE235, NUE251, NUE587 and NUE582 in different tissues

| | Anatomy | | | | | | | |
|---|---|---|---|---|---|---|---|---|
| | germinating seed | | root | | seedling | | shoot | |
| Genes | fold | p-value | fold | p-value | fold | p-value | fold | p-value |
| NUE242 | | | 10.57 | 2.68E−12 | | | 1.00 | 5.47E−01 |
| NUE244 | 1.00 | 4.48E−02 | 3.00 | 1.06E−03 | 1.40 | 1.67E−01 | 2.00 | 2.03E−01 |
| NUE234 | | | 6.89 | 1.80E−24 | | | | |
| NUE239 | | | 7.26 | 1.87E−21 | | | | |
| NUE240 | | | 12.70 | 4.65E−40 | | | | |
| NUE514 | 1.97 | 2.69E−01 | 2.95 | 7.95E−60 | 0.78 | 1 | 0.39 | 9.99E−01 |
| NUE523 | | | 2.15 | 1.17E−05 | 1.11 | 4.45E−01 | 1.33 | 1.31E−01 |
| NUE533 | | | 2.96 | 5.39E−04 | 0.76 | 8.43E−01 | | |
| NUE538 | | | 3.47 | 1.05E−06 | 0.96 | 6.20E−01 | | |
| NUE548 | | | 1.72 | 1.06E−02 | 0.65 | 8.48E−01 | 0.60 | 9.41E−01 |
| NUE549 | | | 1.51 | 7.86E−06 | 2.52 | 7.38E−13 | 0.19 | 1 |
| NUE241 | | | 3.32 | 7.66E−03 | 1.00 | 4.05E−01 | 0.88 | 6.88E−01 |
| NUE235 | 1.00 | 2.95E−02 | 4.94 | 1.12E−06 | 0.48 | 9.46E−01 | | |
| NUE251 | | | 2.72 | 3.33E−05 | | | | |
| NUE587 | | | 2.39 | 2.20E−02 | 2.56 | 1.10E−01 | | |
| NUE582 | | | 2.00 | 6.00E−08 | 1.19 | 2.80E−01 | 1.89 | 7.60E−06 |

Table 1. Digital expression of the indicated genes in germinating seed, root, seedling and shoots. Provided are the fold increase and the calculated p-values. Results were considered statistically significant if the p-value was lower than 0.05. Blank cells indicate that either the gene is not expressed or data is not available.

TABLE 2

Digital expression of NUE242, NUE244, NUE234, NUE239, NUE240, NUE514, NUE523, NUE533, NUE538, NUE548, NUE549, NUE241, NUE235, NUE251, NUE587 and NUE582 under different growth conditions

| | Treatment | | | | | | | | | |
|---|---|---|---|---|---|---|---|---|---|---|
| | drought | | etiolation | | heat stress | | nutrient deficiencies | | waterlogging | |
| Genes | fold | p-value | fold | p-value | fold | p-value | fold | p-value | fold | p-value |
| NUE242 | | | | | 1.00 | 4.69E−02 | 5.00 | 8.06E−06 | | |
| NUE244 | | | 4.00 | 1.40E−02 | | | 7.00 | 2.93E−06 | 1.00 | 1.50E−01 |
| NUE234 | 3.00 | 2.51E−03 | | | | | 2.93 | 1.71E−02 | | |
| NUE239 | 8.00 | 5.17E−11 | | | | | 17.36 | 2.11E−27 | | |
| NUE240 | 4.00 | 1.44E−05 | | | | | 26.09 | 6.02E−35 | | |
| NUE514 | 0.14 | 1 | 0.49 | 9.96E−01 | 1.16 | 5.14E−01 | 5.75 | 1.26E−38 | 3.54 | 1.95E−04 |
| NUE523 | 1.53 | 1.07E−01 | | | | | 4.35 | 5.73E−04 | 1.94 | 2.76E−01 |
| NUE533 | 1.00 | 6.19E−01 | | | | | 4.00 | 3.57E−03 | | |
| NUE538 | 1.69 | 2.10E−01 | | | | | 7.00 | 2.32E−06 | 5.00 | 2.30E−05 |
| NUE548 | 0.76 | 7.80E−01 | | | | | 9.60 | 1.24E−09 | | |
| NUE549 | 1.91 | 8.07E−07 | | | | | 4.08 | 6.20E−12 | 9.58 | 8.54E−30 |
| NUE241 | | | | | | | 3.00 | 8.97E−03 | | |
| NUE235 | 2.00 | 1.50E−01 | | | | | 6.00 | 2.61E−06 | | |
| NUE251 | 1.89 | 9.79E−02 | | | | | 3.00 | 4.85E−02 | 8.00 | 2.04E−08 |
| NUE587 | 4.50 | 1.73E−03 | | | | | 3.00 | 4.71E−03 | | |
| NUE582 | 0.63 | 9.51E−01 | | | | | 3.20 | 4.00E−02 | 0.97 | 6.10E−01 |

Table 2. Digital expression of the indicated genes under drought, etiolation, heat stress, nutrient deficiencies and waterlogging. Provided are the fold increase and the calculated p-values. Results were considered statistically significant if the p-value was lower than 0.05. Blank cells indicate that either the gene is not expressed or data is not available.

NUE229, NUE248, NUE254, NUE542, NUE562, NUE237, NUE221, NUE585 and NUE588 were selected because of their high expression in roots and under drought stress conditions (as shown in Tables 3 and 4, below).

TABLE 3

Digital expression of NUE229, NUE248, NUE254, NUE542, NUE562, NUE237, NUE221, NUE585 and NUE588 in different tissues

| | Anatomy | | | | | | | | | |
|---|---|---|---|---|---|---|---|---|---|---|
| | leaf | | seed | | root | | seedling | | shoot | |
| Genes | fold | p-value | fold | p-value | fold | p-value | fold | p-value | fold | p-value |
| NUE229 | | | | | 4.64 | 2.79E−04 | | | | |
| NUE248 | 1.19 | 5.06E−01 | | | 3.56 | 6.36E−03 | | | | |
| NUE254 | 2.26 | 1.35E−02 | | | 7.90 | 5.32E−22 | 0.33 | 9.53E−01 | 1.55 | 1.46E−01 |
| NUE542 | | | | | 4.22 | 9.75E−04 | | | | |
| NUE562 | 2.75 | 2.40E−02 | | | 3.32 | 3.79E−08 | 0.71 | 9.32E−01 | 0.62 | 9.66E−01 |
| NUE237 | 0.50 | 9.00E−01 | | | 5.35 | 5.22E−11 | 1.21 | 2.97E−01 | 0.50 | 9.67E−01 |
| NUE221 | | | | | 4.15 | 2.33E−04 | 0.63 | 8.74E−01 | 1.41 | 2.48E−01 |
| NUE585 | 2.00 | 1.20E−01 | | | 6.00 | 1.34E−04 | | | | |
| NUE588 | 0.99 | 6.00E−01 | | | 2.56 | 7.16E−05 | 0.65 | 9.64E−01 | 1.30 | 1.29E−01 |

Table 3. Digital expression of the indicated genes in leaf, seed, root, seedling and shoots. Provided are the fold increase and the calculated p-values. Results were considered statistically significant if the p-value was lower than 0.05. Blank cells indicate that either the gene is not expressed or data is not available.

TABLE 4

Digital expression of NUE229, NUE248, NUE254, NUE542, NUE562, NUE237, NUE221 and NUE588 under different growth conditions

| | Treatment | | | | | | | |
|---|---|---|---|---|---|---|---|---|
| | cold | | drought | | etiolation | | salinity | |
| Genes | fold | p-value | fold | p-value | fold | p-value | fold | p-value |
| NUE229 | | | 4.00 | 6.53E−03 | | | | |
| NUE248 | | | 4.00 | 6.02E−03 | | | | |
| NUE254 | | | 3.13 | 1.29E−02 | | | 1.00 | 3.67E−01 |
| NUE542 | | | 3.00 | 3.50E−02 | | | 6.00 | 1.61E−10 |
| NUE562 | 0.70 | 0.760127 | 2.75 | 3.66E−02 | 0.98 | 0.57666 | 4.35 | 2.80E−03 |
| NUE237 | | | 6.00 | 3.30E−04 | | | | |
| NUE221 | | | 4.00 | 1.38E−03 | 1.60 | 0.28739 | | |

TABLE 4-continued

Digital expression of NUE229, NUE248, NUE254, NUE542, NUE562, NUE237, NUE221 and NUE588 under different growth conditions

| Genes | cold | | drought | | etiolation | | salinity | |
|---|---|---|---|---|---|---|---|---|
| | fold | p-value | fold | p-value | fold | p-value | fold | p-value |
| NUE585 | | | 2.00 | 5.13E−02 | | | | |
| NUE588 | 2.10 | 0.173185 | 2.73 | 3.76E−02 | 1.39 | 0.185271 | 0.72 | 7.53E−01 |

Table 4. Digital expression of the indicated genes under cold, drought, etiolation and salinity. Provided are the fold increase and the calculated p-values. Results were considered statistically significant if the p-value was lower than 0.05. Blank cells indicate that either the gene is not expressed or data is not available.

NUE252 and MAB106, NUE265, NUE553, NUE513, NUE579, NUE580, NUE256, NUE227 and NUE223 were selected because of their high expression under etiolation growth conditions (as shown in Table 5).

TABLE 5

Digital expression of NUE252, MAB106, NUE265, NUE553, NUE513, NUE579, NUE580, NUE256, NUE227 and NUE223 under different growth conditions

| Genes | drought | | etiolation | | heat | | heavy metal | |
|---|---|---|---|---|---|---|---|---|
| | fold | p-value | fold | p-value | fold | p-value | fold | p-value |
| NUE252 | 1.28 | 4.2E−01 | 5.67 | 2.0E−11 | | | | |
| MAB106 | 0.49 | 8.7E−01 | 10.17 | 5.2E−71 | | | | |
| NUE265 | | | 1.90 | 4.9E−02 | 4.00 | 2.6E−03 | 2.26 | 7.2E−02 |
| NUE553 | | | 1.92 | 4.4E−02 | | | | |
| NUE513 | 1.05 | 5.7E−01 | 3.75 | 1.5E−04 | | | | |
| NUE579 | 0.27 | 9.8E−01 | 3.18 | 1.9E−05 | | | | |
| NUE580 | 1.00 | 5.6E−01 | 3.16 | 3.8E−02 | | | | |
| NUE256 | 1.84 | 5.9E−02 | 2.03 | 9.9E−03 | 3.43 | 4.7E−03 | | |
| NUE227 | | | 4.74 | 3.4E−03 | | | | |
| NUE223 | 1.40 | 4.19E−01 | 4.17 | 5.6E−09 | | | | |

Table 5. Digital expression of the indicated genes under drought, etiolation, heat and heavy metal. Provided are the fold increase and the calculated p-values. Results were considered statistically significant if the p-value was lower than 0.05. Note the high expression of NUE252 and MAB106 under etiolation.
Blank cells indicate that either the gene is not expressed or data is not available.

TABLE 6

Digital expression of NUE252, MAB106, NUE265, NUE553, NUE513, NUE579, NUE580, NUE256, NUE227 and NUE223 under different growth conditions

| Genes | salinity | | oxidative stress | | waterlogging | |
|---|---|---|---|---|---|---|
| | fold | p-value | fold | p-value | fold | p-value |
| NUE252 | | | | | | |
| MAB106 | | | | | | |
| NUE265 | 3.00 | 6.3E−02 | | | | |
| NUE553 | | | | | | |
| NUE513 | | | | | | |
| NUE579 | | | | | | |
| NUE580 | | | | | | |
| NUE256 | 2.96 | 8.2E−02 | | | | |
| NUE227 | | | | | | |
| NUE223 | 2.85 | 8.91E−02 | | | 2.00 | 2.31E−02 |

Table 6. Digital expression of the indicated genes under salinity, oxidative stress and waterlogging. Provided are the fold increase and the calculated p-values. Results were considered statistically significant if the p-value was lower than 0.05.
Blank cells indicate that either the gene is not expressed or data is not available.

NUE224, NUE230, NUE255, NUE245, NUE237, NUE233, NUE231, NUE228, NUE225 and NUE249 were selected because of their high expression in roots and expressed when treated with plant hormones intrinsically related to plant growth and development (as shown in Tables 7, 8 and 9).

TABLE 7

Digital expression of NUE224, NUE230, NUE255, NUE245, NUE237, NUE233, NUE231, NUE228, NUE225 and NUE249 in different tissues

| | Anatomy | | | | | | | | | |
|---|---|---|---|---|---|---|---|---|---|---|
| | leaf | | callus | | root | | seedling | | shoot | |
| Genes | fold | p-value | fold | p-value | fold | p-value | fold | p-value | fold | p-value |
| NUE224 | 1.20 | 4.0E−01 | 0.49 | 9.9E−01 | 7.26 | 4.1E−30 | 1.64 | 8.4E−03 | 1.04 | 5.0E−01 |
| NUE230 | 0.71 | 8.3E−01 | 1.35 | 1.4E−02 | 2.76 | 7.1E−09 | 0.59 | 1.0E+00 | 1.16 | 2.1E−01 |
| NUE255 | | | | | 4.00 | 3.3E−03 | | | | |
| NUE245 | 1.48 | 2.5E−01 | 0.32 | 1.0E+00 | 2.14 | 4.4E−03 | 1.03 | 4.8E−01 | 1.53 | 3.2E−02 |
| NUE237 | 0.47 | 8.8E−01 | 1.39 | 1.0E−01 | 5.12 | 1.3E−10 | 1.14 | 3.7E−01 | 0.47 | 9.8E−01 |
| NUE233 | | | 1.73 | 4.4E−02 | 4.19 | 9.9E−05 | 0.95 | 6.2E−01 | 1.28 | 3.3E−01 |
| NUE231 | | | 0.75 | 7.8E−01 | 8.66 | 4.6E−10 | 0.30 | 9.7E−01 | | |
| NUE228 | 0.17 | 1.0E+00 | 2.29 | 2.4E−12 | 4.75 | 3.2E−23 | | | 0.13 | 1.0E+00 |
| NUE225 | | | | | 11.25 | 0 | 2.41 | 1.0E−14 | 0.10 | 1.0E+00 |
| NUE249 | | | | | 5.78 | 4.17E−05 | | | | |

Table 7. Digital expression of the indicated genes in leaf, callus, root, seedling and shoot. Provided are the fold increase and the calculated p-values. Results were considered statistically significant if the p-value was lower than 0.05.
Blank cells indicate that either the gene is not expressed or data is not available.

TABLE 8

Digital expression of NUE224, NUE230, NUE255, NUE245, NUE237, NUE233, NUE231, NUE228, NUE225 and NUE249 under different growth conditions and treatments

| | Treatment | | | | | |
|---|---|---|---|---|---|---|
| | plant development hormones | | drought | | etiolation | |
| Genes | fold | p-value | fold | p-value | fold | p-value |
| NUE224 | 4.75 | 1.7E−06 | | | 1.51 | 1.4E−01 |
| NUE230 | 2.74 | 2.1E−04 | 0.31 | 9.6E−01 | | |
| NUE255 | 4.00 | 1.4E−04 | | | | |
| NUE245 | 2.67 | 1.1E−02 | 1.28 | 4.6E−01 | | |
| NUE237 | 4.26 | 5.9E−04 | 6.00 | 4.2E−04 | | |
| NUE233 | 11.74 | 2.5E−10 | | | | |
| NUE231 | 10.00 | 3.4E−10 | | | | |
| NUE228 | 4.48 | 3.0E−09 | | | | |
| NUE225 | 3.45 | 3.6E−07 | | | | |
| NUE249 | 2.00 | 3.0E−02 | | | | |

Table 8. Digital expression of the indicated genes under plant development hormones, drought and etiolation. Provided are the fold increase and the calculated p-values. Results were considered statistically significant if the p-value was lower than 0.05.
Blank cells indicate that either the gene is not expressed or data is not available.

TABLE 9

Digital expression of NUE224, NUE230, NUE255, NUE245, NUE237, NUE233, NUE231, NUE228, NUE225 and NUE249 under different growth treatments

| | Treatment | | | | | |
|---|---|---|---|---|---|---|
| | waterlogging | | photoperiod response | | salinity | |
| Genes | fold | p-value | fold | p-value | fold | p-value |
| NUE224 | | | | | | |
| NUE230 | | | | | 1.26 | 4.3E−01 |
| NUE255 | | | | | | |
| NUE245 | 2.00 | 2.7E−02 | | | 0.87 | 6.9E−01 |

TABLE 9-continued

Digital expression of NUE224, NUE230, NUE255, NUE245, NUE237, NUE233, NUE231, NUE228, NUE225 and NUE249 under different growth treatments

| | Treatment | | | | | |
|---|---|---|---|---|---|---|
| | waterlogging | | photoperiod response | | salinity | |
| Genes | fold | p-value | fold | p-value | fold | p-value |
| NUE237 | | | | | | |
| NUE233 | | | | | | |
| NUE231 | | | | | | |
| NUE228 | | | | | | |
| NUE225 | 21.00 | 3.4E−26 | | | 28.53 | 5.6E−82 |
| NUE249 | | | 2.00 | 4.0E−03 | | |

Table 9. Digital expression of the indicated genes under waterlogging, photoperiod response and salinity. Provided are the fold increase and the calculated p-values. Results were considered statistically significant if the p-value was lower than 0.05.
Blank cells indicate that either the gene is not expressed or data is not available.

NUE268, NUE574 and NUE575 were selected because of their high expression in callus (a tissue with high cell division rate) and induced when treated with plant growth and development related hormones (as shown in Table 10, below).

TABLE 10

Digital expression of NUE268, NUE574 and NUE575 in various tissues and under different conditions and treatments

| | | | NUE268 | NUE574 | NUE575 |
|---|---|---|---|---|---|
| Anatomy | leaf | fold | 0.84 | 1.24 | |
| | | p-value | 0.8 | 4.8E−01 | |
| | callus | fold | 2.37 | 2.28 | 2.47 |
| | | p-value | 6.0E−19 | 2.0E−04 | 2.5E−07 |
| | root | fold | 0.41 | 0.31 | 1.20 |
| | | p-value | 1 | 9.7E−01 | 3.8E−01 |
| | seedling | fold | 0.34 | 1.23 | 0.45 |
| | | p-value | 1 | 3.1E−01 | 9.9E−01 |
| | shoot | fold | 0.59 | 0.16 | 0.91 |
| | | p-value | 9.9E−01 | 1.0E+00 | 6.6E−01 |

TABLE 10-continued

Digital expression of NUE268, NUE574 and NUE575 in various tissues and under different conditions and treatments

|  |  |  | NUE268 | NUE574 | NUE575 |
|---|---|---|---|---|---|
| Treatment | plant | fold | 4.46 | 2.80 | 1.84 |
|  | development | p-value | 1.4E−12 | 5.5E−02 | 1.7E−01 |
|  | hormones |  |  |  |  |
|  | drought | fold |  | 2.00 |  |
|  |  | p-value |  | 1.7E−01 |  |
|  | etiolation | fold | 0.20 | 0.35 | 0.23 |
|  |  | p-value | 1.0E+00 | 9.5E−01 | 9.9E−01 |
|  | waterlogging | fold |  |  |  |
|  |  | p-value |  |  |  |
|  | photoperiod | fold | 3.32 |  |  |
|  | response | p-value | 3.4E−02 |  |  |
|  | salinity | fold |  | 1.00 |  |
|  |  | p-value |  | 4.3E−01 |  |

Table 10. Digital expression of the indicated genes in various tissues (leaf, callus, root, seedling and shoot) and under various treatment or conditions (plant development hormones, drought, etiolation, waterlogging, photoperiod response and salinity. Provided are the fold increase and the calculated p-values. Results were considered statistically significant if the p-value was lower than 0.05. Note the significant fold expression in callus and under plant development hormones.

CT75, CT7, CT76, CT71, CT74, CT11, CT20, CT81, CT22, CT82, CT3, CT40, CT1, CT6, CT27, CT2, NUE269, NUE545 and NUE544, were selected based on their high expression in cotton fiber, which formation is strongly related to cell elongation (Tables 11 and 12 below) and therefore are expected to have a positive effect on root development under normal conditions, nitrogen deficient conditions, fertilizer shortage and/or water deficiencies conditions as well as for increasing oil content.

TABLE 11

Digital expression of CT75, CT7, CT76, CT71, CT74, CT11, CT20, CT81, CT22, CT82, CT3, CT40, CT1, CT6, CT27, CT2, NUE269, NUE545 and NUE544 in different tissues

| | Anatomy | | | | | | | |
|---|---|---|---|---|---|---|---|---|
| | cotton fiber | | fruit | | seed | | root | |
| Gene Name | fold | p-value | fold | p-value | fold | p-value | fold | p-value |
| CT75 | 1.63 | 9.3E−13 | | | | | | |
| CT7 | 1.65 | 6.3E−16 | | | | | | |
| CT76 | 1.21 | 1.9E−01 | | | | | | |
| CT71 | 1.6 | 1.3E−28 | | | | | | |
| CT74 | 1.68 | 2.4E−89 | | | | | | |
| CT11 | 1.49 | 4.4E−04 | | | | | | |
| CT20 | 1.68 | 1.1E−14 | | | | | 0.6 | 8.1E−01 |
| CT81 | 1.37 | 9.8E−04 | | | | | | |
| CT22 | 0.92 | 7.4E−01 | | | | | | |
| CT82 | 1.31 | 3.6E−01 | | | | | | |
| CT3 | 1.87 | 1.4E−14 | | | | | | |
| CT40 | 1.27 | 1.9E−03 | | | | | 0.59 | 8.2E−01 |
| CT1 | 1.53 | 2.4E−09 | | | | | | |
| CT6 | 1.46 | 6.3E−09 | | | | | | |
| CT27 | 0.65 | 9.0E−01 | | | | | | |
| CT2 | 1.43 | 1.7E−03 | | | | | | |
| NUE269 | 1.50 | 2.5E−02 | | | | | | |
| NUE545 | 1.39 | 4.6E−03 | | | | | 1 | 4.5E−01 |
| NUE544 | 1.73 | 1.5E−03 | | | | | | |

Table 11. Digital expression of the indicated genes in cotton fibers, fruit, seed and root. Provided are the fold increase and the calculated p-values. Results were considered statistically significant if the p-value was lower than 0.05. Note the significant fold expression in cotton fiber.
Blank cells indicate that either the gene is not expressed or data is not available.

TABLE 12

Digital expression of CT75, CT7, CT76, CT71, CT74, CT11, CT20, CT81, CT22, CT82, CT3, CT40, CT1, CT6, CT27, CT2, NUE269, NUE545 and NUE544

| | Anatomy | | | | | |
|---|---|---|---|---|---|---|
| | seedling | | stem | | leaf | |
| Gene Name | fold | p-value | fold | p-value | fold | p-value |
| CT75 | | | | | | |
| CT7 | 0.08 | 1 | | | 0.44 | 9.0E−01 |
| CT76 | | | | | | |
| CT71 | 0.17 | 1 | | | | |
| CT74 | 0.17 | 1 | | | | |
| CT11 | | | | | | |
| CT20 | 0.55 | 0.97 | | | | |
| CT81 | 1.6 | 0.08 | | | | |
| CT22 | | | | | | |
| CT82 | | | | | | |
| CT3 | | | | | | |
| CT40 | | | | | 0.52 | 0.86 |
| CT1 | 0.54 | 0.97 | | | | |
| CT6 | | | 0.17 | 0.99 | | |
| CT27 | | | | | | |
| CT2 | 0.21 | 0.99 | | | | |
| NUE269 | | | | | | |
| NUE545 | | | 0.63 | 8.0E−01 | | |
| NUE544 | 0.6 | 8.3E−01 | | | | |

Table 12. Digital expression of the indicated genes in seedling, stem and leaf. Provided are the fold increase and the calculated p-values. Results were considered statistically significant if the p-value was lower than 0.05.
Blank cells indicate that either the gene is not expressed or data is not available.

Plants growing under low nitrogen conditions or harsh drought conditions suffer from severe leaf senescence. NUE525, NUE535, NUE565, NUE578, NUE515 and NUE591 were selected as genes highly induced in leaves and under nutrient deficiencies of drought stress conditions (as shown in Tables 13 and 14, below). In addition, NUE578 shows strong induction in plants affected by heat stress.

NUE520, NUE521, NUE560, NUE563 and NUE573 were selected as genes that can improve seedling vigor under nitrogen stress conditions. NUE520, NUE521, NUE560 were selected as genes that are highly expressed in whole seedlings and are highly induced under drought stress. NUE563 was selected as a gene that is highly induced in seedling leaves and is induced under salinity stress. NUE573 is induced in seedling roots and under salinity stress (see Tables 15 and 16).

TABLE 13

Digital expression of NUE525, NUE535, NUE565, NUE578, NUE515 and NUE591 in different tissues

| | Anatomy | | | | | | | |
|---|---|---|---|---|---|---|---|---|
| | Leaf | | Root | | Flower | | Callus | |
| Genes | fold | p-value | fold | p-value | fold | p-value | fold | p-value |
| NUE525 | 2.54 | 4.4E−06 | 0.93 | 6.6E−01 | 0.28 | 1.0E+00 | | |
| NUE535 | 8.10 | 1.4E−11 | | | | | | |
| NUE565 | 4.78 | 3.3E−03 | | | | | | |
| NUE578 | 2.41 | 9.1E−04 | | | 0.20 | 1.0E+00 | | |
| NUE515 | 3.67 | 2.2E−02 | 1.36 | 4.4E−01 | 1.00 | 3.7E−01 | | |
| NUE591 | 3.41 | 1.3E−02 | 1.40 | 3.6E−01 | 1.59 | 2.9E−01 | | |

Table 13. Digital expression of the indicated genes in leaf, root, flower and callus. Provided are the fold increase and the calculated p-values. Results were considered statistically significant if the p-value was lower than 0.05. Note the fold expression in leaf.
Blank cells indicate that either the gene is not expressed or data is not available.

TABLE 14

Digital expression of NUE525, NUE535, NUE565, NUE578, NUE515 and NUE591 under different conditions

| | Treatment | | | | | | | |
|---|---|---|---|---|---|---|---|---|
| | Nutrient deficiency | | Drought | | Salinity | | Heat | |
| Genes | fold | p-value | fold | p-value | fold | p-value | fold | p-value |
| NUE525 | 3.19 | 1.2E−02 | 0.54 | 9.4E−01 | 1.29 | 4.6E−01 | | |
| NUE535 | | | 4.06 | 6.7E−03 | | | | |
| NUE565 | | | 3.00 | 2.3E−02 | | | | |
| NUE578 | | | 4.25 | 2.7E−05 | 1.00 | 4.0E−01 | 8.05 | 3.8E−08 |
| NUE515 | | | 3.00 | 2.6E−02 | | | | |
| NUE591 | | | 7.00 | 2.7E−05 | | | | |

Table 14. Digital expression of the indicated genes under nutrient deficiency, drought, salinity and heat. Provided are the fold increase and the calculated p-values. Results were considered statistically significant if the p-value was lower than 0.05. Note the fold expression under nutrient deficiency and drought.
Blank cells indicate that either the gene is not expressed or data is not available.

TABLE 15

Digital expression of NUE520, NUE521, NUE560, NUE563 and NUE573 in different tissues

| | Anatomy | | | | | | | |
|---|---|---|---|---|---|---|---|---|
| | Leaf | | Root | | Flower | | Seedling | |
| Genes | fold | p-value | fold | p-value | fold | p-value | fold | p-value |
| NUE520 | 1.80 | 8.0E−02 | 0.88 | 6.9E−01 | 1.34 | 1.4E−02 | 1.87 | 9.1E−05 |
| NUE521 | | | 1.43 | 2.7E−01 | 1.06 | 4.4E−01 | 1.78 | 2.1E−02 |
| NUE560 | 2.68 | 6.2E−02 | 0.66 | 8.2E−01 | 0.57 | 9.8E−01 | 3.67 | 1.2E−09 |
| NUE563 | 5.07 | 6.7E−05 | 0.28 | 9.8E−01 | 0.14 | 1.0E+00 | 5.30 | 4.7E−24 |
| NUE573 | 0.17 | 1.0E+00 | 8.59 | 3.2E−47 | | | 2.00 | 3.0E−03 |

Table 15. Digital expression of the indicated genes in leaf, root, flower and seedling. Provided are the fold increase and the calculated p-values. Results were considered statistically significant if the p-value was lower than 0.05. Note the fold expression in leaf (NUE563), root (NUE573) and seedling (NUE520, NUE521, NUE560, NUE563 and NUE573).
Blank cells indicate that either the gene is not expressed or data is not available.

TABLE 16

Digital expression of NUE520, NUE521, NUE560, NUE563 and NUE573 under different conditions

| Genes | Treatment | | | | | | | |
|---|---|---|---|---|---|---|---|---|
| | Nutrient deficiencies | | Drought | | Heat | | Salinity | |
| | fold | p-value | fold | p-value | fold | p-value | fold | p-value |
| NUE520 | | | 3.96 | 1.1E−03 | 8.00 | 5.5E−06 | 2.60 | 6.9E−02 |
| NUE521 | | | 6.00 | 1.3E−04 | | | 1.00 | 4.5E−01 |
| NUE560 | | | 5.00 | 5.9E−04 | | | | |
| NUE563 | | | | | | | 3.00 | 2.4E−02 |
| NUE573 | | | 1.73 | 1.3E−01 | | | 2.00 | 5.4E−02 |

Table 16. Digital expression of the indicated genes under nutrient deficiency, drought, heat and salinity. Provided are the fold increase and the calculated p-values. Results were considered statistically significant if the p-value was lower than 0.05. Note the fold expression under drought (NUE520, NUE521, NUE560) and salinity (NUE563 and NUE573).
Blank cells indicate that either the gene is not expressed or data is not available.

Seedlings and cell culture are fast growing tissues. Furthermore, emerging root seedlings elongate very fast to reach available water and nitrogen at deeper soils. NUE520, NUE211, NUE564 and NUE567 were selected for their high expression in root seedlings and/or whole seedlings, while NUE519 was selected for its high expression in root seedlings and cell cultures (see Table 17).

TABLE 17

Digital expression of NUE520, NUE211, NUE564, NUE567, and NUE519 in different tissues

| | | | NUE211 | NUE564 | NUE567 | NUE519 |
|---|---|---|---|---|---|---|
| Anatomy | Leaf | fold | 1.76 | 3.39 | | |
| | | p-value | 2.0E−01 | 2.5E−03 | | |
| | Cell suspension | fold | 0.24 | | | 8.00 |
| | | p-value | 9.9E−01 | | | 8.4E−12 |
| | Root | fold | 1.91 | 3.50 | 6.11 | 3.21 |
| | | p-value | 4.6E−02 | 1.1E−03 | 6.9E−06 | 5.1E−05 |
| | Seedling | fold | 2.01 | 3.687807 | | |
| | | p-value | 1.2E−03 | 5.9E−03 | | |
| | Shoot | fold | 1.29 | 0.21 | | |
| | | p-value | 2.0E−01 | 1.0E+00 | | |

Table 17. Digital expression of the indicated genes in leaf, cell suspension, root, seedling and shoot. Provided are the fold increase and the calculated p-values. Results were considered statistically significant if the p-value was lower than 0.05. Note the fold expression in root (NUE211, NUE564, NUE567 and NUE519) and seedling (NUE211 and NUE564).
Blank cells indicate that either the gene is not expressed or data is not available.

NUE528, NUE571, NUE531 and NUE590 are induced by cold stress. Cold stress reduces plant photosynthesis and produces similar effect to that observed in plants growing under nitrogen deficiency (see Table 18).

TABLE 18

Digital expression of NUE528, NUE571, NUE531 and NUE590 under different conditions

| Genes | Treatment | | | | | | | | | |
|---|---|---|---|---|---|---|---|---|---|---|
| | Nutrient deficiencies | | Cold | | Heat | | Salinity | | Drought | |
| | fold | p-value | fold | p-value | fold | p-value | fold | p-value | fold | p-value |
| NUE528 | 2.47 | 0.08 | 3.00 | 5.2E−04 | | | | | | |
| NUE571 | | | 7.24 | 5.8E−09 | | | | | | |

TABLE 18-continued

Digital expression of NUE528, NUE571, NUE531 and NUE590 under different conditions

| Genes | Nutrient deficiencies fold | p-value | Cold fold | p-value | Heat fold | p-value | Salinity fold | p-value | Drought fold | p-value |
|---|---|---|---|---|---|---|---|---|---|---|
| NUE531 | | | 6.00 | 4.5E−04 | | | | | | |
| NUE590 | | | 1.00 | 3.9E−02 | | | 1 | 2.9E−01 | 1 | 2.9E−01 |

Table 18. Digital expression of the indicated genes under nutrient deficiencies, cold, heat, salinity and drought. Provided are the fold increase and the calculated p-values. Results were considered statistically significant if the p-value was lower than 0.05. Note the fold expression under nutrient deficiencies (NUE528) and cold (NUE528, 571, 531 and 590).
Blank cells indicate that either the gene is not expressed or data is not available.

NUE206 was selected based on its digital expression analysis. It showed that NUE206 is highly expressed in roots (2.4 fold p<0.05) and indications of being induced by cold (2.2 fold p<0.08). NUE208 and NUE210 are tomato genes that are expressed in fruit and during fruit ripening, respectively. These stages are considered important for maintaining high cell turgor. NUE209 is a putative HB2 homeodomain protein highly expressed in flower buds. It was selected as a gene that belongs to an orthologue group of genes that are highly induced by plant developmental hormones such as auxins (5 fold p<0.002), and in tissues that maintain high cell turgor such as the fruit pulp (3 fold p<0.00098) and callus (2 fold p<0.0003). NUE246 was selected because of its high expression in fruit pericarp (3.7 fold p<0.01) and because it is highly induced by drought (4 fold, p<0.0013). NUE516 is a putative Pto kinase interactor selected for its induction under drought conditions (3.2 fold, p<0.03) and prior to flowering stage (2.0 fold p<0.02). NUE527 was chosen because of its expression in different nutrient deficiencies (3.7 fold p<0.002) being mainly expressed under phosphate deficiency (4 fold, p<0.006). NUE547, which is a Putative Ca(2+)-dependent nuclease, was selected as a gene induced in flowers during pre-anthesis stage (2.0 fold p<0.04). NUE551 is an uncharacterized protein that was classified and chosen as a gene that is induced in flowers (2.6 fold p<0.007) and is involved in plant carbon metabolism (GO:0005975 carbohydrate metabolism). NUE554 was characterized as TBP-binding protein-like who is induced in shoots (1.8 fold p<8e-09) during blister and/or milking grain filling stage (3.4 fold p<1e-08). NUE583 is an uncharacterized protein highly expressed in flowers (2.5 fold p<0.006) and significantly induced by cytokinins (4.0 fold p<2e-05). NUE584 is an unknown protein highly induced in shoots and roots (6.0 fold p<8e-07) and overrepresented under nutrient deficiency conditions (6.0 fold p<1e-08) and drought (3.0 fold p<0.03). NUE592 is an unknown protein induced by phosphate deficiency (2.0 fold p<0.05) and by stress related hormones (6.1 fold p<2E-05)

Other NUE and MAB genes were selected based on their induced expression in different Microarrays experiments. The experiments selected from the Gene Expression Omnibus (Hypertext Transfer Protocol://World Wide Web (dot) ncbi (dot) nlm (dot) nih (dot) gov/geo/) were abiotic stresses (drought, salinity) GSE6901, nitrogen deficiency GSE4409, cold GSE3326, rice atlas GSE6893, and auxin GSE3350. From TAIR (Hypertext Transfer Protocol://World Wide Web (dot) arabidopsis (dot) org/servlets/Search?type=expr&search_action=new_search) the experiments on salinity 1007966888, osmoticum 1007966835, cold 1007966553 and ABA application 1007964750 were chosen, and from Nascarrays (Hypertext Transfer Protocol://affymetrix (dot) arabidopsis (dot) info/narrays/experimentbrowse (dot) pl) an experiment on Nitrogen deficiency NASCARRAYS-136 was chosen. Furthermore, a Proprietary cotton fiber microarray data was used to detect the expression of the genes in cotton fiber or root specifically (PCT Publication No: WO 2008/075364)

Based on the analysis of the microarray experiments described above NUE222 was selected because it is highly expressed under nitrogen deficiency, salinity and because it is strongly induced by ABA (see Table 19, hereinbelow). NUE267 and NUE206 were selected as these genes are highly induced by salinity, cold and ABA. NUE212 is a cotton gene specifically expressed in roots. MAB52 was selected because it is induced by drought. MAB53 was selected because it is induced by nitrogen deficiency and it is a functional orthologue of MAB106. NUE566 and NUE568 were selected for their high expression in leaves when compared to their expression in roots). NUE570 was selected because it is highly overrepresented in EST's libraries of leaves (5 fold p<0.001) and is induced by salinity in the microarray experiment. NUE540 is expressed in roots and is related to root hair cell differentiation (GO:0048765). NUE539, NUE543, NUE576 and NUE577 were selected for being highly induced under nitrogen deficiency. NUE577 was also selected for being induced under salinity and cold stress. NUE569 was selected for being induced under salinity and osmoticum conditions. NUE586 was selected for being inducted when treated with the growth hormone auxin. NUE253 was selected as a highly expressed gene under nitrogen deficiency and salinity and NUE593 was selected as a highly expressed gene under salinity conditions

TABLE 19

Microarray expression analysis of NUE222, NUE267, NUE206, NUE212, MAB52, MAB53, NUE539, NUE543, NUE576, NUE566, NUE568, NUE569, NUE570, NUE572, NUE581, NUE540, NUE586, NUE577, NUE253 and NUE593

| Gene Name | Fold Salinity | Fold Drought | Fold Osmoticum | Fold Nitrogen Deficiency | Fold Cold | Fold ABA | Fold Roots | Fold Shoot | Fold Auxin |
|---|---|---|---|---|---|---|---|---|---|
| NUE222 | 5.0 | | | 2.0 | | 3.0 | | | |
| NUE267 | 3.0 | | | | 4.4 | 3.5 | | | |
| NUE206 | 4.0 | | | | 10.0 | 6.0 | | | |
| NUE212 | | | | | | | 12.0 | | |
| MAB52 | | 1.6 | | | | | | | |
| MAB53 | | | | 1.9 | | | | | |
| NUE539 | | | | 4.4 | | | | | |
| NUE543 | | | | 2.1 | | | | | |
| NUE576 | | | | 3.3 | | | | | |
| NUE566 | | | | | | | | 2.3 | |
| NUE568 | | | | | | | | 22.0 | |
| NUE569 | 1.5 | | 1.6 | | | | | | |
| NUE570 | 6.2 | | | | | | | | |
| NUE572 | 1.2 | | | | 2.1 | | | | |
| NUE581 | 20.9 | | | | | 7.0 | | | |
| NUE540 | | | | | | | 2.0 | | |
| NUE586 | | | | | | | | | 3.1 |
| NUE577 | 2.1 | | | 1.9 | 4.4 | | | | |
| NUE253 | 1.8 | | | 1.6 | | | | | |
| NUE593 | 2.0 | | | | | | | | |

Table 19: Microarray expression analysis of the indicated genes under salinity, drought, osmoticum, nitrogen deficiency, cold, ABA (abscisic acid) conditions and in roots, shoot and auxin.
Blank cells indicate that either the gene is not expressed.

NUE49, NUE50 and NUE102 are variants of previously described genes that were originally selected for yield and NUE improvement (PCT Publication No. WO2007/049275)

Overall 137 genes were identified to have a major impact on nitrogen use efficiency, fertilizer use efficiency, yield (e.g., seed yield, oil yield, grain quantity and/or quality), growth rate, vigor, biomass, oil content, abiotic stress tolerance and/or water use efficiency when expression thereof is increased in plants. The identified genes, their curated polynucleotide and polypeptide sequences, as well as their updated sequences according to GenBank database are summarized in Table 20, hereinbelow.

TABLE 20

Genes which affect nitrogen use efficiency, fertilizer use efficiency, yield, growth rate, vigor, biomass, oil content, abiotic stress tolerance and/or water use efficiency

| Gene Name | Cluster Name | Organism | Polyn. SEQ ID NO: | Polyp. SEQ ID NO: |
|---|---|---|---|---|
| CT1 | cotton\|gb164\|AI725990 | cotton | 1 | 138 |
| CT11 | cotton\|gb164\|AI725968 | cotton | 2 | 139 |
| CT2 | cotton\|gb164\|AI727334 | cotton | 3 | 140 |
| CT20 | cotton\|gb164\|AI726497 | cotton | 4 | 141 |
| CT22 | cotton\|gb164\|BG440027 | cotton | 5 | 142 |
| CT27 | cotton\|gb164\|AF336280 | cotton | 6 | 143 |
| CT3 | cotton\|gb164\|AI725456 | cotton | 7 | 144 |
| CT40 | cotton\|gb164\|BE052317 | cotton | 8 | 145 |
| CT6 | cotton\|gb164\|AI726479 | cotton | 9 | 146 |
| CT7 | cotton\|gb164\|AI727027 | cotton | 10 | 147 |
| CT71 | cotton\|gb164\|AI725508 | cotton | 11 | 148 |
| CT74 | cotton\|gb164\|AI725950 | cotton | 12 | 149 |
| CT75 | cotton\|gb164\|AI726599 | cotton | 13 | 150 |
| CT76 | cotton\|gb164\|AI726155 | cotton | 14 | 151 |
| CT81 | cotton\|gb164\|AI726693 | cotton | 15 | 152 |
| CT82 | cotton\|gb164\|BQ402794 | cotton | 16 | 153 |
| MAB106 | barley\|gb157.2\|AL450627 | barley | 17 | 154 |
| MAB52 | rice\|gb157.2\|AU070543 | rice | 18 | 155 |
| MAB53 | rice\|gb157.2\|BI805919 | rice | 19 | 156 |
| NUE102 | maize\|gb170\|AI974922 | maize | 20 | 157 |
| NUE206 | arabidopsis\|gb165\|AT4G24960 | arabidopsis | 21 | 158 |
| NUE208 | tomato\|gb164\|BG124666 | tomato | 22 | 159 |
| NUE209 | tomato\|gb164\|BG134403 | tomato | 23 | 160 |
| NUE210 | tomato\|gb157\|TOMTRALTAB | tomato | 24 | 161 |
| NUE211 | rice\|gb157.2\|AU174544 | rice | 25 | 162 |
| NUE212 | cotton\|gb164\|CO081293 | cotton | 26 | 163 |
| NUE221 | rice\|gb157.2\|BI305241 | rice | 27 | 164 |
| NUE222 | arabidopsis\|gb165\|AT1G31820 | arabidopsis | 28 | 165 |
| NUE223 | rice\|gb157.2\|AW069985 | rice | 29 | 166 |

TABLE 20-continued

Genes which affect nitrogen use efficiency, fertilizer use efficiency, yield, growth rate, vigor, biomass, oil content, abiotic stress tolerance and/or water use efficiency

| Gene Name | Cluster Name | Organism | Polyn. SEQ ID NO: | Polyp. SEQ ID NO: |
|---|---|---|---|---|
| NUE224 | rice\|gb157.2\|AW155063 | rice | 30 | 167 |
| NUE225 | rice\|gb157.2\|BE039221 | rice | 31 | 168 |
| NUE227 | rice\|gb157.2\|AU056888 | rice | 32 | 169 |
| NUE228 | rice\|gb157.2\|AA753730 | rice | 33 | 170 |
| NUE229 | maize\|gb164\|AW455682 | maize | 34 | 171 |
| NUE230 | rice\|gb157.2\|AA749861 | rice | 35 | 172 |
| NUE231 | rice\|gb157.2\|AK108994 | rice | 36 | 173 |
| NUE233 | rice\|gb157.2\|CB640732 | rice | 37 | 174 |
| NUE234 | poplar\|gb157.2\|BU868634 | poplar | 38 | 175 |
| NUE235 | soybean\|gb162\|CA852963 | soybean | 39 | 176 |
| NUE237 | rice\|gb157.2\|BI811377 | rice | 40 | 177 |
| NUE239 | poplar\|gb157.2\|BU880014 | poplar | 41 | 178 |
| NUE240 | poplar\|gb157.2\|AJ407707 | poplar | 42 | 179 |
| NUE241 | tomato\|gb164\|BG129806 | tomato | 43 | 180 |
| NUE242 | tomato\|gb164\|BG791300 | tomato | 44 | 181 |
| NUE244 | soybean\|gb162\|CF808561 | soybean | 45 | 182 |
| NUE245 | rice\|gb157.2\|AT003383 | rice | 46 | 183 |
| NUE246 | grape\|gb160\|CF207859 | grape | 47 | 184 |
| NUE248 | maize\|gb157\|BG354535 | maize | 48 | 185 |
| NUE249 | rice\|gb157.2\|AU029933 | rice | 49 | 186 |
| NUE250 | rice\|gb157.2\|AK102239 | rice | 50 | 187 |
| NUE251 | sorghum\|gb161.xeno\|AI947781 | *sorghum* | 51 | 188 |
| NUE252 | arabidopsis\|gb165\|AT1G58030 | *arabidopsis* | 52 | 189 |
| NUE253 | rice\|gb157.2\|AF145730 | rice | 53 | 190 |
| NUE254 | maize\|gb164\|AI600563 | maize | 54 | 191 |
| NUE255 | rice\|gb157.2\|CB000630 | rice | 55 | 192 |
| NUE256 | wheat\|gb154\|TG__BE216912 | wheat | 56 | 193 |
| NUE265 | rice\|gb157.2\|BE039218 | rice | 57 | 194 |
| NUE267 | arabidopsis\|gb165\|AT5G60680 | *arabidopsis* | 58 | 195 |
| NUE268 | rice\|gb157.2\|AA750934 | rice | 59 | 196 |
| NUE269 | cotton\|gb164\|AI730085 | cotton | 60 | 197 |
| NUE49 | maize\|gb154\|AW037179 | maize | 61 | 198 |
| NUE50 | maize\|gb164\|AW287760 | maize | 62 | 199 |
| NUE511 | maize\|gb157\|AW360667 | maize | 63 | 200 |
| NUE512 | arabidopsis\|gb157.2\|AT5G23460 | *arabidopsis* | 64 | 201 |
| NUE513 | arabidopsis\|gb157.2\|AT3G26100 | *arabidopsis* | 65 | 202 |
| NUE514 | soybean\|gb162\|SOYHPR | soybean | 66 | 203 |
| NUE515 | arabidopsis\|gb165\|AT1G44920 | *arabidopsis* | 67 | 204 |
| NUE515 | arabidopsis\|gb157.2\|AT1G44920__P1 | *arabidopsis* | 67 | 266 |
| NUE516 | arabidopsis\|gb157.2\|AT1G48210 | *arabidopsis* | 68 | 205 |
| NUE519 | wheat\|gb164\|BE445396 | wheat | 69 | 206 |
| NUE520 | rice\|gb157.2\|BI305493 | rice | 70 | 207 |
| NUE521 | rice\|gb157.2\|AU077950 | rice | 71 | 208 |
| NUE523 | sorghum\|gb161.xeno\|AI901439 | *sorghum* | 72 | 209 |
| NUE525 | sorghum\|gb161.xeno\|AW052978 | *sorghum* | 73 | 210 |
| NUE527 | sorghum\|gb161.xeno\|AW055409 | *sorghum* | 74 | 211 |
| NUE528 | sorghum\|gb161.xeno\|AI372194 | *sorghum* | 75 | 212 |
| NUE531 | rice\|gb157.2\|BI805136 | rice | 76 | 213 |
| NUE532 | maize\|gb164\|AW054475 | maize | 77 | 214 |
| NUE533 | soybean\|gb166\|AW350050 | soybean | 78 | 215 |
| NUE535 | sorghum\|gb161.crp\|BE599042 | *sorghum* | 79 | 216 |
| NUE536 | maize\|gb164\|BQ279657 | maize | 80 | 217 |
| NUE537 | barley\|gb157.2\|AJ234408 | barley | 81 | 218 |
| NUE538 | sorghum\|gb161.xeno\|AW923729 | *sorghum* | 82 | 219 |
| NUE539 | rice\|gb157.2\|AW155216 | rice | 83 | 220 |
| NUE540 | arabidopsis\|gb157.2\|AT1G13980 | *arabidopsis* | 84 | 221 |
| NUE542 | arabidopsis\|gb157.2\|AT3G46280 | *arabidopsis* | 85 | 222 |
| NUE543 | rice\|gb157.2\|AK063415 | rice | 86 | 223 |
| NUE544 | cotton\|gb164\|BQ412384 | cotton | 87 | 224 |
| NUE545 | cotton\|gb164\|AI055737 | cotton | 88 | 225 |
| NUE547 | sorghum\|gb161.xeno\|BI139559 | *sorghum* | 89 | 226 |
| NUE548 | sorghum\|gb161.xeno\|BQ279657 | *sorghum* | 90 | 227 |
| NUE549 | sorghum\|gb161.xeno\|AF019147 | *sorghum* | 91 | 228 |
| NUE550 | canola\|gb161\|EE559843 | canola | 92 | 229 |
| NUE551 | barley\|gb157.3\|BE420701 | barley | 93 | 230 |
| NUE553 | barley\|gb157.3\|BE421829 | barley | 94 | 231 |
| NUE554 | sorghum\|gb161.xeno\|AA011880 | *sorghum* | 95 | 232 |
| NUE560 | rice\|gb157.2\|BE229552 | rice | 96 | 233 |
| NUE562 | rice\|gb157.2\|BE039784 | rice | 97 | 234 |
| NUE563 | rice\|gb157.2\|AU057884 | rice | 98 | 235 |
| NUE564 | maize\|gb164\|AI619269 | maize | 99 | 236 |
| NUE565 | arabidopsis\|gb157.2\|AT5G15080 | *arabidopsis* | 100 | 237 |
| NUE566 | arabidopsis\|gb165\|AT2G43700 | *arabidopsis* | 101 | 238 |
| NUE567 | arabidopsis\|gb165\|AT1G60680 | *arabidopsis* | 102 | 239 |

TABLE 20-continued

Genes which affect nitrogen use efficiency, fertilizer use efficiency, yield, growth rate, vigor, biomass, oil content, abiotic stress tolerance and/or water use efficiency

| Gene Name | Cluster Name | Organism | Polyn. SEQ ID NO: | Polyp. SEQ ID NO: |
|---|---|---|---|---|
| NUE568 | arabidopsis\|gb165\|AT1G78450 | arabidopsis | 103 | 240 |
| NUE569 | arabidopsis\|gb165\|AT2G03890 | arabidopsis | 104 | 241 |
| NUE570 | arabidopsis\|gb165\|AT1G43910 | arabidopsis | 105 | 242 |
| NUE571 | arabidopsis\|gb157.2\|AT1G47530 | arabidopsis | 106 | 243 |
| NUE572 | arabidopsis\|gb157.2\|AT2G24240 | arabidopsis | 107 | 244 |
| NUE573 | arabidopsis\|gb165\|AT4G15390 | arabidopsis | 108 | 245 |
| NUE574 | rice\|gb157.2\|BI807603 | rice | 109 | 246 |
| NUE575 | rice\|gb157.2\|AU068829 | rice | 110 | 247 |
| NUE576 | rice\|gb157.2\|AA752451 | rice | 111 | 248 |
| NUE577 | arabidopsis\|gb165\|AT1G67800 | arabidopsis | 112 | 249 |
| NUE578 | wheat\|gb164\|BE401454 | wheat | 113 | 250 |
| NUE579 | arabidopsis\|gb165\|AT1G70850 | arabidopsis | 114 | 251 |
| NUE580 | arabidopsis\|gb165\|AT2G35880 | arabidopsis | 115 | 252 |
| NUE581 | arabidopsis\|gb165\|AT1G12845 | arabidopsis | 116 | 253 |
| NUE582 | sorghum\|gb161.xeno\|T18303 | sorghum | 117 | 254 |
| NUE583 | rice\|gb157.2\|AU172665 | rice | 118 | 255 |
| NUE584 | sorghum\|gb161.crp\|AW923545 | sorghum | 119 | 256 |
| NUE585 | arabidopsis\|gb165\|AT1G71900 | arabidopsis | 120 | 257 |
| NUE586 | arabidopsis\|gb165\|AT1G72320 | arabidopsis | 121 | 258 |
| NUE587 | sorghum\|gb161.xeno\|AW672541 | sorghum | 122 | 259 |
| NUE588 | rice\|gb157.2\|AA750816 | rice | 123 | 260 |
| NUE590 | sorghum\|gb161.xeno\|AI622209 | sorghum | 124 | 261 |
| NUE591 | sorghum\|gb161.xeno\|BE123399 | sorghum | 125 | 262 |
| NUE592 | sorghum\|gb161.xeno\|AI901557 | sorghum | 126 | 263 |
| NUE593 | arabidopsis\|gb165\|AT2G04066 | arabidopsis | 127 | 264 |
| CT82 | cotton\|gb164\|BQ402794_T1 | cotton | 128 | 153 |
| NUE102 | maize\|gb164\|AI974922_T1 | maize | 129 | 265 |
| NUE211 | rice\|gb157.2\|AU174544_T1 | rice | 130 | 162 |
| NUE212 | cotton\|gb164\|CO081293_T1 | cotton | 131 | 163 |
| NUE269 | cotton\|gb164\|AI730085_T1 | cotton | 132 | 197 |
| NUE519 | wheat\|gb164\|BE445396_T1 | wheat | 133 | 206 |
| NUE535 | sorghum\|gb161.xeno\|BE599042_T1 | sorghum | 134 | 267 |
| NUE537 | barley\|gb157.2\|AJ234408_T1 | barley | 135 | 218 |
| NUE544 | cotton\|gb164\|BQ412384_T1 | cotton | 136 | 268 |
| NUE584 | sorghum\|gb161.xeno\|AW923465_T1 | sorghum | 137 | 269 |

Table 20. Provided are polynucleotides (polyn.) and polypeptides (polyp.) which affect nitrogen use efficiency, fertilizer use efficiency, yield, growth rate, vigor, biomass, oil content, abiotic stress tolerance and/or water use efficiency of a plant.

Example 2

Identification of Homologues which Affect NUE, FUE, Yield, Growth Rate, Vigor, Biomass, Oil Content, ABST and WUE The concepts of orthology and paralogy have been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative ortholog genes of genes affecting nitrogen use efficiency, fertilizer use efficiency, yield (e.g., seed yield, oil yield, biomass, grain quantity and/or quality), growth rate, vigor, biomass, oil content, abiotic stress tolerance and/or water use efficiency (presented in Table 20, above) all sequences were aligned using the BLAST (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as root). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the genes of some embodiments of the invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of some embodiments of the invention. Example of other plants include, but not limited to, barley (*Hordeum vulgare*), Arabidopsis (*Arabidopsis thaliana*), maize (*Zea mays*), cotton (Gossypium), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*) and Wheat (*Triticum aestivum*).

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of some embodiments of the invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution Tables are well known in the art [see for example Creighton (1984) Proteins. W.H. Freeman and Company]. Homologues of a nucleic acid encompass nucleic acids having nucleotide substitutions, deletions and/or insertions relative to the unmodified nucleic acid in question and having similar biological and functional activity as the unmodified nucleic acid from which they are derived.

Table 21, hereinbelow, lists a summary of orthologous and homologous sequences of the polynucleotide sequences (SEQ ID NOs:1-137) and polypeptide sequences (SEQ ID NOs:138-269) presented in Table 20, which were identified using BLAST (TBLASTN and BlastP programs) having at least 80% identity to the selected polypeptides and which are expected to posses the same role in NUE, ABST, FUE, WUE, biomass increment, growth rate increment, yield, vigor and/or oil content of plants.

TABLE 21

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 270 | cacao\|gb167\|CU484898 | cacao | 1334 | 138 | cotton\|gb164\|AI725990 | 88.2 | blastp |
| 271 | cotton\|gb164\|AI726705 | cotton | 1335 | 138 | cotton\|gb164\|AI725990 | 86.9 | blastp |
| 272 | almond\|gb157.2\|AY947462 | almond | 1336 | 139 | cotton\|gb164\|AI725968 | 85.7 | blastp |
| 273 | apple\|gb157.3\|CO415932 | apple | 1337 | 139 | cotton\|gb164\|AI725968 | 83.5 | blastp |
| 274 | bean\|gb167\|CA902463 | bean | 1338 | 139 | cotton\|gb164\|AI725968 | 87.9 | blastp |
| 275 | cacao\|gb167\|CU519200 | cacao | 1339 | 139 | cotton\|gb164\|AI725968 | 95.5 | blastp |
| 276 | citrus\|gb166\|CK936045 | citrus | 1340 | 139 | cotton\|gb164\|AI725968 | 92.4 | blastp |
| 277 | cotton\|gb164\|AI728519 | cotton | 1341 | 139 | cotton\|gb164\|AI725968 | 90.7 | blastp |
| 278 | grape\|gb160\|AF373604 | grape | 1342 | 139 | cotton\|gb164\|AI725968 | 86.2 | blastp |
| 279 | lotus\|gb157.2\|AY770405 | lotus | 1343 | 139 | cotton\|gb164\|AI725968 | 85.7 | blastp |
| 280 | medicago\|gb157.2\|BI311053 | medicago | 1344 | 139 | cotton\|gb164\|AI725968 | 87.4 | blastp |
| 281 | papaya\|gb165\|GFXEU141966X1 | papaya | 1345 | 139 | cotton\|gb164\|AI725968 | 90.1 | blastp |
| 282 | poplar\|gb170\|BU882889 | poplar | 1346 | 139 | cotton\|gb164\|AI725968 | 87.6 | blastp |
| 283 | poplar\|gb170\|CV256507 | poplar | 1347 | 139 | cotton\|gb164\|AI725968 | 83.9 | blastp |
| 284 | prunus\|gb167\|AJ825116 | prunus | 1348 | 139 | cotton\|gb164\|AI725968 | 85.2 | blastp |
| 285 | soybean\|gb168\|BE659913 | soybean | 1349 | 139 | cotton\|gb164\|AI725968 | 87.4 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 286 | soybean\|gb168\|BE659915 | soybean | 1350 | 139 | cotton\|gb164\|AI725968 | 85.2 | blastp |
| 287 | spurge\|gb161\|DV143720 | spurge | 1351 | 139 | cotton\|gb164\|AI725968 | 84.75 | tblastn |
| 288 | cotton\|gb164\|AI726482 | cotton | 1352 | 140 | cotton\|gb164\|AI727334 | 98.1 | blastp |
| 289 | cacao\|gb167\|CU473257 | cacao | 1353 | 141 | cotton\|gb164\|AI726497 | 87.4 | blastp |
| 290 | cotton\|gb164\|BF272326 | cotton | 1354 | 141 | cotton\|gb164\|AI726497 | 83.3 | blastp |
| 291 | cotton\|gb164\|AI729672 | cotton | 1355 | 144 | cotton\|gb164\|AI725456 | 83.7 | blastp |
| 292 | cotton\|gb164\|CB350460 | cotton | 1356 | 145 | cotton\|gb164\|BE052317 | 87.8 | blastp |
| 293 | cotton\|gb164\|DV437946 | cotton | 1357 | 145 | cotton\|gb164\|BE052317 | 87.8 | blastp |
| 294 | cotton\|gb164\|AI726435 | cotton | 1358 | 146 | cotton\|gb164\|AI726479 | 95.1 | blastp |
| 295 | cacao\|gb167\|CF972823 | cacao | 1359 | 148 | cotton\|gb164\|AI725508 | 81.4 | blastp |
| 296 | cotton\|gb164\|AI725520 | cotton | 1360 | 148 | cotton\|gb164\|AI725508 | 81.8 | blastp |
| 297 | cotton\|gb164\|BE054381 | cotton | 1361 | 148 | cotton\|gb164\|AI725508 | 85.4 | blastp |
| 298 | cotton\|gb164\|AI726610 | cotton | 1362 | 149 | cotton\|gb164\|AI725950 | 86.8 | blastp |
| 299 | cotton\|gb164\|AI731567 | cotton | 1363 | 149 | cotton\|gb164\|AI725950 | 96.4 | blastp |
| 300 | cotton\|gb164\|AI726627 | cotton | 1364 | 150 | cotton\|gb164\|AI726599 | 96.4 | blastp |
| 301 | brachypodium\|gb169\|BE425417 | brachypodium | 1365 | 154 | barley\|gb157.2\|AL450627 | 84.7 | blastp |
| 302 | leymus\|gb166\|EG388830 | leymus | 1366 | 154 | barley\|gb157.2\|AL450627 | 86.4 | blastp |
| 303 | pseudoroegneria\|gb167\|FF340314 | pseudoroegneria | 1367 | 154 | barley\|gb157.2\|AL450627 | 89.4 | blastp |
| 304 | wheat\|gb164\|BE429931 | wheat | 1368 | 154 | barley\|gb157.2\|AL450627 | 89.4 | blastp |
| 305 | switchgrass\|gb167\|DN142225 | switchgrass | 1369 | 156 | rice\|gb157.2\|BI805919 | 82.5 | blastp |
| 306 | brachypodium\|gb169\|BE425715 | brachypodium | 1370 | 157 | maize\|gb170\|AI974922 | 85.2 | blastp |
| 306 | brachypodium\|gb169\|BE425715 | brachypodium | 1370 | 265 | maize\|gb164\|AI974922 | 81 | blastp |
| 307 | maize\|gb170\|BG320615 | maize | 1371 | 157 | maize\|gb170\|AI974922 | 92.1 | blastp |
| 307 | maize\|gb170\|BG320615 | maize | 1371 | 265 | maize\|gb164\|AI974922 | 86 | blastp |
| 308 | maize\|gb170\|CF023721 | maize | 1372 | 157 | maize\|gb170\|AI974922 | 89.1 | blastp |
| 308 | maize\|gb170\|CF023721 | maize | 1372 | 265 | maize\|gb164\|AI974922 | 87.5 | blastp |
| 309 | maize\|gb170\|CF059393 | maize | 1373 | 157 | maize\|gb170\|AI974922 | 87.6 | blastp |
| 309 | maize\|gb170\|CF059393 | maize | 1373 | 265 | maize\|gb164\|AI974922 | 86 | blastp |
| 310 | maize\|gb170\|SRR014551S0286097 | maize | 1374 | 265 | maize\|gb164\|AI974922 | 88.1 | blastp |
| 310 | maize\|gb170\|SRR014551S0286097 | maize | 1374 | 157 | maize\|gb170\|AI974922 | 85.1 | blastp |
| 311 | rice\|gb170\|OS11G09020 | rice | 1375 | 265 | maize\|gb164\|AI974922 | 83.56 | tblastn |
| 311 | rice\|gb170\|OS11G09020 | rice | 1375 | 157 | maize\|gb170\|AI974922 | 80.1 | blastp |
| 312 | rice\|gb170\|OS12G08090 | rice | 1376 | 157 | maize\|gb170\|AI974922 | 86 | blastp |
| 312 | rice\|gb170\|OS12G08090 | rice | 1376 | 265 | maize\|gb164\|AI974922 | 81.3 | blastp |
| 313 | rice\|gb170\|OS12G08130 | rice | 1377 | 157 | maize\|gb170\|AI974922 | 86.2 | blastp |
| 313 | rice\|gb170\|OS12G08130 | rice | 1377 | 265 | maize\|gb164\|AI974922 | 81.5 | blastp |
| 314 | sorghum\|gb161.crp\|BE358811 | sorghum | 1378 | 157 | maize\|gb170\|AI974922 | 95.6 | blastp |
| 314 | sorghum\|gb161.crp\|BE358811 | sorghum | 1378 | 265 | maize\|gb164\|AI974922 | 89.8 | blastp |
| 315 | sorghum\|gb161.crp\|BG052599 | sorghum | 1379 | 157 | maize\|gb170\|AI974922 | 89.1 | blastp |
| 315 | sorghum\|gb161.crp\|BG052599 | sorghum | 1379 | 265 | maize\|gb164\|AI974922 | 87.5 | blastp |
| 316 | sorghum\|gb161.crp\|BG464355 | sorghum | 1380 | 157 | maize\|gb170\|AI974922 | 91 | blastp |
| 316 | sorghum\|gb161.crp\|BG464355 | sorghum | 1380 | 265 | maize\|gb164\|AI974922 | 85.6 | blastp |
| 317 | sorghum\|gb161.crp\|BG488442 | sorghum | 1381 | 157 | maize\|gb170\|AI974922 | 89.1 | blastp |
| 317 | sorghum\|gb161.crp\|BG488442 | sorghum | 1381 | 265 | maize\|gb164\|AI974922 | 87.7 | blastp |
| 318 | sorghum\|gb161.crp\|SBGWP027891 | sorghum | 1382 | 157 | maize\|gb170\|AI974922 | 87.6 | blastp |
| 318 | sorghum\|gb161.crp\|SBGWP027891 | sorghum | 1382 | 265 | maize\|gb164\|AI974922 | 86 | blastp |
| 319 | wheat\|gb164\|BI479031 | wheat | 1383 | 265 | maize\|gb164\|AI974922 | 81.74 | tblastn |
| 319 | wheat\|gb164\|BI479031 | wheat | 1383 | 157 | maize\|gb170\|AI974922 | 80.33 | tblastn |
| 320 | b_rapa\|gb162\|BG544047 | b_rapa | 1384 | 158 | arabidopsis\|gb165\|AT4G24960 | 87.5 | blastp |
| 321 | b_rapa\|gb162\|EX087649 | b_rapa | 1385 | 158 | arabidopsis\|gb165\|AT4G24960 | 82.2 | blastp |
| 322 | canola\|gb161\|DY020042 | canola | 1386 | 158 | arabidopsis\|gb165\|AT4G24960 | 86.8 | blastp |
| 323 | radish\|gb164\|EV538867 | radish | 1387 | 158 | arabidopsis\|gb165\|AT4G24960 | 84.4 | blastp |
| 324 | radish\|gb164\|EV544902 | radish | 1388 | 158 | arabidopsis\|gb165\|AT4G24960 | 85.1 | blastp |
| 325 | radish\|gb164\|EX746928 | radish | 1389 | 158 | arabidopsis\|gb165\|AT4G24960 | 84.4 | blastp |
| 326 | radish\|gb164\|EX748244 | radish | 1390 | 158 | arabidopsis\|gb165\|AT4G24960 | 83.9 | blastp |
| 327 | thellungiella\|gb167\|BY812778 | thellungiella | 1391 | 158 | arabidopsis\|gb165\|AT4G24960 | 84.3 | blastp |
| 328 | apple\|gb157.3\|CN876940 | apple | 1392 | 159 | tomato\|gb164\|BG124666 | 81.7 | blastp |
| 329 | apple\|gb157.3\|CN944710 | apple | 1393 | 159 | tomato\|gb164\|BG124666 | 81.7 | blastp |
| 330 | apricot\|gb157.2\|CB819340 | apricot | 1394 | 159 | tomato\|gb164\|BG124666 | 82.3 | blastp |
| 331 | b_oleracea\|gb161\|AM057864 | b_oleracea | 1395 | 159 | tomato\|gb164\|BG124666 | 80.6 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 332 | b_rapa\|gb162\|EE527690 | b_rapa | 1396 | 159 | tomato\|gb164\|BG124666 | 80.6 | blastp |
| 333 | cacao\|gb167\|CU493876 | cacao | 1397 | 159 | tomato\|gb164\|BG124666 | 80.3 | blastp |
| 334 | canola\|gb161\|CD830518 | canola | 1398 | 159 | tomato\|gb164\|BG124666 | 80 | blastp |
| 335 | canola\|gb161\|CX279110 | canola | 1399 | 159 | tomato\|gb164\|BG124666 | 80.6 | blastp |
| 336 | cassava\|gb164\|DV454217 | cassava | 1400 | 159 | tomato\|gb164\|BG124666 | 82.3 | blastp |
| 337 | catharanthus\|gb166\|EG557732 | catharanthus | 1401 | 159 | tomato\|gb164\|BG124666 | 81.1 | blastp |
| 338 | citrus\|gb166\|CB290240 | citrus | 1402 | 159 | tomato\|gb164\|BG124666 | 83.4 | blastp |
| 339 | coffea\|gb157.2\|DV694449 | coffea | 1403 | 159 | tomato\|gb164\|BG124666 | 83.4 | blastp |
| 340 | cotton\|gb164\|AI727100 | cotton | 1404 | 159 | tomato\|gb164\|BG124666 | 83.7 | blastp |
| 341 | cynara\|gb167\|GE589728 | cynara | 1405 | 159 | tomato\|gb164\|BG124666 | 80 | blastp |
| 342 | ipomoea\|gb157.2\|EE875432 | ipomoea | 1406 | 159 | tomato\|gb164\|BG124666 | 81.7 | blastp |
| 343 | kiwi\|gb166\|FG405906 | kiwi | 1407 | 159 | tomato\|gb164\|BG124666 | 81.6 | blastp |
| 344 | peach\|gb157.2\|BU044342 | peach | 1408 | 159 | tomato\|gb164\|BG124666 | 84 | blastp |
| 345 | pepper\|gb157.2\|CA514905 | pepper | 1409 | 159 | tomato\|gb164\|BG124666 | 93.1 | blastp |
| 346 | periwinkle\|gb164\|EG557732 | periwinkle | 1410 | 159 | tomato\|gb164\|BG124666 | 81.1 | blastp |
| 347 | petunia\|gb166\|CV294973 | petunia | 1411 | 159 | tomato\|gb164\|BG124666 | 88.7 | tblastn |
| 348 | poplar\|gb170\|BU867493 | poplar | 1412 | 159 | tomato\|gb164\|BG124666 | 85.2 | blastp |
| 349 | prunus\|gb167\|BU044342 | prunus | 1413 | 159 | tomato\|gb164\|BG124666 | 84 | blastp |
| 350 | safflower\|gb162\|EL399778 | safflower | 1414 | 159 | tomato\|gb164\|BG124666 | 81.71 | tblastn |
| 351 | soybean\|gb168\|AL371264 | soybean | 1415 | 159 | tomato\|gb164\|BG124666 | 81.1 | blastp |
| 352 | soybean\|gb168\|BE661867 | soybean | 1416 | 159 | tomato\|gb164\|BG124666 | 80.6 | blastp |
| 353 | spurge\|gb161\|DV121886 | spurge | 1417 | 159 | tomato\|gb164\|BG124666 | 80.6 | blastp |
| 354 | strawberry\|gb164\|DY670203 | strawberry | 1418 | 159 | tomato\|gb164\|BG124666 | 82.4 | blastp |
| 355 | sunflower\|gb162\|EL460579 | sunflower | 1419 | 159 | tomato\|gb164\|BG124666 | 80 | tblastn |
| 356 | thellungiella\|gb167\|DN773683 | thellungiella | 1420 | 159 | tomato\|gb164\|BG124666 | 80.6 | blastp |
| 357 | tobacco\|gb162\|EB445785 | tobacco | 1421 | 159 | tomato\|gb164\|BG124666 | 90.9 | blastp |
| 358 | potato\|gb157.2\|BG098579 | potato | 1422 | 160 | tomato\|gb164\|BG134403 | 97.1 | blastp |
| 359 | potato\|gb157.2\|CK246251 | potato | 1423 | 160 | tomato\|gb164\|BG134403 | 96.7 | blastp |
| 360 | potato\|gb157.2\|CK246610 | potato | 1424 | 160 | tomato\|gb164\|BG134403 | 96 | blastp |
| 361 | brachypodium\|gb169\|BF260689 | brachypodium | 1425 | 162 | rice\|gb157.2\|AU174544 | 88.6 | tblastn |
| 362 | maize\|gb170\|AI676864 | maize | 1426 | 162 | rice\|gb157.2\|AU174544 | 86.9 | blastp |
| 363 | rice\|gb170\|OS02G44980 | rice | 1427 | 162 | rice\|gb157.2\|AU174544 | 80.6 | blastp |
| 364 | sorghum\|gb161.crp\|BF704932 | sorghum | 1428 | 162 | rice\|gb157.2\|AU174544 | 89 | blastp |
| 365 | rice\|gb170\|OS12G38010 | rice | 1429 | 168 | rice\|gb157.2\|BE039221 | 91.14 | tblastn |
| 366 | rice\|gb170\|OS12G38270 | rice | 1430 | 168 | rice\|gb157.2\|BE039221 | 81.2 | blastp |
| 367 | rice\|gb170\|OS10G38040 | rice | 1431 | 169 | rice\|gb157.2\|AU056888 | 98.1 | blastp |
| 368 | maize\|gb170\|BQ528487 | maize | 1432 | 170 | rice\|gb157.2\|AA753730 | 89.1 | blastp |
| 369 | sorghum\|gb161.crp\|CD221960 | sorghum | 1433 | 170 | rice\|gb157.2\|AA753730 | 87.1 | blastp |
| 370 | switchgrass\|gb167\|DN149767 | switchgrass | 1434 | 170 | rice\|gb157.2\|AA753730 | 86.7 | blastp |
| 371 | sorghum\|gb161.crp\|SBGWP095487 | sorghum | 1435 | 171 | maize\|gb164\|AW455682 | 89.3 | blastp |
| 372 | sugarcane\|gb157.3\|CA172410 | sugarcane | 1436 | 171 | maize\|gb164\|AW455682 | 89 | blastp |
| 373 | switchgrass\|gb167\|DN144560 | switchgrass | 1437 | 171 | maize\|gb164\|AW455682 | 85.2 | blastp |
| 374 | brachypodium\|gb169\|BE404970 | brachypodium | 1438 | 172 | rice\|gb157.2\|AA749861 | 88.7 | blastp |
| 375 | cenchrus\|gb166\|EB654111 | cenchrus | 1439 | 172 | rice\|gb157.2\|AA749861 | 87 | blastp |
| 376 | leymus\|gb166\|EG400906 | leymus | 1440 | 172 | rice\|gb157.2\|AA749861 | 83.6 | blastp |
| 377 | maize\|gb170\|AW018173 | maize | 1441 | 172 | rice\|gb157.2\|AA749861 | 90 | blastp |
| 378 | maize\|gb170\|LLAI637139 | maize | 1442 | 172 | rice\|gb157.2\|AA749861 | 88.9 | blastp |
| 379 | sorghum\|gb161.crp\|AI783434 | sorghum | 1443 | 172 | rice\|gb157.2\|AA749861 | 90.5 | blastp |
| 380 | sugarcane\|gb157.3\|BU925706 | sugarcane | 1444 | 172 | rice\|gb157.2\|AA749861 | 91.2 | blastp |
| 381 | switchgrass\|gb167\|DN142209 | switchgrass | 1445 | 172 | rice\|gb157.2\|AA749861 | 91 | blastp |
| 382 | switchgrass\|gb167\|DN142636 | switchgrass | 1446 | 172 | rice\|gb157.2\|AA749861 | 90.7 | blastp |
| 383 | wheat\|gb164\|BE398863 | wheat | 1447 | 172 | rice\|gb157.2\|AA749861 | 80.9 | blastp |
| 384 | wheat\|gb164\|BE404970 | wheat | 1448 | 172 | rice\|gb157.2\|AA749861 | 81.7 | blastp |
| 385 | wheat\|gb164\|BE418290 | wheat | 1449 | 172 | rice\|gb157.2\|AA749861 | 82 | blastp |
| 386 | maize\|gb170\|BM895695 | maize | 1450 | 173 | rice\|gb157.2\|AK108994 | 84.5 | blastp |
| 387 | rice\|gb170\|OS04G55740 | rice | 1451 | 173 | rice\|gb157.2\|AK108994 | 94.7 | blastp |
| 388 | sorghum\|gb161.crp\|BM895695 | sorghum | 1452 | 173 | rice\|gb157.2\|AK108994 | 82.2 | blastp |
| 389 | brachypodium\|gb169\|CA684980 | brachypodium | 1453 | 174 | rice\|gb157.2\|CB640732 | 87.2 | blastp |
| 390 | maize\|gb170\|AW562805 | maize | 1454 | 174 | rice\|gb157.2\|CB640732 | 87.1 | blastp |
| 391 | sorghum\|gb161.crp\|CD219694 | sorghum | 1455 | 174 | rice\|gb157.2\|CB640732 | 87.7 | blastp |
| 392 | soybean\|gb168\|AL366192 | soybean | 1456 | 174 | rice\|gb157.2\|CB640732 | 80.38 | tblastn |
| 393 | poplar\|gb170\|AI166596 | poplar | 1457 | 175 | poplar\|gb157.2\|BU868634 | 88.2 | blastp |
| 394 | castorbean\|gb160\|AJ605572 | castorbean | 1458 | 176 | soybean\|gb162\|CA852963 | 81 | blastp |
| 395 | chestnut\|gb170\|SRR006296S0014660 | chestnut | 1459 | 176 | soybean\|gb162\|CA852963 | 80.08 | tblastn |
| 396 | citrus\|gb166\|CK740163 | citrus | 1460 | 176 | soybean\|gb162\|CA852963 | 80.08 | tblastn |
| 397 | cowpea\|gb166\|FF394551 | cowpea | 1461 | 176 | soybean\|gb162\|CA852963 | 90.7 | blastp |
| 398 | medicago\|gb157.2\|AA660751 | medicago | 1462 | 176 | soybean\|gb162\|CA852963 | 87.9 | blastp |
| 399 | peanut\|gb167\|EH042453 | peanut | 1463 | 176 | soybean\|gb162\|CA852963 | 88.66 | tblastn |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 400 | soybean\|gb168\|BU547671 | soybean | 1464 | 176 | soybean\|gb162\|CA852963 | 97.2 | blastp |
| 401 | barley\|gb157.3\|BE194421 | barley | 1465 | 177 | rice\|gb157.2\|BI811377 | 81.5 | blastp |
| 402 | brachypodium\|gb169\|BE424330 | brachypodium | 1466 | 177 | rice\|gb157.2\|BI811377 | 82.4 | blastp |
| 403 | leymus\|gb166\|EG376396 | leymus | 1467 | 177 | rice\|gb157.2\|BI811377 | 81.8 | blastp |
| 404 | pseudoroegneria\|gb167\|FF349876 | pseudoroegneria | 1468 | 177 | rice\|gb157.2\|BI811377 | 82.1 | blastp |
| 405 | sugarcane\|gb157.3\|CA099115 | sugarcane | 1469 | 177 | rice\|gb157.2\|BI811377 | 81 | blastp |
| 406 | wheat\|gb164\|BE424330 | wheat | 1470 | 177 | rice\|gb157.2\|BI811377 | 81.82 | tblastn |
| 407 | wheat\|gb164\|BE516775 | wheat | 1471 | 177 | rice\|gb157.2\|BI811377 | 82.1 | blastp |
| 408 | antirrhinum\|gb166\|AJ560033 | antirrhinum | 1472 | 180 | tomato\|gb164\|BG129806 | 82.9 | blastp |
| 409 | antirrhinum\|gb166\|AJ801252 | antirrhinum | 1473 | 180 | tomato\|gb164\|BG129806 | 83.3 | blastp |
| 410 | apple\|gb157.3\|AU301287 | apple | 1474 | 180 | tomato\|gb164\|BG129806 | 86.9 | blastp |
| 411 | apple\|gb157.3\|CN488989 | apple | 1475 | 180 | tomato\|gb164\|BG129806 | 84.7 | blastp |
| 412 | apple\|gb157.3\|CN864173 | apple | 1476 | 180 | tomato\|gb164\|BG129806 | 84.7 | blastp |
| 413 | apple\|gb157.3\|CN869339 | apple | 1477 | 180 | tomato\|gb164\|BG129806 | 87.4 | blastp |
| 414 | aquilegia\|gb157.3\|DR939874 | aquilegia | 1478 | 180 | tomato\|gb164\|BG129806 | 81.5 | blastp |
| 415 | arabidopsis\|gb165\|AT1G04750 | arabidopsis | 1479 | 180 | tomato\|gb164\|BG129806 | 81.5 | blastp |
| 416 | arabidopsis\|gb165\|AT2G33120 | arabidopsis | 1480 | 180 | tomato\|gb164\|BG129806 | 82 | blastp |
| 417 | artemisia\|gb164\|EY060063 | artemisia | 1481 | 180 | tomato\|gb164\|BG129806 | 84.7 | blastp |
| 418 | artemisia\|gb164\|EY073689 | artemisia | 1482 | 180 | tomato\|gb164\|BG129806 | 84.7 | blastp |
| 419 | avocado\|gb164\|CK762777 | avocado | 1483 | 180 | tomato\|gb164\|BG129806 | 82.9 | blastp |
| 420 | avocado\|gb164\|CV461025 | avocado | 1484 | 180 | tomato\|gb164\|BG129806 | 80.6 | blastp |
| 421 | b_oleracea\|gb161\|AM386735 | b_oleracea | 1485 | 180 | tomato\|gb164\|BG129806 | 80.6 | blastp |
| 422 | b_oleracea\|gb161\|CB617574 | b_oleracea | 1486 | 180 | tomato\|gb164\|BG129806 | 81.6 | blastp |
| 423 | b_rapa\|gb162\|CA992099 | b_rapa | 1487 | 180 | tomato\|gb164\|BG129806 | 80.2 | blastp |
| 424 | b_rapa\|gb162\|CV544695 | b_rapa | 1488 | 180 | tomato\|gb164\|BG129806 | 82.4 | blastp |
| 425 | b_rapa\|gb162\|DN961220 | b_rapa | 1489 | 180 | tomato\|gb164\|BG129806 | 82.1 | blastp |
| 426 | b_rapa\|gb162\|DY008890 | b_rapa | 1490 | 180 | tomato\|gb164\|BG129806 | 82.4 | blastp |
| 427 | b_rapa\|gb162\|EX034829 | b_rapa | 1491 | 180 | tomato\|gb164\|BG129806 | 80.6 | blastp |
| 428 | banana\|gb167\|FF558354 | banana | 1492 | 180 | tomato\|gb164\|BG129806 | 80.4 | blastp |
| 429 | banana\|gb167\|FL658702 | banana | 1493 | 180 | tomato\|gb164\|BG129806 | 82 | blastp |
| 430 | barley\|gb157.3\|BE413339 | barley | 1494 | 180 | tomato\|gb164\|BG129806 | 80.8 | blastp |
| 431 | basilicum\|gb157.3\|DY343103 | basilicum | 1495 | 180 | tomato\|gb164\|BG129806 | 84.1 | blastp |
| 432 | bean\|gb167\|CA898578 | bean | 1496 | 180 | tomato\|gb164\|BG129806 | 83.8 | blastp |
| 433 | bean\|gb167\|CA899486 | bean | 1497 | 180 | tomato\|gb164\|BG129806 | 87.2 | blastp |
| 434 | bean\|gb167\|CA907867 | bean | 1498 | 180 | tomato\|gb164\|BG129806 | 87.4 | blastp |
| 435 | brachypodium\|gb169\|BE417694 | brachypodium | 1499 | 180 | tomato\|gb164\|BG129806 | 80.2 | blastp |
| 436 | cacao\|gb167\|CA798042 | cacao | 1500 | 180 | tomato\|gb164\|BG129806 | 83.3 | blastp |
| 437 | cacao\|gb167\|CU474349 | cacao | 1501 | 180 | tomato\|gb164\|BG129806 | 90.5 | blastp |
| 438 | cacao\|gb167\|CU478046 | cacao | 1502 | 180 | tomato\|gb164\|BG129806 | 85.1 | blastp |
| 439 | canola\|gb161\|CD816574 | canola | 1503 | 180 | tomato\|gb164\|BG129806 | 82.4 | blastp |
| 440 | canola\|gb161\|CD818619 | canola | 1504 | 180 | tomato\|gb164\|BG129806 | 80.2 | blastp |
| 441 | canola\|gb161\|CD826636 | canola | 1505 | 180 | tomato\|gb164\|BG129806 | 82.9 | blastp |
| 442 | canola\|gb161\|CD841484 | canola | 1506 | 180 | tomato\|gb164\|BG129806 | 82.4 | blastp |
| 443 | canola\|gb161\|CN734885 | canola | 1507 | 180 | tomato\|gb164\|BG129806 | 81.5 | blastp |
| 444 | canola\|gb161\|DW998530 | canola | 1508 | 180 | tomato\|gb164\|BG129806 | 82.1 | blastp |
| 445 | canola\|gb161\|DY028580 | canola | 1509 | 180 | tomato\|gb164\|BG129806 | 82.5 | blastp |
| 446 | canola\|gb161\|EE483345 | canola | 1510 | 180 | tomato\|gb164\|BG129806 | 80.2 | blastp |
| 447 | cassava\|gb164\|BM259789 | cassava | 1511 | 180 | tomato\|gb164\|BG129806 | 84.2 | blastp |
| 448 | cassava\|gb164\|CK645968 | cassava | 1512 | 180 | tomato\|gb164\|BG129806 | 84.7 | blastp |
| 449 | cassava\|gb164\|DV446794 | cassava | 1513 | 180 | tomato\|gb164\|BG129806 | 82.4 | blastp |
| 450 | castorbean\|gb160\|EE255473 | castorbean | 1514 | 180 | tomato\|gb164\|BG129806 | 82.9 | blastp |
| 451 | castorbean\|gb160\|EE255572 | castorbean | 1515 | 180 | tomato\|gb164\|BG129806 | 85.1 | blastp |
| 452 | castorbean\|gb160\|EE259993 | castorbean | 1516 | 180 | tomato\|gb164\|BG129806 | 86 | blastp |
| 453 | centaurea\|gb166\|EH728993 | centaurea | 1517 | 180 | tomato\|gb164\|BG129806 | 84.3 | blastp |
| 454 | centaurea\|gb166\|EH737653 | centaurea | 1518 | 180 | tomato\|gb164\|BG129806 | 83.33 | tblastn |
| 455 | centaurea\|gb166\|EH743515 | centaurea | 1519 | 180 | tomato\|gb164\|BG129806 | 84.7 | blastp |
| 456 | centaurea\|gb166\|EH747496 | centaurea | 1520 | 180 | tomato\|gb164\|BG129806 | 82 | blastp |
| 457 | chestnut\|gb170\|SRR006295S0000799 | chestnut | 1521 | 180 | tomato\|gb164\|BG129806 | 84.7 | blastp |
| 458 | chestnut\|gb170\|SRR006295S0000895 | chestnut | 1522 | 180 | tomato\|gb164\|BG129806 | 85.7 | blastp |
| 459 | cichorium\|gb166\|DT212405 | cichorium | 1523 | 180 | tomato\|gb164\|BG129806 | 83.33 | tblastn |
| 460 | cichorium\|gb166\|DT212482 | cichorium | 1524 | 180 | tomato\|gb164\|BG129806 | 84.7 | blastp |
| 461 | cichorium\|gb166\|EH686887 | cichorium | 1525 | 180 | tomato\|gb164\|BG129806 | 82.88 | tblastn |
| 462 | citrus\|gb166\|BE205677 | citrus | 1526 | 180 | tomato\|gb164\|BG129806 | 88.3 | blastp |
| 463 | citrus\|gb166\|CB290704 | citrus | 1527 | 180 | tomato\|gb164\|BG129806 | 83.3 | blastp |
| 464 | citrus\|gb166\|CF830698 | citrus | 1528 | 180 | tomato\|gb164\|BG129806 | 83.8 | blastp |
| 465 | coffea\|gb157.2\|CF588660 | coffea | 1529 | 180 | tomato\|gb164\|BG129806 | 82.9 | blastp |
| 466 | coffea\|gb157.2\|DV665256 | coffea | 1530 | 180 | tomato\|gb164\|BG129806 | 80.5 | blastp |
| 467 | cotton\|gb164\|AI055143 | cotton | 1531 | 180 | tomato\|gb164\|BG129806 | 82.4 | blastp |
| 468 | cotton\|gb164\|AI726538 | cotton | 1532 | 180 | tomato\|gb164\|BG129806 | 82.43 | tblastn |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 469 | cotton\|gb164\|BF268281 | cotton | 1533 | 180 | tomato\|gb164\|BG129806 | 88.3 | blastp |
| 470 | cotton\|gb164\|BF270800 | cotton | 1534 | 180 | tomato\|gb164\|BG129806 | 85.1 | blastp |
| 471 | cotton\|gb164\|BF274309 | cotton | 1535 | 180 | tomato\|gb164\|BG129806 | 88.8 | blastp |
| 472 | cowpea\|gb166\|FF382703 | cowpea | 1536 | 180 | tomato\|gb164\|BG129806 | 84.2 | blastp |
| 473 | cowpea\|gb166\|FF385500 | cowpea | 1537 | 180 | tomato\|gb164\|BG129806 | 87.4 | blastp |
| 474 | cowpea\|gb166\|FF388694 | cowpea | 1538 | 180 | tomato\|gb164\|BG129806 | 88 | blastp |
| 475 | cycas\|gb166\|CB090084 | *cycas* | 1539 | 180 | tomato\|gb164\|BG129806 | 80.6 | blastp |
| 476 | cynara\|gb167\|GE583641 | *cynara* | 1540 | 180 | tomato\|gb164\|BG129806 | 81.98 | tblastn |
| 477 | cynara\|gb167\|GE586008 | *cynara* | 1541 | 180 | tomato\|gb164\|BG129806 | 80.18 | tblastn |
| 478 | dandelion\|gb161\|DY820375 | dandelion | 1542 | 180 | tomato\|gb164\|BG129806 | 84.23 | tblastn |
| 479 | dandelion\|gb161\|DY822153 | dandelion | 1543 | 180 | tomato\|gb164\|BG129806 | 85.1 | blastp |
| 480 | fescue\|gb161\|DT686644 | *fescue* | 1544 | 180 | tomato\|gb164\|BG129806 | 82.9 | blastp |
| 481 | ginger\|gb164\|DY354490 | ginger | 1545 | 180 | tomato\|gb164\|BG129806 | 82.9 | blastp |
| 482 | ginger\|gb164\|DY357009 | ginger | 1546 | 180 | tomato\|gb164\|BG129806 | 81.53 | tblastn |
| 483 | grape\|gb160\|BQ797249 | grape | 1547 | 180 | tomato\|gb164\|BG129806 | 84.2 | blastp |
| 484 | grape\|gb160\|CA814878 | grape | 1548 | 180 | tomato\|gb164\|BG129806 | 83.4 | blastp |
| 485 | grape\|gb160\|CB009359 | grape | 1549 | 180 | tomato\|gb164\|BG129806 | 83.8 | blastp |
| 486 | ipomoea\|gb157.2\|BJ554498 | *ipomoea* | 1550 | 180 | tomato\|gb164\|BG129806 | 90.1 | blastp |
| 487 | ipomoea\|gb157.2\|BJ555833 | *ipomoea* | 1551 | 180 | tomato\|gb164\|BG129806 | 89.6 | blastp |
| 488 | ipomoea\|gb157.2\|BJ565525 | *ipomoea* | 1552 | 180 | tomato\|gb164\|BG129806 | 89.6 | blastp |
| 489 | ipomoea\|gb157.2\|DQ016990 | *ipomoea* | 1553 | 180 | tomato\|gb164\|BG129806 | 82 | blastp |
| 490 | kiwi\|gb166\|FG428824 | kiwi | 1554 | 180 | tomato\|gb164\|BG129806 | 81.5 | blastp |
| 491 | lettuce\|gb157.2\|DW046480 | lettuce | 1555 | 180 | tomato\|gb164\|BG129806 | 85.1 | blastp |
| 492 | lettuce\|gb157.2\|DW051770 | lettuce | 1556 | 180 | tomato\|gb164\|BG129806 | 80.6 | blastp |
| 493 | lettuce\|gb157.2\|DW054433 | lettuce | 1557 | 180 | tomato\|gb164\|BG129806 | 84.7 | blastp |
| 494 | lettuce\|gb157.2\|DW104005 | lettuce | 1558 | 180 | tomato\|gb164\|BG129806 | 83.8 | blastp |
| 495 | lettuce\|gb157.2\|DW148893 | lettuce | 1559 | 180 | tomato\|gb164\|BG129806 | 84.7 | blastp |
| 496 | liriodendron\|gb166\|CK761427 | *liriodendron* | 1560 | 180 | tomato\|gb164\|BG129806 | 81.1 | blastp |
| 497 | lovegrass\|gb167\|EH189433 | lovegrass | 1561 | 180 | tomato\|gb164\|BG129806 | 81.5 | blastp |
| 498 | maize\|gb170\|AI621444 | maize | 1562 | 180 | tomato\|gb164\|BG129806 | 83 | blastp |
| 499 | maize\|gb170\|AI901672 | maize | 1563 | 180 | tomato\|gb164\|BG129806 | 81.5 | blastp |
| 500 | medicago\|gb157.2\|AL371369 | *medicago* | 1564 | 180 | tomato\|gb164\|BG129806 | 81.3 | blastp |
| 501 | medicago\|gb157.2\|AW127543 | *medicago* | 1565 | 180 | tomato\|gb164\|BG129806 | 85.3 | blastp |
| 502 | medicago\|gb157.2\|AW329342 | *medicago* | 1566 | 180 | tomato\|gb164\|BG129806 | 81.5 | blastp |
| 503 | melon\|gb165\|AM743036 | melon | 1567 | 180 | tomato\|gb164\|BG129806 | 82.9 | blastp |
| 504 | melon\|gb165\|DV633620 | melon | 1568 | 180 | tomato\|gb164\|BG129806 | 80.6 | blastp |
| 505 | nuphar\|gb166\|ES730054 | *nuphar* | 1569 | 180 | tomato\|gb164\|BG129806 | 81.2 | blastp |
| 506 | oak\|gb170\|CU639508 | oak | 1570 | 180 | tomato\|gb164\|BG129806 | 85.7 | blastp |
| 507 | oak\|gb170\|SRR006307S0008904 | oak | 1571 | 180 | tomato\|gb164\|BG129806 | 84.7 | blastp |
| 508 | oil_palm\|gb166\|CN599846 | oil_palm | 1572 | 180 | tomato\|gb164\|BG129806 | 82 | blastp |
| 509 | onion\|gb162\|CF440003 | onion | 1573 | 180 | tomato\|gb164\|BG129806 | 82.43 | tblastn |
| 510 | papaya\|gb165\|AM904122 | *papaya* | 1574 | 180 | tomato\|gb164\|BG129806 | 84.2 | blastp |
| 511 | papaya\|gb165\|EX245134 | *papaya* | 1575 | 180 | tomato\|gb164\|BG129806 | 83.8 | blastp |
| 512 | peach\|gb157.2\|BU040787 | peach | 1576 | 180 | tomato\|gb164\|BG129806 | 88.7 | blastp |
| 513 | peach\|gb157.2\|BU048627 | peach | 1577 | 180 | tomato\|gb164\|BG129806 | 81.53 | tblastn |
| 514 | peanut\|gb167\|EH042957 | peanut | 1578 | 180 | tomato\|gb164\|BG129806 | 88.4 | blastp |
| 515 | peanut\|gb167\|EH044861 | peanut | 1579 | 180 | tomato\|gb164\|BG129806 | 83 | blastp |
| 516 | pepper\|gb157.2\|CA520584 | pepper | 1580 | 180 | tomato\|gb164\|BG129806 | 82.4 | blastp |
| 517 | petunia\|gb166\|CV296853 | *petunia* | 1581 | 180 | tomato\|gb164\|BG129806 | 82.9 | blastp |
| 518 | pineapple\|gb157.2\|DT337519 | pineapple | 1582 | 180 | tomato\|gb164\|BG129806 | 83.3 | blastp |
| 519 | poplar\|gb170\|AI166018 | poplar | 1583 | 180 | tomato\|gb164\|BG129806 | 86.9 | blastp |
| 520 | poplar\|gb170\|BI120322 | poplar | 1584 | 180 | tomato\|gb164\|BG129806 | 82.9 | blastp |
| 521 | poplar\|gb170\|BI128184 | poplar | 1585 | 180 | tomato\|gb164\|BG129806 | 81.1 | blastp |
| 522 | poplar\|gb170\|BU818354 | poplar | 1586 | 180 | tomato\|gb164\|BG129806 | 87.8 | blastp |
| 523 | poplar\|gb170\|CB240411 | poplar | 1587 | 180 | tomato\|gb164\|BG129806 | 81.1 | blastp |
| 524 | potato\|gb157.2\|BG590329 | potato | 1588 | 180 | tomato\|gb164\|BG129806 | 80.3 | blastp |
| 525 | potato\|gb157.2\|BG886984 | potato | 1589 | 180 | tomato\|gb164\|BG129806 | 82.9 | blastp |
| 526 | potato\|gb157.2\|BI406651 | potato | 1590 | 180 | tomato\|gb164\|BG129806 | 100 | blastp |
| 527 | prunus\|gb167\|BU040787 | *prunus* | 1591 | 180 | tomato\|gb164\|BG129806 | 88.7 | blastp |
| 528 | prunus\|gb167\|BU048627 | *prunus* | 1592 | 180 | tomato\|gb164\|BG129806 | 85.6 | blastp |
| 529 | pseudoroegneria\|gb167\|FF341379 | *pseudoroegneria* | 1593 | 180 | tomato\|gb164\|BG129806 | 81.2 | blastp |
| 530 | radish\|gb164\|EV527352 | radish | 1594 | 180 | tomato\|gb164\|BG129806 | 82.5 | blastp |
| 531 | radish\|gb164\|EV528724 | radish | 1595 | 180 | tomato\|gb164\|BG129806 | 82 | blastp |
| 532 | radish\|gb164\|EV532638 | radish | 1596 | 180 | tomato\|gb164\|BG129806 | 82 | blastp |
| 533 | radish\|gb164\|EV535212 | radish | 1597 | 180 | tomato\|gb164\|BG129806 | 82.5 | blastp |
| 534 | radish\|gb164\|EV544241 | radish | 1598 | 180 | tomato\|gb164\|BG129806 | 82 | blastp |
| 535 | radish\|gb164\|EV549527 | radish | 1599 | 180 | tomato\|gb164\|BG129806 | 81.98 | tblastn |
| 536 | radish\|gb164\|EV567707 | radish | 1600 | 180 | tomato\|gb164\|BG129806 | 82 | blastp |
| 537 | radish\|gb164\|EW724564 | radish | 1601 | 180 | tomato\|gb164\|BG129806 | 82 | blastp |
| 538 | radish\|gb164\|EX755021 | radish | 1602 | 180 | tomato\|gb164\|BG129806 | 80.7 | blastp |
| 539 | rice\|gb170\|OS03G58840 | rice | 1603 | 180 | tomato\|gb164\|BG129806 | 82.9 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 540 | rice\|gb170\|OS07G09600 | rice | 1604 | 180 | tomato\|gb164\|BG129806 | 82.9 | blastp |
| 541 | safflower\|gb162\|EL373980 | safflower | 1605 | 180 | tomato\|gb164\|BG129806 | 84.7 | blastp |
| 542 | safflower\|gb162\|EL381462 | safflower | 1606 | 180 | tomato\|gb164\|BG129806 | 83.8 | blastp |
| 543 | safflower\|gb162\|EL389501 | safflower | 1607 | 180 | tomato\|gb164\|BG129806 | 81.5 | blastp |
| 544 | safflower\|gb162\|EL404279 | safflower | 1608 | 180 | tomato\|gb164\|BG129806 | 84.7 | blastp |
| 545 | senecio\|gb170\|DY663178 | senecio | 1609 | 180 | tomato\|gb164\|BG129806 | 81.08 | tblastn |
| 546 | sorghum\|gb161.crp\|AW282206 | sorghum | 1610 | 180 | tomato\|gb164\|BG129806 | 81.5 | blastp |
| 547 | sorghum\|gb161.crp\|AW565015 | sorghum | 1611 | 180 | tomato\|gb164\|BG129806 | 83 | blastp |
| 548 | soybean\|gb168\|AL371369 | soybean | 1612 | 180 | tomato\|gb164\|BG129806 | 87.8 | blastp |
| 549 | soybean\|gb168\|AL371370 | soybean | 1613 | 180 | tomato\|gb164\|BG129806 | 87.6 | blastp |
| 550 | soybean\|gb168\|AL374552 | soybean | 1614 | 180 | tomato\|gb164\|BG129806 | 87.4 | blastp |
| 551 | soybean\|gb168\|AL384290 | soybean | 1615 | 180 | tomato\|gb164\|BG129806 | 86.7 | blastp |
| 552 | soybean\|gb168\|BE658783 | soybean | 1616 | 180 | tomato\|gb164\|BG129806 | 84.7 | blastp |
| 553 | soybean\|gb168\|BE660085 | soybean | 1617 | 180 | tomato\|gb164\|BG129806 | 85.1 | blastp |
| 554 | spurge\|gb161\|DV113185 | spurge | 1618 | 180 | tomato\|gb164\|BG129806 | 83.8 | blastp |
| 555 | spurge\|gb161\|DV115533 | spurge | 1619 | 180 | tomato\|gb164\|BG129806 | 86.5 | blastp |
| 556 | spurge\|gb161\|DV129528 | spurge | 1620 | 180 | tomato\|gb164\|BG129806 | 82.4 | blastp |
| 557 | strawberry\|gb164\|CO380944 | strawberry | 1621 | 180 | tomato\|gb164\|BG129806 | 87.4 | blastp |
| 558 | strawberry\|gb164\|DY667942 | strawberry | 1622 | 180 | tomato\|gb164\|BG129806 | 83.8 | blastp |
| 559 | sugarcane\|gb157.3\|CA066679 | sugarcane | 1623 | 180 | tomato\|gb164\|BG129806 | 81.53 | tblastn |
| 560 | sugarcane\|gb157.3\|CA070863 | sugarcane | 1624 | 180 | tomato\|gb164\|BG129806 | 83 | blastp |
| 561 | sugarcane\|gb157.3\|CA073069 | sugarcane | 1625 | 180 | tomato\|gb164\|BG129806 | 82.5 | blastp |
| 562 | sugarcane\|gb157.3\|CA098212 | sugarcane | 1626 | 180 | tomato\|gb164\|BG129806 | 81.1 | blastp |
| 563 | sugarcane\|gb157.3\|CA105955 | sugarcane | 1627 | 180 | tomato\|gb164\|BG129806 | 83 | blastp |
| 564 | sugarcane\|gb157.3\|CA125341 | sugarcane | 1628 | 180 | tomato\|gb164\|BG129806 | 83 | blastp |
| 565 | sunflower\|gb162\|CD848438 | sunflower | 1629 | 180 | tomato\|gb164\|BG129806 | 83.8 | blastp |
| 566 | sunflower\|gb162\|CD855829 | sunflower | 1630 | 180 | tomato\|gb164\|BG129806 | 84.7 | blastp |
| 567 | sunflower\|gb162\|DY909391 | sunflower | 1631 | 180 | tomato\|gb164\|BG129806 | 84.7 | blastp |
| 568 | sunflower\|gb162\|EL423569 | sunflower | 1632 | 180 | tomato\|gb164\|BG129806 | 83.3 | blastp |
| 569 | sunflower\|gb162\|EL429220 | sunflower | 1633 | 180 | tomato\|gb164\|BG129806 | 85.1 | blastp |
| 570 | switchgrass\|gb167\|DN143573 | switchgrass | 1634 | 180 | tomato\|gb164\|BG129806 | 82.4 | blastp |
| 571 | switchgrass\|gb167\|DN151435 | switchgrass | 1635 | 180 | tomato\|gb164\|BG129806 | 82.9 | blastp |
| 572 | switchgrass\|gb167\|FE607763 | switchgrass | 1636 | 180 | tomato\|gb164\|BG129806 | 83 | blastp |
| 573 | switchgrass\|gb167\|FE624609 | switchgrass | 1637 | 180 | tomato\|gb164\|BG129806 | 84.2 | blastp |
| 574 | thellungiella\|gb167\|BY802757 | thellungiella | 1638 | 180 | tomato\|gb164\|BG129806 | 81.5 | blastp |
| 575 | tobacco\|gb162\|DV157924 | tobacco | 1639 | 180 | tomato\|gb164\|BG129806 | 82.4 | blastp |
| 576 | tobacco\|gb162\|EB426444 | tobacco | 1640 | 180 | tomato\|gb164\|BG129806 | 96.4 | tblastn |
| 577 | tobacco\|gb162\|EB426574 | tobacco | 1641 | 180 | tomato\|gb164\|BG129806 | 84.7 | blastp |
| 578 | tobacco\|gb162\|EB677916 | tobacco | 1642 | 180 | tomato\|gb164\|BG129806 | 94.1 | blastp |
| 579 | tomato\|gb164\|BG135003 | tomato | 1643 | 180 | tomato\|gb164\|BG129806 | 84.2 | blastp |
| 580 | tomato\|gb164\|BG629456 | tomato | 1644 | 180 | tomato\|gb164\|BG129806 | 82.9 | blastp |
| 581 | triphysaria\|gb164\|DR172719 | triphysaria | 1645 | 180 | tomato\|gb164\|BG129806 | 82.3 | blastp |
| 582 | triphysaria\|gb164\|EY126667 | triphysaria | 1646 | 180 | tomato\|gb164\|BG129806 | 83.8 | blastp |
| 583 | triphysaria\|gb164\|EY128979 | triphysaria | 1647 | 180 | tomato\|gb164\|BG129806 | 83.8 | blastp |
| 584 | walnuts\|gb166\|CV198306 | walnuts | 1648 | 180 | tomato\|gb164\|BG129806 | 85.7 | blastp |
| 585 | wheat\|gb164\|BE400499 | wheat | 1649 | 180 | tomato\|gb164\|BG129806 | 80.8 | blastp |
| 586 | wheat\|gb164\|BE417694 | wheat | 1650 | 180 | tomato\|gb164\|BG129806 | 81.2 | blastp |
| 587 | wheat\|gb164\|CA595472 | wheat | 1651 | 180 | tomato\|gb164\|BG129806 | 81.2 | blastp |
| 588 | zamia\|gb166\|FD768487 | zamia | 1652 | 180 | tomato\|gb164\|BG129806 | 80.2 | blastp |
| 589 | barley\|gb157.3\|AL450674 | barley | 1653 | 183 | rice\|gb157.2\|AT003383 | 85.7 | blastp |
| 590 | brachypodium\|gb169\|BE424284 | brachypodium | 1654 | 183 | rice\|gb157.2\|AT003383 | 83.4 | blastp |
| 591 | fescue\|gb161\|DT675288 | fescue | 1655 | 183 | rice\|gb157.2\|AT003383 | 85.4 | blastp |
| 592 | leymus\|gb166\|CN466264 | leymus | 1656 | 183 | rice\|gb157.2\|AT003383 | 84.6 | blastp |
| 593 | maize\|gb170\|AI438809 | maize | 1657 | 183 | rice\|gb157.2\|AT003383 | 84.4 | blastp |
| 594 | maize\|gb170\|AI977870 | maize | 1658 | 183 | rice\|gb157.2\|AT003383 | 82.8 | blastp |
| 595 | maize\|gb170\|LLDQ245361 | maize | 1659 | 183 | rice\|gb157.2\|AT003383 | 85.7 | tblastn |
| 596 | pseudoroegneria\|gb167\|FF341007 | pseudoroegneria | 1660 | 183 | rice\|gb157.2\|AT003383 | 85.7 | blastp |
| 597 | rye\|gb164\|BE586725 | rye | 1661 | 183 | rice\|gb157.2\|AT003383 | 85.7 | blastp |
| 598 | sorghum\|gb161.crp\|AW565030 | sorghum | 1662 | 183 | rice\|gb157.2\|AT003383 | 82.9 | blastp |
| 599 | sugarcane\|gb157.3\|CA084082 | sugarcane | 1663 | 183 | rice\|gb157.2\|AT003383 | 83.1 | blastp |
| 600 | switchgrass\|gb167\|DN142592 | switchgrass | 1664 | 183 | rice\|gb157.2\|AT003383 | 86.4 | blastp |
| 601 | switchgrass\|gb167\|DN145453 | switchgrass | 1665 | 183 | rice\|gb157.2\|AT003383 | 85 | blastp |
| 602 | wheat\|gb164\|BE424284 | wheat | 1666 | 183 | rice\|gb157.2\|AT003383 | 85.7 | blastp |
| 603 | wheat\|gb164\|BE498139 | wheat | 1667 | 183 | rice\|gb157.2\|AT003383 | 85.3 | blastp |
| 604 | wheat\|gb164\|BF200880 | wheat | 1668 | 183 | rice\|gb157.2\|AT003383 | 85.1 | blastp |
| 605 | wheat\|gb164\|CA620728 | wheat | 1669 | 183 | rice\|gb157.2\|AT003383 | 81.67 | tblastn |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 606 | brachypodium\|gb169\|AJ476542 | brachypodium | 1670 | 185 | maize\|gb157\|BG354535 | 91 | blastp |
| 607 | leymus\|gb166\|EG388555 | leymus | 1671 | 185 | maize\|gb157\|BG354535 | 88.3 | blastp |
| 608 | pseudoroegneria\|gb167\|FF346414 | pseudoroegneria | 1672 | 185 | maize\|gb157\|BG354535 | 88.9 | blastp |
| 609 | rice\|gb170\|OS01G51190 | rice | 1673 | 185 | maize\|gb157\|BG354535 | 91.57 | tblastn |
| 610 | sorghum\|gb161.crp\|AW283867 | sorghum | 1674 | 185 | maize\|gb157\|BG354535 | 98.8 | blastp |
| 611 | wheat\|gb164\|AL820971 | wheat | 1675 | 185 | maize\|gb157\|BG354535 | 88.3 | blastp |
| 612 | maize\|gb170\|BI388811 | maize | 1676 | 186 | rice\|gb157.2\|AU029933 | 82.8 | blastp |
| 613 | sorghum\|gb161.crp\|DR807282 | sorghum | 1677 | 186 | rice\|gb157.2\|AU029933 | 82 | blastp |
| 614 | rice\|gb170\|OS01G65169 | rice | 1678 | 187 | rice\|gb157.2\|AK102239 | 82.5 | blastp |
| 615 | brachypodium\|gb169\|BE421953 | brachypodium | 1679 | 188 | sorghum\|gb161.xeno\|AI947781 | 81.97 | tblastn |
| 616 | maize\|gb170\|AI947781 | maize | 1680 | 188 | sorghum\|gb161.xeno\|AI947781 | 95.8 | blastp |
| 617 | rice\|gb170\|OS01G65100 | rice | 1681 | 188 | sorghum\|gb161.xeno\|AI947781 | 87 | blastp |
| 618 | switchgrass\|gb167\|DN144961 | switchgrass | 1682 | 188 | sorghum\|gb161.xeno\|AI947781 | 90.2 | tblastn |
| 619 | canola\|gb161\|EE417585 | canola | 1683 | 189 | arabidopsis\|gb165\|AT1G58030 | 89 | blastp |
| 620 | radish\|gb164\|EV566943 | radish | 1684 | 189 | arabidopsis\|gb165\|AT1G58030 | 89.47 | tblastn |
| 621 | barley\|gb157.3\|BE412663 | barley | 1685 | 191 | maize\|gb164\|AI600563 | 84.2 | blastp |
| 622 | brachypodium\|gb169\|BE407009 | brachypodium | 1686 | 191 | maize\|gb164\|AI600563 | 88.6 | blastp |
| 623 | rice\|gb170\|OS04G56290 | rice | 1687 | 191 | maize\|gb164\|AI600563 | 88.1 | blastp |
| 624 | sorghum\|gb161.crp\|AI622153 | sorghum | 1688 | 191 | maize\|gb164\|AI600563 | 95.3 | blastp |
| 625 | sugarcane\|gb157.3\|CA067412 | sugarcane | 1689 | 191 | maize\|gb164\|AI600563 | 95 | blastp |
| 626 | switchgrass\|gb167\|DN150103 | switchgrass | 1690 | 191 | maize\|gb164\|AI600563 | 93.5 | blastp |
| 627 | wheat\|gb164\|BE407009 | wheat | 1691 | 191 | maize\|gb164\|AI600563 | 87.5 | blastp |
| 628 | rice\|gb170\|OS01G03530 | rice | 1692 | 192 | rice\|gb157.2\|CB000630 | 99.8 | blastp |
| 629 | barley\|gb157.3\|BF066082 | barley | 1693 | 193 | wheat\|gb154\|TG_BE216912 | 88.03 | tblastn |
| 630 | barley\|gb157.3\|HVU08135 | barley | 1694 | 193 | wheat\|gb154\|TG_BE216912 | 81.7 | blastp |
| 631 | brachypodium\|gb169\|HVU08135 | brachypodium | 1695 | 193 | wheat\|gb154\|TG_BE216912 | 91.1 | blastp |
| 632 | fescue\|gb161\|DT682842 | fescue | 1696 | 193 | wheat\|gb154\|TG_BE216912 | 86.5 | blastp |
| 633 | leymus\|gb166\|CD808858 | leymus | 1697 | 193 | wheat\|gb154\|TG_BE216912 | 97.4 | blastp |
| 634 | maize\|gb170\|AI491463 | maize | 1698 | 193 | wheat\|gb154\|TG_BE216912 | 84.3 | blastp |
| 635 | maize\|gb170\|AI601031 | maize | 1699 | 193 | wheat\|gb154\|TG_BE216912 | 84.9 | blastp |
| 636 | pseudoroegneria\|gb167\|FF347239 | pseudoroegneria | 1700 | 193 | wheat\|gb154\|TG_BE216912 | 98.3 | blastp |
| 637 | rice\|gb170\|OS03G56670 | rice | 1701 | 193 | wheat\|gb154\|TG_BE216912 | 85 | blastp |
| 638 | rye\|gb164\|BE636806 | rye | 1702 | 193 | wheat\|gb154\|TG_BE216912 | 84 | blastp |
| 639 | sorghum\|gb161.crp\|AI861201 | sorghum | 1703 | 193 | wheat\|gb154\|TG_BE216912 | 85.4 | blastp |
| 640 | switchgrass\|gb167\|DN144671 | switchgrass | 1704 | 193 | wheat\|gb154\|TG_BE216912 | 84.4 | blastp |
| 641 | wheat\|gb164\|BE213564 | wheat | 1705 | 193 | wheat\|gb154\|TG_BE216912 | 91.5 | blastp |
| 642 | wheat\|gb164\|BE216912 | wheat | 1706 | 193 | wheat\|gb154\|TG_BE216912 | 89.8 | blastp |
| 643 | wheat\|gb164\|BE415875 | wheat | 1707 | 193 | wheat\|gb154\|TG_BE216912 | 93.5 | blastp |
| 644 | wheat\|gb164\|CK217408 | wheat | 1708 | 193 | wheat\|gb154\|TG_BE216912 | 83.12 | tblastn |
| 645 | wheat\|gb164\|DR737269 | wheat | 1709 | 193 | wheat\|gb154\|TG_BE216912 | 82.25 | tblastn |
| 646 | leymus\|gb166\|EG400892 | leymus | 1710 | 194 | rice\|gb157.2\|BE039218 | 81.9 | blastp |
| 647 | b_oleracea\|gb161\|AM059989 | b_oleracea | 1711 | 195 | arabidopsis\|gb165\|AT5G60680 | 80.6 | blastp |
| 648 | canola\|gb161\|DW997913 | canola | 1712 | 195 | arabidopsis\|gb165\|AT5G60680 | 81.2 | blastp |
| 649 | bean\|gb167\|CA898406 | bean | 1713 | 196 | rice\|gb157.2\|AA750934 | 80.5 | blastp |
| 650 | cacao\|gb167\|CU469591 | cacao | 1714 | 196 | rice\|gb157.2\|AA750934 | 80.6 | blastp |
| 651 | cassava\|gb164\|CK641441 | cassava | 1715 | 196 | rice\|gb157.2\|AA750934 | 80.9 | blastp |
| 652 | castorbean\|gb160\|T15009 | castorbean | 1716 | 196 | rice\|gb157.2\|AA750934 | 80.2 | blastp |
| 653 | cowpea\|gb166\|FC457559 | cowpea | 1717 | 196 | rice\|gb157.2\|AA750934 | 80.2 | blastp |
| 654 | cowpea\|gb166\|FC461906 | cowpea | 1718 | 196 | rice\|gb157.2\|AA750934 | 80.3 | blastp |
| 655 | maize\|gb170\|W21620 | maize | 1719 | 196 | rice\|gb157.2\|AA750934 | 87.6 | blastp |
| 656 | oil_palm\|gb166\|CN601354 | oil_palm | 1720 | 196 | rice\|gb157.2\|AA750934 | 81.1 | blastp |
| 657 | papaya\|gb165\|EX264224 | papaya | 1721 | 196 | rice\|gb157.2\|AA750934 | 80 | blastp |
| 658 | pineapple\|gb157.2\|CO730751 | pineapple | 1722 | 196 | rice\|gb157.2\|AA750934 | 81.6 | blastp |
| 659 | sorghum\|gb161.crp\|W21620 | sorghum | 1723 | 196 | rice\|gb157.2\|AA750934 | 87.4 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 660 | soybean\|gb168\|AL373484 | soybean | 1724 | 196 | rice\|gb157.2\|AA750934 | 80.9 | blastp |
| 661 | soybean\|gb168\|AW348141 | soybean | 1725 | 196 | rice\|gb157.2\|AA750934 | 80.4 | blastp |
| 662 | soybean\|gb168\|AW587090 | soybean | 1726 | 196 | rice\|gb157.2\|AA750934 | 80.4 | blastp |
| 663 | sugarcane\|gb157.3\|BQ535675 | sugarcane | 1727 | 196 | rice\|gb157.2\|AA750934 | 86.8 | blastp |
| 664 | switchgrass\|gb167\|DN140694 | switchgrass | 1728 | 196 | rice\|gb157.2\|AA750934 | 86.1 | blastp |
| 665 | switchgrass\|gb167\|DN141888 | switchgrass | 1729 | 196 | rice\|gb157.2\|AA750934 | 85.8 | blastp |
| 666 | switchgrass\|gb167\|FE603746 | switchgrass | 1730 | 196 | rice\|gb157.2\|AA750934 | 85.3 | blastp |
| 667 | maize\|gb170\|BE129570 | maize | 1731 | 198 | maize\|gb154\|AW037179 | 96.1 | blastp |
| 668 | maize\|gb170\|BI478834 | maize | 1732 | 198 | maize\|gb154\|AW037179 | 92.9 | blastp |
| 669 | rice\|gb170\|OS02G54730 | rice | 1733 | 198 | maize\|gb154\|AW037179 | 81.4 | blastp |
| 670 | sorghum\|gb161.crp\|BE129570 | sorghum | 1734 | 198 | maize\|gb154\|AW037179 | 91.8 | blastp |
| 671 | sorghum\|gb161.crp\|CD231473 | sorghum | 1735 | 199 | maize\|gb164\|AW287760 | 81.98 | tblastn |
| 672 | sugarcane\|gb157.3\|CA089926 | sugarcane | 1736 | 199 | maize\|gb164\|AW287760 | 88.56 | tblastn |
| 673 | switchgrass\|gb167\|FL699406 | switchgrass | 1737 | 199 | maize\|gb164\|AW287760 | 85.3 | blastp |
| 674 | switchgrass\|gb167\|FL727557 | switchgrass | 1738 | 199 | maize\|gb164\|AW287760 | 81.9 | blastp |
| 675 | sorghum\|gb161.crp\|BF480947 | sorghum | 1739 | 200 | maize\|gb157\|AW360667 | 96.1 | blastp |
| 676 | sugarcane\|gb157.3\|CA069365 | sugarcane | 1740 | 200 | maize\|gb157\|AW360667 | 97.2 | blastp |
| 677 | apple\|gb157.3\|CN873722 | apple | 1741 | 202 | arabidopsis\|gb157.2\| AT3G26100 | 80.26 | tblastn |
| 678 | chestnut\|gb170\|SRR006295S0001486 | chestnut | 1742 | 202 | arabidopsis\|gb157.2\| AT3G26100 | 82.2 | blastp |
| 679 | cotton\|gb164\|AI728964 | cotton | 1743 | 202 | arabidopsis\|gb157.2\| AT3G26100 | 80.3 | blastp |
| 680 | grape\|gb160\|CB004507 | grape | 1744 | 202 | arabidopsis\|gb157.2\| AT3G26100 | 80.3 | blastp |
| 681 | papaya\|gb165\|EX243430 | papaya | 1745 | 202 | arabidopsis\|gb157.2\| AT3G26100 | 82.8 | blastp |
| 682 | poplar\|gb170\|AI165788 | poplar | 1746 | 202 | arabidopsis\|gb157.2\| AT3G26100 | 80.26 | tblastn |
| 683 | poplar\|gb170\|BI071804 | poplar | 1747 | 202 | arabidopsis\|gb157.2\| AT3G26100 | 80.75 | tblastn |
| 684 | bean\|gb167\|CV538336 | bean | 1748 | 203 | soybean\|gb162\|SOYHPR | 80.83 | tblastn |
| 685 | bean\|gb167\|PVU72768 | bean | 1749 | 203 | soybean\|gb162\|SOYHPR | 85.8 | blastp |
| 686 | clover\|gb162\|BB932705 | clover | 1750 | 203 | soybean\|gb162\|SOYHPR | 83.3 | blastp |
| 687 | cowpea\|gb166\|FC457443 | cowpea | 1751 | 203 | soybean\|gb162\|SOYHPR | 87.92 | tblastn |
| 688 | medicago\|gb157.2\|AL366760 | medicago | 1752 | 203 | soybean\|gb162\|SOYHPR | 84.7 | blastp |
| 689 | medicago\|gb157.2\|AW328889 | medicago | 1753 | 203 | soybean\|gb162\|SOYHPR | 80.52 | tblastn |
| 690 | medicago\|gb157.2\|AW329415 | medicago | 1754 | 203 | soybean\|gb162\|SOYHPR | 83.67 | tblastn |
| 691 | medicago\|gb157.2\|AW329734 | medicago | 1755 | 203 | soybean\|gb162\|SOYHPR | 85.11 | tblastn |
| 692 | soybean\|gb168\|S44202 | soybean | 1756 | 203 | soybean\|gb162\|SOYHPR | 95.7 | blastp |
| 693 | b_rapa\|gb162\|CV544929 | b_rapa | 1757 | 266 | arabidopsis\|gb157.2\| AT1G44920 | 80.38 | tblastn |
| 693 | b_rapa\|gb162\|CV544929 | b_rapa | 1757 | 204 | arabidopsis\|gb165\| AT1G44920 | 80.15 | tblastn |
| 694 | radish\|gb164\|EV525414 | radish | 1758 | 266 | arabidopsis\|gb157.2\| AT1G44920 | 81.3 | blastp |
| 694 | radish\|gb164\|EV525414 | radish | 1758 | 204 | arabidopsis\|gb165\| AT1G44920 | 80.7 | blastp |
| 695 | thellungiella\|gb167\|DN777579 | thellungiella | 1759 | 266 | arabidopsis\|gb157.2\| AT1G44920 | 81.7 | blastp |
| 695 | thellungiella\|gb167\|DN777579 | thellungiella | 1759 | 204 | arabidopsis\|gb165\| AT1G44920 | 81.1 | blastp |
| 696 | arabidopsis\|gb165\|AT3G17410 | arabidopsis | 1760 | 205 | arabidopsis\|gb157.2\| AT1G48210 | 87.1 | blastp |
| 697 | b_oleracea\|gb161\|AM385784 | b_oleracea | 1761 | 205 | arabidopsis\|gb157.2\| AT1G48210 | 87.4 | blastp |
| 698 | b_rapa\|gb162\|DN962030 | b_rapa | 1762 | 205 | arabidopsis\|gb157.2\| AT1G48210 | 83.52 | tblastn |
| 699 | b_rapa\|gb162\|EX020680 | b_rapa | 1763 | 205 | arabidopsis\|gb157.2\| AT1G48210 | 85.4 | blastp |
| 700 | b_rapa\|gb162\|EX025892 | b_rapa | 1764 | 205 | arabidopsis\|gb157.2\| AT1G48210 | 85.99 | tblastn |
| 701 | canola\|gb161\|CX278279 | canola | 1765 | 205 | arabidopsis\|gb157.2\| AT1G48210 | 86.3 | blastp |
| 702 | canola\|gb161\|EG021170 | canola | 1766 | 205 | arabidopsis\|gb157.2\| AT1G48210 | 83.79 | tblastn |
| 703 | radish\|gb164\|EV525080 | radish | 1767 | 205 | arabidopsis\|gb157.2\| AT1G48210 | 87.6 | blastp |
| 704 | radish\|gb164\|EV543636 | radish | 1768 | 205 | arabidopsis\|gb157.2\| AT1G48210 | 85.4 | blastp |
| 705 | radish\|gb164\|EY895533 | radish | 1769 | 205 | arabidopsis\|gb157.2\| AT1G48210 | 84.7 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 706 | thellungiella\|gb167\|DN774052 | thellungiella | 1770 | 205 | arabidopsis\|gb157.2\|AT1G48210 | 87.4 | blastp |
| 707 | wheat\|gb164\|AL822688 | wheat | 1771 | 206 | wheat\|gb164\|BE445396 | 92.9 | blastp |
| 708 | wheat\|gb164\|CD869154 | wheat | 1772 | 206 | wheat\|gb164\|BE445396 | 92.9 | blastp |
| 709 | banana\|gb167\|ES432415 | banana | 1773 | 208 | rice\|gb157.2\|AU077950 | 85.3 | blastp |
| 710 | barley\|gb157.3\|BI948762 | barley | 1774 | 208 | rice\|gb157.2\|AU077950 | 81.5 | blastp |
| 711 | barley\|gb157.3\|BJ453298 | barley | 1775 | 208 | rice\|gb157.2\|AU077950 | 94.2 | blastp |
| 712 | citrus\|gb166\|CF419725 | citrus | 1776 | 208 | rice\|gb157.2\|AU077950 | 80.8 | blastp |
| 713 | cotton\|gb164\|BF277609 | cotton | 1777 | 208 | rice\|gb157.2\|AU077950 | 81.5 | blastp |
| 714 | fescue\|gb161\|CK801460 | fescue | 1778 | 208 | rice\|gb157.2\|AU077950 | 91.1 | blastp |
| 715 | maize\|gb170\|AI619081 | maize | 1779 | 208 | rice\|gb157.2\|AU077950 | 97.7 | blastp |
| 716 | maize\|gb170\|AW216176 | maize | 1780 | 208 | rice\|gb157.2\|AU077950 | 87.8 | blastp |
| 717 | maize\|gb170\|BG841543 | maize | 1781 | 208 | rice\|gb157.2\|AU077950 | 97.7 | blastp |
| 718 | maize\|gb170\|H89383 | maize | 1782 | 208 | rice\|gb157.2\|AU077950 | 86.9 | blastp |
| 719 | onion\|gb162\|CF447150 | onion | 1783 | 208 | rice\|gb157.2\|AU077950 | 80 | blastp |
| 720 | pseudoroegneria\|gb167\|FF343595 | pseudoroegneria | 1784 | 208 | rice\|gb157.2\|AU077950 | 94.2 | blastp |
| 721 | rice\|gb170\|OS05G36110 | rice | 1785 | 208 | rice\|gb157.2\|AU077950 | 86.2 | blastp |
| 722 | sorghum\|gb161.crp\|AI783327 | sorghum | 1786 | 208 | rice\|gb157.2\|AU077950 | 96.5 | blastp |
| 723 | sorghum\|gb161.crp\|H89383 | sorghum | 1787 | 208 | rice\|gb157.2\|AU077950 | 87.9 | blastp |
| 724 | sugarcane\|gb157.3\|BQ479039 | sugarcane | 1788 | 208 | rice\|gb157.2\|AU077950 | 98.1 | blastp |
| 725 | switchgrass\|gb167\|DN144476 | switchgrass | 1789 | 208 | rice\|gb157.2\|AU077950 | 96.9 | blastp |
| 726 | switchgrass\|gb167\|FE642599 | switchgrass | 1790 | 208 | rice\|gb157.2\|AU077950 | 87.5 | blastp |
| 727 | wheat\|gb164\|BG909438 | wheat | 1791 | 208 | rice\|gb157.2\|AU077950 | 93.4 | blastp |
| 728 | wheat\|gb164\|CA497850 | wheat | 1792 | 208 | rice\|gb157.2\|AU077950 | 81.9 | blastp |
| 729 | wheat\|gb164\|CA658427 | wheat | 1793 | 208 | rice\|gb157.2\|AU077950 | 94.2 | blastp |
| 730 | cenchrus\|gb166\|EB654920 | cenchrus | 1794 | 209 | sorghum\|gb161.xeno\|AI901439 | 82.2 | blastp |
| 731 | maize\|gb170\|AI855209 | maize | 1795 | 209 | sorghum\|gb161.xeno\|AI901439 | 89.4 | blastp |
| 732 | sugarcane\|gb157.3\|BU102825 | sugarcane | 1796 | 209 | sorghum\|gb161.xeno\|AI901439 | 96.2 | blastp |
| 733 | switchgrass\|gb167\|DN146789 | switchgrass | 1797 | 209 | sorghum\|gb161.xeno\|AI901439 | 81.2 | blastp |
| 734 | maize\|gb170\|AI944302 | maize | 1798 | 210 | sorghum\|gb161.xeno\|AW052978 | 93.5 | blastp |
| 735 | sugarcane\|gb157.3\|BQ534346 | sugarcane | 1799 | 210 | sorghum\|gb161.xeno\|AW052978 | 93.5 | blastp |
| 736 | switchgrass\|gb167\|FL722616 | switchgrass | 1800 | 210 | sorghum\|gb161.xeno\|AW052978 | 86.1 | blastp |
| 737 | barley\|gb157.3\|BE413281 | barley | 1801 | 211 | sorghum\|gb161.xeno\|AW055409 | 88.3 | blastp |
| 738 | leymus\|gb166\|EG382167 | leymus | 1802 | 211 | sorghum\|gb161.xeno\|AW055409 | 88.5 | blastp |
| 739 | maize\|gb170\|AI855325 | maize | 1803 | 211 | sorghum\|gb161.xeno\|AW055409 | 93.5 | blastp |
| 740 | rice\|gb170\|OS01G09010 | rice | 1804 | 211 | sorghum\|gb161.xeno\|AW055409 | 88.8 | blastp |
| 741 | switchgrass\|gb167\|DN145994 | switchgrass | 1805 | 211 | sorghum\|gb161.xeno\|AW055409 | 93 | blastp |
| 742 | wheat\|gb164\|BE414789 | wheat | 1806 | 211 | sorghum\|gb161.xeno\|AW055409 | 88.5 | blastp |
| 743 | barley\|gb157.3\|BE437905 | barley | 1807 | 212 | sorghum\|gb161.xeno\|AI372194 | 82.43 | tblastn |
| 744 | brachypodium\|gb169\|BE437905 | brachypodium | 1808 | 212 | sorghum\|gb161.xeno\|AI372194 | 80.2 | blastp |
| 745 | leymus\|gb166\|EG394243 | leymus | 1809 | 212 | sorghum\|gb161.xeno\|AI372194 | 80.4 | blastp |
| 746 | maize\|gb170\|BG320821 | maize | 1810 | 212 | sorghum\|gb161.xeno\|AI372194 | 94.5 | blastp |
| 747 | maize\|gb170\|LLT23330 | maize | 1811 | 212 | sorghum\|gb161.xeno\|AI372194 | 96.2 | blastp |
| 748 | rice\|gb170\|OS08G45240 | rice | 1812 | 212 | sorghum\|gb161.xeno\|AI372194 | 82.2 | blastp |
| 749 | sugarcane\|gb157.3\|CA073529 | sugarcane | 1813 | 212 | sorghum\|gb161.xeno\|AI372194 | 97.9 | blastp |
| 750 | switchgrass\|gb167\|DN145055 | switchgrass | 1814 | 212 | sorghum\|gb161.xeno\|AI372194 | 94.9 | blastp |
| 751 | wheat\|gb164\|BE404004 | wheat | 1815 | 212 | sorghum\|gb161.xeno\|AI372194 | 81.59 | tblastn |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 752 | maize\|gb170\|AI939746 | maize | 1816 | 213 | rice\|gb157.2\|BI805136 | 80 | blastp |
| 753 | rice\|gb170\|OS08G44840 | rice | 1817 | 213 | rice\|gb157.2\|BI805136 | 99.8 | blastp |
| 754 | wheat\|gb164\|BE400051 | wheat | 1818 | 213 | rice\|gb157.2\|BI805136 | 80.54 | tblastn |
| 755 | barley\|gb157.3\|AL506838 | barley | 1819 | 214 | maize\|gb164\|AW054475 | 86.9 | blastp |
| 756 | brachypodium\|gb169\|BE406703 | brachypodium | 1820 | 214 | maize\|gb164\|AW054475 | 90.9 | blastp |
| 757 | rice\|gb170\|OS01G13730 | rice | 1821 | 214 | maize\|gb164\|AW054475 | 92.7 | blastp |
| 758 | sorghum\|gb161.crp\|AI739896 | sorghum | 1822 | 214 | maize\|gb164\|AW054475 | 97.8 | blastp |
| 759 | sugarcane\|gb157.3\|BQ479038 | sugarcane | 1823 | 214 | maize\|gb164\|AW054475 | 97.8 | blastp |
| 760 | switchgrass\|gb167\|FE622691 | switchgrass | 1824 | 214 | maize\|gb164\|AW054475 | 95.1 | blastp |
| 761 | wheat\|gb164\|BE406703 | wheat | 1825 | 214 | maize\|gb164\|AW054475 | 86.7 | blastp |
| 762 | apple\|gb157.3\|AU301405 | apple | 1826 | 215 | soybean\|gb166\|AW350050 | 93.1 | blastp |
| 763 | arabidopsis\|gb165\|AT2G27600 | arabidopsis | 1827 | 215 | soybean\|gb166\|AW350050 | 91 | blastp |
| 764 | b_rapa\|gb162\|CV546524 | b_rapa | 1828 | 215 | soybean\|gb166\|AW350050 | 90.6 | blastp |
| 765 | b_rapa\|gb162\|EX019335 | b_rapa | 1829 | 215 | soybean\|gb166\|AW350050 | 89.9 | blastp |
| 766 | barley\|gb157.3\|BE438944 | barley | 1830 | 215 | soybean\|gb166\|AW350050 | 87.5 | blastp |
| 767 | basilicum\|gb157.3\|DY330212 | basilicum | 1831 | 215 | soybean\|gb166\|AW350050 | 88 | blastp |
| 768 | bean\|gb167\|CA896847 | bean | 1832 | 215 | soybean\|gb166\|AW350050 | 98.4 | blastp |
| 769 | brachypodium\|gb169\|BE405668 | brachypodium | 1833 | 215 | soybean\|gb166\|AW350050 | 87.9 | blastp |
| 770 | cacao\|gb167\|CA794307 | cacao | 1834 | 215 | soybean\|gb166\|AW350050 | 93.1 | blastp |
| 771 | canola\|gb161\|CD814779 | canola | 1835 | 215 | soybean\|gb166\|AW350050 | 88.7 | blastp |
| 772 | canola\|gb161\|DY024749 | canola | 1836 | 215 | soybean\|gb166\|AW350050 | 90.8 | blastp |
| 773 | castorbean\|gb160\|EG661556 | castorbean | 1837 | 215 | soybean\|gb166\|AW350050 | 93.1 | blastp |
| 774 | chestnut\|gb170\|SRR006295S0002595 | chestnut | 1838 | 215 | soybean\|gb166\|AW350050 | 92.9 | blastp |
| 775 | citrus\|gb166\|CF830344 | citrus | 1839 | 215 | soybean\|gb166\|AW350050 | 93.8 | blastp |
| 776 | cotton\|gb164\|AI726326 | cotton | 1840 | 215 | soybean\|gb166\|AW350050 | 94 | blastp |
| 777 | cotton\|gb164\|AI729650 | cotton | 1841 | 215 | soybean\|gb166\|AW350050 | 91.5 | blastp |
| 778 | cotton\|gb164\|AI731487 | cotton | 1842 | 215 | soybean\|gb166\|AW350050 | 89.5 | blastp |
| 779 | cotton\|gb164\|AI731657 | cotton | 1843 | 215 | soybean\|gb166\|AW350050 | 92.2 | blastp |
| 780 | cowpea\|gb166\|FF395986 | cowpea | 1844 | 215 | soybean\|gb166\|AW350050 | 94.2 | blastp |
| 781 | iceplant\|gb164\|AF165422 | iceplant | 1845 | 215 | soybean\|gb166\|AW350050 | 91.3 | blastp |
| 782 | lettuce\|gb157.2\|DW049083 | lettuce | 1846 | 215 | soybean\|gb166\|AW350050 | 90.8 | blastp |
| 783 | lettuce\|gb157.2\|DW059917 | lettuce | 1847 | 215 | soybean\|gb166\|AW350050 | 83.9 | blastp |
| 784 | maize\|gb170\|AI615072 | maize | 1848 | 215 | soybean\|gb166\|AW350050 | 89.9 | blastp |
| 785 | maize\|gb170\|AI714627 | maize | 1849 | 215 | soybean\|gb166\|AW350050 | 89.7 | blastp |
| 786 | medicago\|gb157.2\|AW329426 | medicago | 1850 | 215 | soybean\|gb166\|AW350050 | 91.94 | tblastn |
| 787 | pine\|gb157.2\|AL751019 | pine | 1851 | 215 | soybean\|gb166\|AW350050 | 88.2 | blastp |
| 788 | pine\|gb157.2\|BE643751 | pine | 1852 | 215 | soybean\|gb166\|AW350050 | 86.8 | blastp |
| 789 | poplar\|gb170\|AI166646 | poplar | 1853 | 215 | soybean\|gb166\|AW350050 | 91.7 | blastp |
| 790 | poplar\|gb170\|BI069748 | poplar | 1854 | 215 | soybean\|gb166\|AW350050 | 90.8 | blastp |
| 791 | poplar\|gb170\|BI070062 | poplar | 1855 | 215 | soybean\|gb166\|AW350050 | 81.7 | blastp |
| 792 | poplar\|gb170\|CN549423 | poplar | 1856 | 215 | soybean\|gb166\|AW350050 | 81.6 | blastp |
| 793 | potato\|gb157.2\|BG096555 | potato | 1857 | 215 | soybean\|gb166\|AW350050 | 87.4 | blastp |
| 794 | potato\|gb157.2\|BI177056 | potato | 1858 | 215 | soybean\|gb166\|AW350050 | 90.8 | blastp |
| 795 | rice\|gb170\|OS01G04814 | rice | 1859 | 215 | soybean\|gb166\|AW350050 | 90.8 | blastp |
| 796 | sorghum\|gb161.crp\|BE366383 | sorghum | 1860 | 215 | soybean\|gb166\|AW350050 | 90.6 | blastp |
| 797 | soybean\|gb168\|AW329426 | soybean | 1861 | 215 | soybean\|gb166\|AW350050 | 94 | blastp |
| 798 | soybean\|gb168\|AW719488 | soybean | 1862 | 215 | soybean\|gb166\|AW350050 | 94 | blastp |
| 799 | soybean\|gb168\|AW719867 | soybean | 1863 | 215 | soybean\|gb166\|AW350050 | 97.5 | blastp |
| 800 | spikemoss\|gb165\|FE429017 | spikemoss | 1864 | 215 | soybean\|gb166\|AW350050 | 85.3 | blastp |
| 801 | spruce\|gb162\|CO217587 | spruce | 1865 | 215 | soybean\|gb166\|AW350050 | 88.2 | blastp |
| 802 | strawberry\|gb164\|CO816822 | strawberry | 1866 | 215 | soybean\|gb166\|AW350050 | 92.4 | blastp |
| 803 | sugarcane\|gb157.3\|BQ533539 | sugarcane | 1867 | 215 | soybean\|gb166\|AW350050 | 90.6 | blastp |
| 804 | sunflower\|gb162\|CD849902 | sunflower | 1868 | 215 | soybean\|gb166\|AW350050 | 90.57 | tblastn |
| 805 | sunflower\|gb162\|DY927633 | sunflower | 1869 | 215 | soybean\|gb166\|AW350050 | 82.3 | blastp |
| 806 | switchgrass\|gb167\|DN142133 | switchgrass | 1870 | 215 | soybean\|gb166\|AW350050 | 90.3 | blastp |
| 807 | tomato\|gb164\|AI637361 | tomato | 1871 | 215 | soybean\|gb166\|AW350050 | 90.6 | blastp |
| 808 | tomato\|gb164\|BE459090 | tomato | 1872 | 215 | soybean\|gb166\|AW350050 | 87.2 | blastp |
| 809 | triphysaria\|gb164\|DR175699 | triphysaria | 1873 | 215 | soybean\|gb166\|AW350050 | 90.3 | blastp |
| 810 | wheat\|gb164\|BE405903 | wheat | 1874 | 215 | soybean\|gb166\|AW350050 | 87.9 | blastp |
| 811 | maize\|gb170\|BG316566 | maize | 1875 | 267 | sorghum\|gb161.xeno\|BE599042 | 98.87 | tblastn |
| 811 | maize\|gb170\|BG316566 | maize | 1875 | 216 | sorghum\|gb161.crp\|BE599042 | 96.8 | blastp |
| 812 | rice\|gb170\|OS11G10420 | rice | 1876 | 267 | sorghum\|gb161.xeno\|BE599042 | 93.57 | tblastn |
| 812 | rice\|gb170\|OS11G10420 | rice | 1876 | 216 | sorghum\|gb161.crp\|BE599042 | 88 | blastp |
| 813 | aquilegia\|gb157.3\|DR921243 | aquilegia | 1877 | 217 | maize\|gb164\|BQ279657 | 80.7 | blastp |
| 814 | avocado\|gb164\|CK766314 | avocado | 1878 | 217 | maize\|gb164\|BQ279657 | 80.5 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 815 | brachypodium\|gb169\|BE492967 | brachypodium | 1879 | 217 | maize\|gb164\|BQ279657 | 85.7 | blastp |
| 815 | brachypodium\|gb169\|BE492967 | brachypodium | 1879 | 227 | sorghum\|gb161.xeno\|BQ279657 | 84.7 | blastp |
| 816 | castorbean\|gb160\|EE255906 | castorbean | 1880 | 217 | maize\|gb164\|BQ279657 | 81.3 | blastp |
| 816 | castorbean\|gb160\|EE255906 | castorbean | 1880 | 227 | sorghum\|gb161.xeno\|BQ279657 | 81 | blastp |
| 817 | centaurea\|gb166\|EH728846 | centaurea | 1881 | 217 | maize\|gb164\|BQ279657 | 80.08 | tblastn |
| 818 | chestnut\|gb170\|SRR006295S0011600 | chestnut | 1882 | 217 | maize\|gb164\|BQ279657 | 81.3 | blastp |
| 818 | chestnut\|gb170\|SRR006295S0011600 | chestnut | 1882 | 227 | sorghum\|gb161.xeno\|BQ279657 | 80.6 | blastp |
| 819 | citrus\|gb166\|CB305147 | citrus | 1883 | 227 | sorghum\|gb161.xeno\|BQ279657 | 81.4 | blastp |
| 819 | citrus\|gb166\|CB305147 | citrus | 1883 | 217 | maize\|gb164\|BQ279657 | 81.3 | blastp |
| 820 | cotton\|gb164\|CO121350 | cotton | 1884 | 217 | maize\|gb164\|BQ279657 | 82.4 | tblastn |
| 820 | cotton\|gb164\|CO121350 | cotton | 1884 | 227 | sorghum\|gb161.xeno\|BQ279657 | 81.41 | tblastn |
| 821 | kiwi\|gb166\|FG403767 | kiwi | 1885 | 217 | maize\|gb164\|BQ279657 | 80.5 | blastp |
| 822 | leymus\|gb166\|EG376319 | leymus | 1886 | 217 | maize\|gb164\|BQ279657 | 90.3 | blastp |
| 822 | leymus\|gb166\|EG376319 | leymus | 1886 | 227 | sorghum\|gb161.xeno\|BQ279657 | 89.6 | blastp |
| 823 | papaya\|gb165\|EX229221 | papaya | 1887 | 217 | maize\|gb164\|BQ279657 | 81.3 | blastp |
| 823 | papaya\|gb165\|EX229221 | papaya | 1887 | 227 | sorghum\|gb161.xeno\|BQ279657 | 81 | blastp |
| 824 | potato\|gb157.2\|BE341318 | potato | 1888 | 217 | maize\|gb164\|BQ279657 | 81.3 | blastp |
| 824 | potato\|gb157.2\|BE341318 | potato | 1888 | 227 | sorghum\|gb161.xeno\|BQ279657 | 81.3 | blastp |
| 825 | pseudoroegneria\|gb167\|FF342296 | pseudoroegneria | 1889 | 217 | maize\|gb164\|BQ279657 | 89.9 | blastp |
| 825 | pseudoroegneria\|gb167\|FF342296 | pseudoroegneria | 1889 | 227 | sorghum\|gb161.xeno\|BQ279657 | 89.2 | blastp |
| 826 | rice\|gb170\|OS03G21914 | rice | 1890 | 217 | maize\|gb164\|BQ279657 | 90.6 | blastp |
| 826 | rice\|gb170\|OS03G21914 | rice | 1890 | 227 | sorghum\|gb161.xeno\|BQ279657 | 89.9 | blastp |
| 827 | rice\|gb170\|OS03G50620 | rice | 1891 | 217 | maize\|gb164\|BQ279657 | 88.2 | blastp |
| 827 | rice\|gb170\|OS03G50620 | rice | 1891 | 227 | sorghum\|gb161.xeno\|BQ279657 | 87.2 | blastp |
| 828 | sugarcane\|gb157.3\|BQ536934 | sugarcane | 1892 | 227 | sorghum\|gb161.xeno\|BQ279657 | 99.3 | blastp |
| 828 | sugarcane\|gb157.3\|BQ536934 | sugarcane | 1892 | 217 | maize\|gb164\|BQ279657 | 98.1 | blastp |
| 829 | sugarcane\|gb157.3\|CA096803 | sugarcane | 1893 | 227 | sorghum\|gb161.xeno\|BQ279657 | 98.9 | blastp |
| 829 | sugarcane\|gb157.3\|CA096803 | sugarcane | 1893 | 217 | maize\|gb164\|BQ279657 | 97.8 | blastp |
| 830 | sunflower\|gb162\|BU018368 | sunflower | 1894 | 217 | maize\|gb164\|BQ279657 | 80.2 | blastp |
| 831 | switchgrass\|gb167\|FL773351 | switchgrass | 1895 | 227 | sorghum\|gb161.xeno\|BQ279657 | 94.8 | blastp |
| 831 | switchgrass\|gb167\|FL773351 | switchgrass | 1895 | 217 | maize\|gb164\|BQ279657 | 94 | blastp |
| 832 | tobacco\|gb162\|DV158876 | tobacco | 1896 | 217 | maize\|gb164\|BQ279657 | 80.9 | blastp |
| 832 | tobacco\|gb162\|DV158876 | tobacco | 1896 | 227 | sorghum\|gb161.xeno\|BQ279657 | 80.2 | blastp |
| 833 | tomato\|gb164\|BG124565 | tomato | 1897 | 217 | maize\|gb164\|BQ279657 | 80.9 | blastp |
| 833 | tomato\|gb164\|BG124565 | tomato | 1897 | 227 | sorghum\|gb161.xeno\|BQ279657 | 80.6 | blastp |
| 834 | wheat\|gb164\|BE492967 | wheat | 1898 | 217 | maize\|gb164\|BQ279657 | 89.9 | blastp |
| 834 | wheat\|gb164\|BE492967 | wheat | 1898 | 227 | sorghum\|gb161.xeno\|BQ279657 | 89.2 | blastp |
| 835 | wheat\|gb164\|BQ168983 | wheat | 1899 | 217 | maize\|gb164\|BQ279657 | 90.3 | blastp |
| 835 | wheat\|gb164\|BQ168983 | wheat | 1899 | 227 | sorghum\|gb161.xeno\|BQ279657 | 89.6 | blastp |
| 836 | fescue\|gb161\|CK801026 | fescue | 1900 | 218 | barley\|gb157.2\|AJ234408 | 87 | blastp |
| 837 | pseudoroegneria\|gb167\|FF340368 | pseudoroegneria | 1901 | 218 | barley\|gb157.2\|AJ234408 | 92.1 | blastp |
| 838 | rice\|gb170\|OS07G05360 | rice | 1902 | 218 | barley\|gb157.2\|AJ234408 | 81.2 | blastp |
| 839 | wheat\|gb164\|BE213379 | wheat | 1903 | 218 | barley\|gb157.2\|AJ234408 | 92.1 | blastp |
| 840 | wheat\|gb164\|BE401132 | wheat | 1904 | 218 | barley\|gb157.2\|AJ234408 | 90 | blastp |
| 841 | wheat\|gb164\|BE401288 | wheat | 1905 | 218 | barley\|gb157.2\|AJ234408 | 90.7 | blastp |
| 842 | wheat\|gb164\|CA654680 | wheat | 1906 | 218 | barley\|gb157.2\|AJ234408 | 84.89 | tblastn |
| 843 | wheat\|gb164\|CA695915 | wheat | 1907 | 218 | barley\|gb157.2\|AJ234408 | 88.49 | tblastn |
| 844 | maize\|gb170\|AW433364 | maize | 1908 | 219 | sorghum\|gb161.xeno\|AW923729 | 87.9 | blastp |
| 845 | sorghum\|gb161.crp\|AW922411 | sorghum | 1909 | 219 | sorghum\|gb161.xeno\|AW923729 | 81.1 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 846 | sugarcane\|gb157.3\|CA068925 A068925 | sugarcane | 1910 | 219 | sorghum\|gb161.xeno\| AW923729 | 91.1 | blastp |
| 847 | switchgrass\|gb167\|DN144528 | switchgrass | 1911 | 219 | sorghum\|gb161.xeno\| AW923729 | 86.8 | blastp |
| 848 | switchgrass\|gb167\|DN144587 | switchgrass | 1912 | 219 | sorghum\|gb161.xeno\| AW923729 | 85.8 | blastp |
| 849 | switchgrass\|gb167\|FL758275 | switchgrass | 1913 | 219 | sorghum\|gb161.xeno\| AW923729 | 80.1 | blastp |
| 850 | castorbean\|gb160\|MDL29813M001539 | castorbean | 1914 | 221 | arabidopsis\|gb157.2\| AT1G13980 | 83.3 | blastp |
| 851 | poplar\|gb170\|IBU886496 | poplar | 1915 | 221 | arabidopsis\|gb157.2\| AT1G13980 | 82 | blastp |
| 852 | soybean\|gb168\|BM308552 | soybean | 1916 | 221 | arabidopsis\|gb157.2\| AT1G13980 | 81.2 | blastp |
| 853 | maize\|gb170\|BM072861 | maize | 1917 | 226 | sorghum\|gb161.xeno\| BI139559 | 95.5 | blastp |
| 854 | rice\|gb170\|OS01G07200 | rice | 1918 | 226 | sorghum\|gb161.xeno\| BI139559 | 83.5 | blastp |
| 855 | sugarcane\|gb157.3\|CA112539 | sugarcane | 1919 | 226 | sorghum\|gb161.xeno\| BI139559 | 88.25 | tblastn |
| 856 | barley\|gb157.3\|BE412997 | barley | 1920 | 228 | sorghum\|gb161.xeno\| AF019147 | 84.1 | blastp |
| 857 | brachypodium\|gb169\| BE403874 | brachypodium | 1921 | 228 | sorghum\|gb161.xeno\| AF019147 | 83 | blastp |
| 858 | fescue\|gb161\|DT680716 | fescue | 1922 | 228 | sorghum\|gb161.xeno\| AF019147 | 81 | blastp |
| 859 | leymus\|gb166\|CN466335 | leymus | 1923 | 228 | sorghum\|gb161.xeno\| AF019147 | 83.4 | blastp |
| 860 | maize\|gb170\|AF019147 | maize | 1924 | 228 | sorghum\|gb161.xeno\| AF019147 | 91.7 | blastp |
| 861 | maize\|gb170\|AI948311 | maize | 1925 | 228 | sorghum\|gb161.xeno\| AF019147 | 90 | blastp |
| 862 | rice\|gb170\|OS04G55650 | rice | 1926 | 228 | sorghum\|gb161.xeno\| AF019147 | 85.2 | blastp |
| 863 | sugarcane\|gb157.3\|BQ536348 | sugarcane | 1927 | 228 | sorghum\|gb161.xeno\| AF019147 | 97.9 | blastp |
| 864 | switchgrass\|gb167\|DN140659 | switchgrass | 1928 | 228 | sorghum\|gb161.xeno\| AF019147 | 91.8 | blastp |
| 865 | switchgrass\|gb167\|DN141292 | switchgrass | 1929 | 228 | sorghum\|gb161.xeno\| AF019147 | 90.8 | blastp |
| 866 | wheat\|gb164\|BE403874 | wheat | 1930 | 228 | sorghum\|gb161.xeno\| AF019147 | 83.9 | blastp |
| 867 | wheat\|gb164\|BE405077 | wheat | 1931 | 228 | sorghum\|gb161.xeno\| AF019147 | 84.5 | blastp |
| 868 | b_rapa\|gb162\|EX027120 | b_rapa | 1932 | 229 | canola\|gb161\|EE559843 | 94.1 | blastp |
| 869 | brachypodium\|gb169\| BF202681 | brachypodium | 1933 | 230 | barley\|gb157.3\|BE420701 | 90.9 | blastp |
| 870 | maize\|gb170\|LLAI629913 | maize | 1934 | 230 | barley\|gb157.3\|BE420701 | 87 | blastp |
| 871 | pseudoroegneria\|gb167\| FF340034 | pseudoroegneria | 1935 | 230 | barley\|gb157.3\|BE420701 | 96.8 | blastp |
| 872 | rice\|gb170\|OS07G44660 | rice | 1936 | 230 | barley\|gb157.3\|BE420701 | 88.6 | blastp |
| 873 | sorghum\|gb161.crp\| AW282627 | sorghum | 1937 | 230 | barley\|gb157.3\|BE420701 | 88.3 | blastp |
| 874 | switchgrass\|gb167\|FE609054 | switchgrass | 1938 | 230 | barley\|gb157.3\|BE420701 | 88.1 | blastp |
| 875 | brachypodium\|gb169\| BE421829 | brachypodium | 1939 | 231 | barley\|gb157.3\|BE420701 | 90.2 | blastp |
| 875 | brachypodium\|gb169\| BE421829 | brachypodium | 1939 | 235 | rice\|gb157.2\|AU057884 | 82.6 | blastp |
| 875 | brachypodium\|gb169\| BE421829 | brachypodium | 1939 | 261 | sorghum\|gb161.xeno\| AI622209 | 81.1 | blastp |
| 876 | fescue\|gb161\|DT679850 | fescue | 1940 | 231 | barley\|gb157.3\|BE421829 | 95.3 | blastp |
| 876 | fescue\|gb161\|DT679850 | fescue | 1940 | 235 | rice\|gb157.2\|AU057884 | 84.1 | blastp |
| 876 | fescue\|gb161\|DT679850 | fescue | 1940 | 261 | sorghum\|gb161.xeno\| AI622209 | 81.6 | blastp |
| 877 | leymus\|gb166\|EG396605 | leymus | 1941 | 231 | barley\|gb157.3\|BE421829 | 96.3 | blastp |
| 877 | leymus\|gb166\|EG396605 | leymus | 1941 | 235 | rice\|gb157.2\|AU057884 | 83.6 | blastp |
| 877 | leymus\|gb166\|EG396605 | leymus | 1941 | 261 | sorghum\|gb161.xeno\| AI622209 | 83.1 | blastp |
| 878 | maize\|gb170\|AI622209 | maize | 1942 | 261 | sorghum\|gb161.xeno\| AI622209 | 94 | blastp |
| 878 | maize\|gb170\|AI622209 | maize | 1942 | 235 | rice\|gb157.2\|AU057884 | 82.9 | blastp |
| 878 | maize\|gb170\|AI622209 | maize | 1942 | 231 | barley\|gb157.3\|BE421829 | 81.8 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algo-rithm |
|---|---|---|---|---|---|---|---|
| 879 | sugarcane\|gb157.3\|CA123704 | sugarcane | 1943 | 261 | sorghum\|gb161.xeno\|AI622209 | 93.5 | blastp |
| 879 | sugarcane\|gb157.3\|CA123704 | sugarcane | 1943 | 231 | barley\|gb157.3\|BE421829 | 86.5 | blastp |
| 879 | sugarcane\|gb157.3\|CA123704 | sugarcane | 1943 | 235 | rice\|gb157.2\|AU057884 | 84.6 | blastp |
| 880 | switchgrass\|gb167\|FE619680 | switchgrass | 1944 | 261 | sorghum\|gb161.xeno\|AI622209 | 91 | blastp |
| 880 | switchgrass\|gb167\|FE619680 | switchgrass | 1944 | 235 | rice\|gb157.2\|AU057884 | 85.4 | blastp |
| 880 | switchgrass\|gb167\|FE619680 | switchgrass | 1944 | 231 | barley\|gb157.3\|BE421829 | 82.7 | blastp |
| 881 | switchgrass\|gb167\|FE630609 | switchgrass | 1945 | 261 | sorghum\|gb161.xeno\|AI622209 | 89.6 | blastp |
| 881 | switchgrass\|gb167\|FE630609 | switchgrass | 1945 | 235 | rice\|gb157.2\|AU057884 | 84 | blastp |
| 881 | switchgrass\|gb167\|FE630609 | switchgrass | 1945 | 231 | barley\|gb157.3\|BE421829 | 81.9 | blastp |
| 882 | wheat\|gb164\|BE497607 | wheat | 1946 | 231 | barley\|gb157.3\|BE421829 | 96.8 | blastp |
| 882 | wheat\|gb164\|BE497607 | wheat | 1946 | 235 | rice\|gb157.2\|AU057884 | 84.6 | blastp |
| 882 | wheat\|gb164\|BE497607 | wheat | 1946 | 261 | sorghum\|gb161.xeno\|AI622209 | 82.6 | blastp |
| 883 | wheat\|gb164\|BF428660 | wheat | 1947 | 231 | barley\|gb157.3\|BE421829 | 96.8 | blastp |
| 883 | wheat\|gb164\|BF428660 | wheat | 1947 | 235 | rice\|gb157.2\|AU057884 | 85.6 | blastp |
| 883 | wheat\|gb164\|BF428660 | wheat | 1947 | 261 | sorghum\|gb161.xeno\|AI622209 | 82.6 | blastp |
| 884 | barley\|gb157.3\|BE411922 | barley | 1948 | 232 | sorghum\|gb161.xeno\|AA011880 | 81 | blastp |
| 885 | brachypodium\|gb169\|BE398696 | brachypodium | 1949 | 232 | sorghum\|gb161.xeno\|AA011880 | 82.3 | blastp |
| 886 | cenchrus\|gb166\|EB652789 | cenchrus | 1950 | 232 | sorghum\|gb161.xeno\|AA011880 | 92.3 | blastp |
| 887 | cotton\|gb164\|DT574337 | cotton | 1951 | 232 | sorghum\|gb161.xeno\|AA011880 | 95.9 | blastp |
| 888 | leymus\|gb166\|CN465754 | leymus | 1952 | 232 | sorghum\|gb161.xeno\|AA011880 | 81.1 | blastp |
| 889 | maize\|gb170\|AA011880 | maize | 1953 | 232 | sorghum\|gb161.xeno\|AA011880 | 95.9 | blastp |
| 890 | maize\|gb170\|LLCD979368 | maize | 1954 | 232 | sorghum\|gb161.xeno\|AA011880 | 95.9 | blastp |
| 891 | pseudoroegneria\|gb167\|FF344484 | pseudoroegneria | 1955 | 232 | sorghum\|gb161.xeno\|AA011880 | 83.3 | blastp |
| 892 | rice\|gb170\|OS07G46750 | rice | 1956 | 232 | sorghum\|gb161.xeno\|AA011880 | 87.9 | blastp |
| 893 | sugarcane\|gb157.3\|BQ535840 | sugarcane | 1957 | 232 | sorghum\|gb161.xeno\|AA011880 | 97.3 | blastp |
| 894 | sugarcane\|gb157.3\|BQ536355 | sugarcane | 1958 | 232 | sorghum\|gb161.xeno\|AA011880 | 94 | blastp |
| 895 | sugarcane\|gb157.3\|CA065609 | sugarcane | 1959 | 232 | sorghum\|gb161.xeno\|AA011880 | 83.94 | tblastn |
| 896 | sugarcane\|gb157.3\|CA075754 | sugarcane | 1960 | 232 | sorghum\|gb161.xeno\|AA011880 | 93.3 | blastp |
| 897 | sugarcane\|gb157.3\|CA078921 | sugarcane | 1961 | 232 | sorghum\|gb161.xeno\|AA011880 | 98.6 | blastp |
| 898 | switchgrass\|gb167\|DN141728 | switchgrass | 1962 | 232 | sorghum\|gb161.xeno\|AA011880 | 91.5 | blastp |
| 899 | switchgrass\|gb167\|DN145078 | switchgrass | 1963 | 232 | sorghum\|gb161.xeno\|AA011880 | 92.4 | blastp |
| 900 | wheat\|gb164\|BE398306 | wheat | 1964 | 232 | sorghum\|gb161.xeno\|AA011880 | 82.8 | blastp |
| 901 | wheat\|gb164\|BE398696 | wheat | 1965 | 232 | sorghum\|gb161.xeno\|AA011880 | 81.4 | blastp |
| 902 | wheat\|gb164\|BE423010 | wheat | 1966 | 232 | sorghum\|gb161.xeno\|AA011880 | 82.8 | blastp |
| 903 | wheat\|gb164\|CA484184 | wheat | 1967 | 232 | sorghum\|gb161.xeno\|AA011880 | 97.7 | blastp |
| 904 | barley\|gb157.3\|BE413465 | barley | 1968 | 233 | rice\|gb157.2\|BE229552 | 87.4 | blastp |
| 905 | brachypodium\|gb169\|BE413465 | brachypodium | 1969 | 233 | rice\|gb157.2\|BE229552 | 86.5 | blastp |
| 906 | leymus\|gb166\|EG379179 | leymus | 1970 | 233 | rice\|gb157.2\|BE229552 | 87.1 | blastp |
| 907 | maize\|gb170\|T26952 | maize | 1971 | 233 | rice\|gb157.2\|BE229552 | 87.7 | blastp |
| 908 | sorghum\|gb161.crp\|BG549557 | sorghum | 1972 | 233 | rice\|gb157.2\|BE229552 | 87.7 | blastp |
| 909 | sugarcane\|gb157.3\|CA099583 | sugarcane | 1973 | 233 | rice\|gb157.2\|BE229552 | 88.3 | blastp |
| 910 | switchgrass\|gb167\|FE610789 | switchgrass | 1974 | 233 | rice\|gb157.2\|BE229552 | 85.6 | blastp |
| 911 | switchgrass\|gb167\|FL748149 | switchgrass | 1975 | 233 | rice\|gb157.2\|BE229552 | 88 | blastp |
| 912 | wheat\|gb164\|BE430330 | wheat | 1976 | 233 | rice\|gb157.2\|BE229552 | 86.83 | tblastn |
| 913 | wheat\|gb164\|BE490164 | wheat | 1977 | 233 | rice\|gb157.2\|BE229552 | 87.1 | blastp |
| 914 | wheat\|gb164\|BF201086 | wheat | 1978 | 233 | rice\|gb157.2\|BE229552 | 87.4 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 915 | amborella\|gb166\|CD484126 | amborella | 1979 | 234 | rice\|gb157.2\|BE039784 | 96 | blastp |
| 916 | amborella\|gb166\|CK760819 | amborella | 1980 | 234 | rice\|gb157.2\|BE039784 | 97.4 | blastp |
| 917 | antirrhinum\|gb166\|AJ558674 | antirrhinum | 1981 | 234 | rice\|gb157.2\|BE039784 | 89.4 | blastp |
| 918 | antirrhinum\|gb166\|AJ559850 | antirrhinum | 1982 | 234 | rice\|gb157.2\|BE039784 | 91.4 | blastp |
| 919 | antirrhinum\|gb166\|AJ787300 | antirrhinum | 1983 | 234 | rice\|gb157.2\|BE039784 | 91.4 | blastp |
| 920 | antirrhinum\|gb166\|AJ789533 | antirrhinum | 1984 | 234 | rice\|gb157.2\|BE039784 | 91.4 | blastp |
| 921 | apple\|gb157.3\|CN489349 | apple | 1985 | 234 | rice\|gb157.2\|BE039784 | 90.7 | blastp |
| 922 | apple\|gb157.3\|CN496576 | apple | 1986 | 234 | rice\|gb157.2\|BE039784 | 91.4 | blastp |
| 923 | apple\|gb157.3\|CN995013 | apple | 1987 | 234 | rice\|gb157.2\|BE039784 | 90.7 | blastp |
| 924 | apricot\|gb157.2\|CB819597 | apricot | 1988 | 234 | rice\|gb157.2\|BE039784 | 92.7 | blastp |
| 925 | apricot\|gb157.2\|CV044080 | apricot | 1989 | 234 | rice\|gb157.2\|BE039784 | 93.4 | blastp |
| 926 | aquilegia\|gb157.3\|DR915026 | aquilegia | 1990 | 234 | rice\|gb157.2\|BE039784 | 94.7 | blastp |
| 927 | arabidopsis\|gb165\|AT2G36160 | arabidopsis | 1991 | 234 | rice\|gb157.2\|BE039784 | 90.7 | blastp |
| 928 | arabidopsis\|gb165\|AT3G11510 | arabidopsis | 1992 | 234 | rice\|gb157.2\|BE039784 | 91.4 | blastp |
| 929 | arabidopsis\|gb165\|AT3G52580 | arabidopsis | 1993 | 234 | rice\|gb157.2\|BE039784 | 91.4 | blastp |
| 930 | artemisia\|gb164\|EY033322 | artemisia | 1994 | 234 | rice\|gb157.2\|BE039784 | 89.4 | blastp |
| 931 | artemisia\|gb164\|EY038655 | artemisia | 1995 | 234 | rice\|gb157.2\|BE039784 | 88.1 | blastp |
| 932 | artemisia\|gb164\|EY050701 | artemisia | 1996 | 234 | rice\|gb157.2\|BE039784 | 89.4 | blastp |
| 933 | avocado\|gb164\|CK753882 | avocado | 1997 | 234 | rice\|gb157.2\|BE039784 | 93.4 | blastp |
| 934 | b_juncea\|gb164\|EVGN00033609170815 | b_juncea | 1998 | 234 | rice\|gb157.2\|BE039784 | 92.7 | blastp |
| 935 | b_juncea\|gb164\|EVGN00191625522759 | b_juncea | 1999 | 234 | rice\|gb157.2\|BE039784 | 92.7 | blastp |
| 936 | b_juncea\|gb164\|EVGN00422623890637 | b_juncea | 2000 | 234 | rice\|gb157.2\|BE039784 | 84.8 | blastp |
| 937 | b_juncea\|gb164\|EVGN00544912222373 | b_juncea | 2001 | 234 | rice\|gb157.2\|BE039784 | 93.4 | blastp |
| 938 | b_juncea\|gb164\|EVGN00716011751939 | b_juncea | 2002 | 234 | rice\|gb157.2\|BE039784 | 92.1 | blastp |
| 939 | b_juncea\|gb164\|EVGN00888211982122 | b_juncea | 2003 | 234 | rice\|gb157.2\|BE039784 | 92.1 | blastp |
| 940 | b_juncea\|gb164\|EVGN01248609033239 | b_juncea | 2004 | 234 | rice\|gb157.2\|BE039784 | 92.7 | blastp |
| 941 | b_oleracea\|gb161\|DY026232 | b_oleracea | 2005 | 234 | rice\|gb157.2\|BE039784 | 93.4 | blastp |
| 942 | b_oleracea\|gb161\|DY026495 | b_oleracea | 2006 | 234 | rice\|gb157.2\|BE039784 | 92.7 | blastp |
| 943 | b_oleracea\|gb161\|DY026867 | b_oleracea | 2007 | 234 | rice\|gb157.2\|BE039784 | 93.4 | blastp |
| 944 | b_oleracea\|gb161\|DY027139 | b_oleracea | 2008 | 234 | rice\|gb157.2\|BE039784 | 92.7 | blastp |
| 945 | b_oleracea\|gb161\|DY028093 | b_oleracea | 2009 | 234 | rice\|gb157.2\|BE039784 | 92.7 | blastp |
| 946 | b_oleracea\|gb161\|ES942246 | b_oleracea | 2010 | 234 | rice\|gb157.2\|BE039784 | 92.7 | blastp |
| 947 | b_rapa\|gb162\|BG544390 | b_rapa | 2011 | 234 | rice\|gb157.2\|BE039784 | 92.7 | blastp |
| 948 | b_rapa\|gb162\|CA992255 | b_rapa | 2012 | 234 | rice\|gb157.2\|BE039784 | 92.7 | blastp |
| 949 | b_rapa\|gb162\|CV433769 | b_rapa | 2013 | 234 | rice\|gb157.2\|BE039784 | 92.7 | blastp |
| 950 | b_rapa\|gb162\|CV433783 | b_rapa | 2014 | 234 | rice\|gb157.2\|BE039784 | 93.4 | blastp |
| 951 | b_rapa\|gb162\|CX265694 | b_rapa | 2015 | 234 | rice\|gb157.2\|BE039784 | 93.4 | blastp |
| 952 | b_rapa\|gb162\|CX270426 | b_rapa | 2016 | 234 | rice\|gb157.2\|BE039784 | 92.7 | blastp |
| 953 | b_rapa\|gb162\|CX270426 | b_rapa | 2017 | 234 | rice\|gb157.2\|BE039784 | 93.4 | blastp |
| 954 | b_rapa\|gb162\|DY008989 | b_rapa | 2018 | 234 | rice\|gb157.2\|BE039784 | 93.4 | blastp |
| 955 | b_rapa\|gb162\|EE525926 | b_rapa | 2019 | 234 | rice\|gb157.2\|BE039784 | 92.7 | blastp |
| 956 | b_rapa\|gb162\|L33661 | b_rapa | 2020 | 234 | rice\|gb157.2\|BE039784 | 93.4 | blastp |
| 957 | banana\|gb167\|DN240239 | banana | 2021 | 234 | rice\|gb157.2\|BE039784 | 96.7 | blastp |
| 958 | banana\|gb167\|ES433381 | banana | 2022 | 234 | rice\|gb157.2\|BE039784 | 96.7 | blastp |
| 959 | banana\|gb167\|FF558372 | banana | 2023 | 234 | rice\|gb157.2\|BE039784 | 96.7 | blastp |
| 960 | banana\|gb167\|FF558518 | banana | 2024 | 234 | rice\|gb157.2\|BE039784 | 97.4 | blastp |
| 961 | banana\|gb167\|FL662140 | banana | 2025 | 234 | rice\|gb157.2\|BE039784 | 91.4 | blastp |
| 962 | barley\|gb157.3\|AL501882 | barley | 2026 | 234 | rice\|gb157.2\|BE039784 | 96 | blastp |
| 963 | barley\|gb157.3\|BE412576 | barley | 2027 | 234 | rice\|gb157.2\|BE039784 | 97.4 | blastp |
| 964 | barley\|gb157.3\|BQ768399 | barley | 2028 | 234 | rice\|gb157.2\|BE039784 | 82.8 | blastp |
| 965 | barley\|gb157.3\|DN183050 | barley | 2029 | 234 | rice\|gb157.2\|BE039784 | 80.9 | blastp |
| 966 | basilicum\|gb157.3\|DY331402 | basilicum | 2030 | 234 | rice\|gb157.2\|BE039784 | 91.4 | blastp |
| 967 | basilicum\|gb157.3\|DY344099 | basilicum | 2031 | 234 | rice\|gb157.2\|BE039784 | 90.1 | blastp |
| 968 | bean\|gb167\|CA897110 | bean | 2032 | 234 | rice\|gb157.2\|BE039784 | 91.4 | blastp |
| 969 | bean\|gb167\|CA897113 | bean | 2033 | 234 | rice\|gb157.2\|BE039784 | 91.4 | blastp |
| 970 | beet\|gb162\|BQ060487 | beet | 2034 | 234 | rice\|gb157.2\|BE039784 | 94 | blastp |
| 971 | brachypodium\|gb169\|BE398957 | brachypodium | 2035 | 234 | rice\|gb157.2\|BE039784 | 94.04 | tblastn |
| 972 | brachypodium\|gb169\|BE402469 | brachypodium | 2036 | 234 | rice\|gb157.2\|BE039784 | 97.35 | tblastn |
| 973 | brachypodium\|gb169\|BE403589 | brachypodium | 2037 | 234 | rice\|gb157.2\|BE039784 | 95.4 | blastp |
| 974 | brachypodium\|gb169\|BE406789 | brachypodium | 2038 | 234 | rice\|gb157.2\|BE039784 | 96.7 | blastp |
| 975 | bruguiera\|gb166\|BP949576 | bruguiera | 2039 | 234 | rice\|gb157.2\|BE039784 | 91.39 | tblastn |
| 976 | cacao\|gb167\|CA796567 | cacao | 2040 | 234 | rice\|gb157.2\|BE039784 | 93.4 | blastp |
| 977 | cacao\|gb167\|CU473326 | cacao | 2041 | 234 | rice\|gb157.2\|BE039784 | 92.1 | blastp |
| 978 | canola\|gb161\|AY196093 | canola | 2042 | 234 | rice\|gb157.2\|BE039784 | 93.4 | blastp |
| 979 | canola\|gb161\|CD811632 | canola | 2043 | 234 | rice\|gb157.2\|BE039784 | 93.4 | blastp |
| 980 | canola\|gb161\|CD812906 | canola | 2044 | 234 | rice\|gb157.2\|BE039784 | 92.7 | blastp |
| 981 | canola\|gb161\|CD820445 | canola | 2045 | 234 | rice\|gb157.2\|BE039784 | 93.4 | blastp |
| 982 | canola\|gb161\|CD822523 | canola | 2046 | 234 | rice\|gb157.2\|BE039784 | 92.7 | blastp |
| 983 | canola\|gb161\|CD823758 | canola | 2047 | 234 | rice\|gb157.2\|BE039784 | 92.7 | blastp |
| 984 | canola\|gb161\|CD827084 | canola | 2048 | 234 | rice\|gb157.2\|BE039784 | 92.7 | blastp |
| 985 | canola\|gb161\|CD829044 | canola | 2049 | 234 | rice\|gb157.2\|BE039784 | 92.7 | blastp |
| 986 | canola\|gb161\|CD840491 | canola | 2050 | 234 | rice\|gb157.2\|BE039784 | 92.7 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algo- rithm |
|---|---|---|---|---|---|---|---|
| 987 | canola\|gb161\|CN730264 | canola | 2051 | 234 | rice\|gb157.2\|BE039784 | 93.4 | blastp |
| 988 | canola\|gb161\|CN731838 | canola | 2052 | 234 | rice\|gb157.2\|BE039784 | 92.7 | blastp |
| 989 | canola\|gb161\|CX190513 | canola | 2053 | 234 | rice\|gb157.2\|BE039784 | 92.7 | blastp |
| 990 | canola\|gb161\|CX280454 | canola | 2054 | 234 | rice\|gb157.2\|BE039784 | 92.7 | blastp |
| 991 | canola\|gb161\|CX280565 | canola | 2055 | 234 | rice\|gb157.2\|BE039784 | 92.7 | blastp |
| 992 | canola\|gb161\|H07559 | canola | 2056 | 234 | rice\|gb157.2\|BE039784 | 92.7 | blastp |
| 993 | cassava\|gb164\|CK647007 | cassava | 2057 | 234 | rice\|gb157.2\|BE039784 | 95.4 | blastp |
| 994 | cassava\|gb164\|CK650413 | cassava | 2058 | 234 | rice\|gb157.2\|BE039784 | 95.4 | blastp |
| 995 | cassava\|gb164\|CK652715 | cassava | 2059 | 234 | rice\|gb157.2\|BE039784 | 95.4 | blastp |
| 996 | castorbean\|gb160\|MDL29693M002016 | castorbean | 2060 | 234 | rice\|gb157.2\|BE039784 | 93.4 | blastp |
| 997 | castorbean\|gb160\|T14945 | castorbean | 2061 | 234 | rice\|gb157.2\|BE039784 | 93.4 | blastp |
| 998 | catharanthus\|gb166\|EG556977 | catharanthus | 2062 | 234 | rice\|gb157.2\|BE039784 | 88.7 | blastp |
| 999 | catharanthus\|gb166\|EG557933 | catharanthus | 2063 | 234 | rice\|gb157.2\|BE039784 | 93.4 | blastp |
| 1000 | cenchrus\|gb166\|EB656767 | cenchrus | 2064 | 234 | rice\|gb157.2\|BE039784 | 94.7 | blastp |
| 1001 | cenchrus\|gb166\|EB664187 | cenchrus | 2065 | 234 | rice\|gb157.2\|BE039784 | 97.4 | blastp |
| 1002 | centaurea\|gb166\|EH724794 | centaurea | 2066 | 234 | rice\|gb157.2\|BE039784 | 91.4 | blastp |
| 1003 | centaurea\|gb166\|EH739148 | centaurea | 2067 | 234 | rice\|gb157.2\|BE039784 | 91.4 | blastp |
| 1004 | centaurea\|gb166\|EH748001 | centaurea | 2068 | 234 | rice\|gb157.2\|BE039784 | 90.7 | blastp |
| 1005 | centaurea\|gb166\|EH753801 | centaurea | 2069 | 234 | rice\|gb157.2\|BE039784 | 91.4 | blastp |
| 1006 | centaurea\|gb166\|EH780000 | centaurea | 2070 | 234 | rice\|gb157.2\|BE039784 | 91.4 | blastp |
| 1007 | cherry\|gb157.2\|EE488074 | cherry | 2071 | 234 | rice\|gb157.2\|BE039784 | 92.05 | tblastn |
| 1008 | chestnut\|gb170\|SRR006295S0002784 | chestnut | 2072 | 234 | rice\|gb157.2\|BE039784 | 94 | blastp |
| 1009 | chestnut\|gb170\|SRR006295S0004532 | chestnut | 2073 | 234 | rice\|gb157.2\|BE039784 | 93.4 | blastp |
| 1010 | chestnut\|gb170\|SRR006295S0010942 | chestnut | 2074 | 234 | rice\|gb157.2\|BE039784 | 94 | blastp |
| 1011 | chlamydomonas\|gb162\|AW676072 | chlamydomonas | 2075 | 234 | rice\|gb157.2\|BE039784 | 85.6 | blastp |
| 1012 | cichorium\|gb166\|DT211087 | cichorium | 2076 | 234 | rice\|gb157.2\|BE039784 | 89.4 | blastp |
| 1013 | cichorium\|gb166\|DT214005 | cichorium | 2077 | 234 | rice\|gb157.2\|BE039784 | 91.4 | blastp |
| 1014 | cichorium\|gb166\|EL356717 | cichorium | 2078 | 234 | rice\|gb157.2\|BE039784 | 91.4 | blastp |
| 1015 | cichorium\|gb166\|EL365574 | cichorium | 2079 | 234 | rice\|gb157.2\|BE039784 | 91.4 | blastp |
| 1016 | citrus\|gb166\|BQ623292 | citrus | 2080 | 234 | rice\|gb157.2\|BE039784 | 94.7 | blastp |
| 1017 | citrus\|gb166\|BQ624114 | citrus | 2081 | 234 | rice\|gb157.2\|BE039784 | 93.4 | blastp |
| 1018 | coffea\|gb157.2\|BQ449109 | coffea | 2082 | 234 | rice\|gb157.2\|BE039784 | 93.4 | blastp |
| 1019 | coffea\|gb157.2\|DV673676 | coffea | 2083 | 234 | rice\|gb157.2\|BE039784 | 92.7 | blastp |
| 1020 | cotton\|gb164\|AI726845 | cotton | 2084 | 234 | rice\|gb157.2\|BE039784 | 92.7 | blastp |
| 1021 | cotton\|gb164\|AI730068 | cotton | 2085 | 234 | rice\|gb157.2\|BE039784 | 92.1 | blastp |
| 1022 | cotton\|gb164\|BE054711 | cotton | 2086 | 234 | rice\|gb157.2\|BE039784 | 92.7 | blastp |
| 1023 | cotton\|gb164\|BF271677 | cotton | 2087 | 234 | rice\|gb157.2\|BE039784 | 92.1 | blastp |
| 1024 | cotton\|gb164\|CD485874 | cotton | 2088 | 234 | rice\|gb157.2\|BE039784 | 81.46 | tblastn |
| 1025 | cotton\|gb164\|DV849004 | cotton | 2089 | 234 | rice\|gb157.2\|BE039784 | 92.1 | blastp |
| 1026 | cotton\|gb164\|ES792938 | cotton | 2090 | 234 | rice\|gb157.2\|BE039784 | 92.1 | blastp |
| 1027 | cowpea\|gb166\|FC459642 | cowpea | 2091 | 234 | rice\|gb157.2\|BE039784 | 91.4 | blastp |
| 1028 | cowpea\|gb166\|FF384317 | cowpea | 2092 | 234 | rice\|gb157.2\|BE039784 | 81.6 | blastp |
| 1029 | cowpea\|gb166\|FF385803 | cowpea | 2093 | 234 | rice\|gb157.2\|BE039784 | 91.4 | blastp |
| 1030 | cowpea\|gb166\|FF389079 | cowpea | 2094 | 234 | rice\|gb157.2\|BE039784 | 83.4 | blastp |
| 1031 | cowpea\|gb166\|FF391295 | cowpea | 2095 | 234 | rice\|gb157.2\|BE039784 | 90.7 | blastp |
| 1032 | cryptomeria\|gb166\|BP173938 | cryptomeria | 2096 | 234 | rice\|gb157.2\|BE039784 | 92.7 | blastp |
| 1033 | cryptomeria\|gb166\|BW994122 | cryptomeria | 2097 | 234 | rice\|gb157.2\|BE039784 | 92.7 | blastp |
| 1034 | cycas\|gb166\|EX923616 | cycas | 2098 | 234 | rice\|gb157.2\|BE039784 | 92.1 | blastp |
| 1035 | cycas\|gb166\|EX924938 | cycas | 2099 | 234 | rice\|gb157.2\|BE039784 | 91.39 | tblastn |
| 1036 | cynara\|gb167\|GE586142 | cynara | 2100 | 234 | rice\|gb157.2\|BE039784 | 91.4 | blastp |
| 1037 | cynara\|gb167\|GE586173 | cynara | 2101 | 234 | rice\|gb157.2\|BE039784 | 91.4 | blastp |
| 1038 | cynara\|gb167\|GE591726 | cynara | 2102 | 234 | rice\|gb157.2\|BE039784 | 90.1 | blastp |
| 1039 | dandelion\|gb161\|DY804347 | dandelion | 2103 | 234 | rice\|gb157.2\|BE039784 | 91.4 | blastp |
| 1040 | dandelion\|gb161\|DY807877 | dandelion | 2104 | 234 | rice\|gb157.2\|BE039784 | 91.4 | blastp |
| 1041 | eucalyptus\|gb166\|CB967799 | eucalyptus | 2105 | 234 | rice\|gb157.2\|BE039784 | 94.7 | blastp |
| 1042 | eucalyptus\|gb166\|CT980941 | eucalyptus | 2106 | 234 | rice\|gb157.2\|BE039784 | 94.7 | blastp |
| 1043 | fescue\|gb161\|DT679829 | fescue | 2107 | 234 | rice\|gb157.2\|BE039784 | 98 | blastp |
| 1044 | fescue\|gb161\|DT682674 | fescue | 2108 | 234 | rice\|gb157.2\|BE039784 | 96 | blastp |
| 1045 | fescue\|gb161\|DT688310 | fescue | 2109 | 234 | rice\|gb157.2\|BE039784 | 98 | blastp |
| 1046 | flax\|gb157.3\|CV478813 | flax | 2110 | 234 | rice\|gb157.2\|BE039784 | 89.4 | tblastn |
| 1047 | ginger\|gb164\|DY372231 | ginger | 2111 | 234 | rice\|gb157.2\|BE039784 | 97.4 | blastp |
| 1048 | grape\|gb160\|BQ796073 | grape | 2112 | 234 | rice\|gb157.2\|BE039784 | 94.7 | blastp |
| 1049 | grape\|gb160\|BQ796330 | grape | 2113 | 234 | rice\|gb157.2\|BE039784 | 93.4 | blastp |
| 1050 | grape\|gb160\|BQ800180 | grape | 2114 | 234 | rice\|gb157.2\|BE039784 | 94 | blastp |
| 1051 | iceplant\|gb164\|BE034755 | iceplant | 2115 | 234 | rice\|gb157.2\|BE039784 | 93.4 | blastp |
| 1052 | iceplant\|gb164\|CA833881 | iceplant | 2116 | 234 | rice\|gb157.2\|BE039784 | 92.7 | blastp |
| 1053 | ipomoea\|gb157.2\|BJ554031 | ipomoea | 2117 | 234 | rice\|gb157.2\|BE039784 | 94.7 | blastp |
| 1054 | ipomoea\|gb157.2\|BJ555694 | ipomoea | 2118 | 234 | rice\|gb157.2\|BE039784 | 92.72 | tblastn |
| 1055 | ipomoea\|gb157.2\|BJ557693 | ipomoea | 2119 | 234 | rice\|gb157.2\|BE039784 | 94.7 | blastp |
| 1056 | ipomoea\|gb157.2\|BU691365 | ipomoea | 2120 | 234 | rice\|gb157.2\|BE039784 | 94 | blastp |
| 1057 | kiwi\|gb166\|FG404658 | kiwi | 2121 | 234 | rice\|gb157.2\|BE039784 | 92.7 | blastp |
| 1058 | kiwi\|gb166\|FG404746 | kiwi | 2122 | 234 | rice\|gb157.2\|BE039784 | 92.1 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 1059 | kiwi\|gb166\|FG408063 | kiwi | 2123 | 234 | rice\|gb157.2\|BE039784 | 94 | blastp |
| 1060 | lettuce\|gb157.2\|DW078606 | lettuce | 2124 | 234 | rice\|gb157.2\|BE039784 | 91.4 | blastp |
| 1061 | leymus\|gb166\|EG388410 | leymus | 2125 | 234 | rice\|gb157.2\|BE039784 | 96 | blastp |
| 1062 | liriodendron\|gb166\|CK743464 | liriodendron | 2126 | 234 | rice\|gb157.2\|BE039784 | 94.7 | blastp |
| 1063 | liriodendron\|gb166\|CO998653 | liriodendron | 2127 | 234 | rice\|gb157.2\|BE039784 | 93.4 | blastp |
| 1064 | lotus\|gb157.2\|AI967817 | lotus | 2128 | 234 | rice\|gb157.2\|BE039784 | 90.1 | blastp |
| 1065 | lotus\|gb157.2\|CB826697 | lotus | 2129 | 234 | rice\|gb157.2\|BE039784 | 89.4 | blastp |
| 1066 | lovegrass\|gb167\|DN480258 | lovegrass | 2130 | 234 | rice\|gb157.2\|BE039784 | 99.3 | blastp |
| 1067 | lovegrass\|gb167\|EH183996 | lovegrass | 2131 | 234 | rice\|gb157.2\|BE039784 | 98.7 | blastp |
| 1068 | maize\|gb170\|AI612306 | maize | 2132 | 234 | rice\|gb157.2\|BE039784 | 97.4 | blastp |
| 1069 | maize\|gb170\|AI967032 | maize | 2133 | 234 | rice\|gb157.2\|BE039784 | 98.7 | blastp |
| 1070 | maize\|gb170\|AI979679 | maize | 2134 | 234 | rice\|gb157.2\|BE039784 | 85.71 | tblastn |
| 1071 | maize\|gb170\|AW054617 | maize | 2135 | 234 | rice\|gb157.2\|BE039784 | 97.4 | blastp |
| 1072 | maize\|gb170\|AW165569 | maize | 2136 | 234 | rice\|gb157.2\|BE039784 | 97.4 | blastp |
| 1073 | maize\|gb170\|LLBU037867 | maize | 2137 | 234 | rice\|gb157.2\|BE039784 | 94.7 | tblastn |
| 1074 | maize\|gb170\|LLDQ244878 | maize | 2138 | 234 | rice\|gb157.2\|BE039784 | 92.7 | blastp |
| 1075 | maize\|gb170\|LLDQ245962 | maize | 2139 | 234 | rice\|gb157.2\|BE039784 | 92.1 | blastp |
| 1076 | maize\|gb170\|T18275 | maize | 2140 | 234 | rice\|gb157.2\|BE039784 | 97.4 | blastp |
| 1077 | marchantia\|gb166\|BJ841500 | marchantia | 2141 | 234 | rice\|gb157.2\|BE039784 | 89.4 | blastp |
| 1078 | marchantia\|gb166\|C95799 | marchantia | 2142 | 234 | rice\|gb157.2\|BE039784 | 92.1 | blastp |
| 1079 | medicago\|gb157.2\|AA660312 | medicago | 2143 | 234 | rice\|gb157.2\|BE039784 | 89.4 | blastp |
| 1080 | medicago\|gb157.2\|AA660491 | medicago | 2144 | 234 | rice\|gb157.2\|BE039784 | 88.7 | blastp |
| 1081 | melon\|gb165\|AM713905 | melon | 2145 | 234 | rice\|gb157.2\|BE039784 | 94 | blastp |
| 1082 | melon\|gb165\|AM719737 | melon | 2146 | 234 | rice\|gb157.2\|BE039784 | 84.1 | blastp |
| 1083 | melon\|gb165\|AM719902 | melon | 2147 | 234 | rice\|gb157.2\|BE039784 | 92.76 | tblastn |
| 1084 | melon\|gb165\|EB714362 | melon | 2148 | 234 | rice\|gb157.2\|BE039784 | 94 | blastp |
| 1085 | mesostigma\|gb166\|DN254866 | mesostigma | 2149 | 234 | rice\|gb157.2\|BE039784 | 86.3 | blastp |
| 1086 | millet\|gb161\|CD724748 | millet | 2150 | 234 | rice\|gb157.2\|BE039784 | 96 | blastp |
| 1087 | millet\|gb161\|CD725398 | millet | 2151 | 234 | rice\|gb157.2\|BE039784 | 92.72 | tblastn |
| 1088 | nuphar\|gb166\|CD475044 | nuphar | 2152 | 234 | rice\|gb157.2\|BE039784 | 94 | blastp |
| 1089 | nuphar\|gb166\|CK757845 | nuphar | 2153 | 234 | rice\|gb157.2\|BE039784 | 94 | blastp |
| 1090 | nuphar\|gb166\|CK767949 | nuphar | 2154 | 234 | rice\|gb157.2\|BE039784 | 93.4 | blastp |
| 1091 | oak\|gb170\|DB996865 | oak | 2155 | 234 | rice\|gb157.2\|BE039784 | 93.4 | blastp |
| 1092 | oak\|gb170\|DB998068 | oak | 2156 | 234 | rice\|gb157.2\|BE039784 | 94 | blastp |
| 1093 | oak\|gb170\|DN949738 | oak | 2157 | 234 | rice\|gb157.2\|BE039784 | 94 | blastp |
| 1094 | oil_palm\|gb166\|EL681750 | oil_palm | 2158 | 234 | rice\|gb157.2\|BE039784 | 96 | blastp |
| 1095 | oil_palm\|gb166\|EL930220 | oil_palm | 2159 | 234 | rice\|gb157.2\|BE039784 | 96 | blastp |
| 1096 | oil_palm\|gb166\|EL930363 | oil_palm | 2160 | 234 | rice\|gb157.2\|BE039784 | 96 | blastp |
| 1097 | onion\|gb162\|BQ580074 | onion | 2161 | 234 | rice\|gb157.2\|BE039784 | 96 | blastp |
| 1098 | papaya\|gb165\|EX231620 | papaya | 2162 | 234 | rice\|gb157.2\|BE039784 | 92.7 | blastp |
| 1099 | papaya\|gb165\|EX252393 | papaya | 2163 | 234 | rice\|gb157.2\|BE039784 | 92.7 | blastp |
| 1100 | peach\|gb157.2\|BU040848 | peach | 2164 | 234 | rice\|gb157.2\|BE039784 | 93.4 | blastp |
| 1101 | peanut\|gb167\|CD037918 | peanut | 2165 | 234 | rice\|gb157.2\|BE039784 | 92.1 | blastp |
| 1102 | peanut\|gb167\|CX018155 | peanut | 2166 | 234 | rice\|gb157.2\|BE039784 | 92.1 | blastp |
| 1103 | pepper\|gb157.2\|BM061978 | pepper | 2167 | 234 | rice\|gb157.2\|BE039784 | 92.1 | blastp |
| 1104 | pepper\|gb157.2\|BM062219 | pepper | 2168 | 234 | rice\|gb157.2\|BE039784 | 92.7 | blastp |
| 1105 | pepper\|gb157.2\|BM066627 | pepper | 2169 | 234 | rice\|gb157.2\|BE039784 | 92.7 | blastp |
| 1106 | periwinkle\|gb164\|EG556977 | periwinkle | 2170 | 234 | rice\|gb157.2\|BE039784 | 88.7 | blastp |
| 1107 | periwinkle\|gb164\|EG557933 | periwinkle | 2171 | 234 | rice\|gb157.2\|BE039784 | 93.4 | blastp |
| 1108 | physcomitrella\|gb157\|AW127039 | physcomitrella | 2172 | 234 | rice\|gb157.2\|BE039784 | 89.4 | tblastn |
| 1109 | physcomitrella\|gb157\|BQ827306 | physcomitrella | 2173 | 234 | rice\|gb157.2\|BE039784 | 88.7 | blastp |
| 1110 | pine\|gb157.2\|AW010184 | pine | 2174 | 234 | rice\|gb157.2\|BE039784 | 92.7 | blastp |
| 1111 | pine\|gb157.2\|BX248872 | pine | 2175 | 234 | rice\|gb157.2\|BE039784 | 93.4 | blastp |
| 1112 | pine\|gb157.2\|BX251919 | pine | 2176 | 234 | rice\|gb157.2\|BE039784 | 92.7 | blastp |
| 1113 | pine\|gb157.2\|DR102094 | pine | 2177 | 234 | rice\|gb157.2\|BE039784 | 82.1 | blastp |
| 1114 | pine\|gb157.2\|H75266 | pine | 2178 | 234 | rice\|gb157.2\|BE039784 | 92.7 | blastp |
| 1115 | poplar\|gb170\|AI162468 | poplar | 2179 | 234 | rice\|gb157.2\|BE039784 | 96 | blastp |
| 1116 | poplar\|gb170\|AI163154 | poplar | 2180 | 234 | rice\|gb157.2\|BE039784 | 93.4 | blastp |
| 1117 | poplar\|gb170\|AI164614 | poplar | 2181 | 234 | rice\|gb157.2\|BE039784 | 94 | blastp |
| 1118 | poplar\|gb170\|AI164759 | poplar | 2182 | 234 | rice\|gb157.2\|BE039784 | 94.7 | blastp |
| 1119 | poppy\|gb166\|FE964530 | poppy | 2183 | 234 | rice\|gb157.2\|BE039784 | 92.1 | blastp |
| 1120 | poppy\|gb166\|FE965652 | poppy | 2184 | 234 | rice\|gb157.2\|BE039784 | 91.4 | blastp |
| 1121 | potato\|gb157.2\|AW906248 | potato | 2185 | 234 | rice\|gb157.2\|BE039784 | 92.7 | blastp |
| 1122 | potato\|gb157.2\|BF459889 | potato | 2186 | 234 | rice\|gb157.2\|BE039784 | 92.1 | blastp |
| 1123 | potato\|gb157.2\|BG350431 | potato | 2187 | 234 | rice\|gb157.2\|BE039784 | 92.1 | blastp |
| 1124 | potato\|gb157.2\|BG351012 | potato | 2188 | 234 | rice\|gb157.2\|BE039784 | 92.1 | blastp |
| 1125 | potato\|gb157.2\|BG351586 | potato | 2189 | 234 | rice\|gb157.2\|BE039784 | 92.05 | tblastn |
| 1126 | prunus\|gb167\|BQ641170 | prunus | 2190 | 234 | rice\|gb157.2\|BE039784 | 92.7 | blastp |
| 1127 | prunus\|gb167\|BU040848 | prunus | 2191 | 234 | rice\|gb157.2\|BE039784 | 93.4 | blastp |
| 1128 | pseudoroegneria\|gb167\| | pseudoroegneria | 2192 | 234 | rice\|gb157.2\|BE039784 | 97.4 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 1129 | pseudoroegneria|gb167|FF343278 FF349878 | pseudoroegneria | 2193 | 234 | rice|gb157.2|BE039784 | 96 | blastp |
| 1130 | radish|gb164|EV527917 | radish | 2194 | 234 | rice|gb157.2|BE039784 | 92.7 | blastp |
| 1131 | radish|gb164|EV528399 | radish | 2195 | 234 | rice|gb157.2|BE039784 | 92.1 | blastp |
| 1132 | radish|gb164|EV535656 | radish | 2196 | 234 | rice|gb157.2|BE039784 | 92.7 | blastp |
| 1133 | radish|gb164|EV535984 | radish | 2197 | 234 | rice|gb157.2|BE039784 | 92.7 | blastp |
| 1134 | radish|gb164|EV538012 | radish | 2198 | 234 | rice|gb157.2|BE039784 | 92.7 | blastp |
| 1135 | radish|gb164|EV543948 | radish | 2199 | 234 | rice|gb157.2|BE039784 | 92.7 | blastp |
| 1136 | radish|gb164|EV544942 | radish | 2200 | 234 | rice|gb157.2|BE039784 | 92.7 | blastp |
| 1137 | radish|gb164|EV545164 | radish | 2201 | 234 | rice|gb157.2|BE039784 | 92.7 | blastp |
| 1138 | radish|gb164|EV565378 | radish | 2202 | 234 | rice|gb157.2|BE039784 | 92.05 | tblastn |
| 1139 | radish|gb164|EV565564 | radish | 2203 | 234 | rice|gb157.2|BE039784 | 92.7 | blastp |
| 1140 | radish|gb164|EV565962 | radish | 2204 | 234 | rice|gb157.2|BE039784 | 92.7 | blastp |
| 1141 | radish|gb164|EV569172 | radish | 2205 | 234 | rice|gb157.2|BE039784 | 92.7 | blastp |
| 1142 | radish|gb164|EV571678 | radish | 2206 | 234 | rice|gb157.2|BE039784 | 92.7 | blastp |
| 1143 | radish|gb164|EW714068 | radish | 2207 | 234 | rice|gb157.2|BE039784 | 92.7 | blastp |
| 1144 | radish|gb164|EW715107 | radish | 2208 | 234 | rice|gb157.2|BE039784 | 92.7 | blastp |
| 1145 | radish|gb164|EW715768 | radish | 2209 | 234 | rice|gb157.2|BE039784 | 92.7 | blastp |
| 1146 | radish|gb164|EX755320 | radish | 2210 | 234 | rice|gb157.2|BE039784 | 92.1 | blastp |
| 1147 | radish|gb164|EX762413 | radish | 2211 | 234 | rice|gb157.2|BE039784 | 92.7 | blastp |
| 1148 | radish|gb164|EX762524 | radish | 2212 | 234 | rice|gb157.2|BE039784 | 92.1 | blastp |
| 1149 | radish|gb164|EX762893 | radish | 2213 | 234 | rice|gb157.2|BE039784 | 92.7 | blastp |
| 1150 | radish|gb164|EY902515 | radish | 2214 | 234 | rice|gb157.2|BE039784 | 92.1 | blastp |
| 1151 | radish|gb164|EY916898 | radish | 2215 | 234 | rice|gb157.2|BE039784 | 92.7 | blastp |
| 1152 | radish|gb164|T25179 | radish | 2216 | 234 | rice|gb157.2|BE039784 | 92.7 | blastp |
| 1153 | rice|gb170|OS02G06700 | rice | 2217 | 234 | rice|gb157.2|BE039784 | 98 | blastp |
| 1154 | rose|gb157.2|EC586094 | rose | 2218 | 234 | rice|gb157.2|BE039784 | 92.1 | blastp |
| 1155 | rye|gb164|BE494213 | rye | 2219 | 234 | rice|gb157.2|BE039784 | 96.69 | tblastn |
| 1156 | safflower|gb162|EL401182 | safflower | 2220 | 234 | rice|gb157.2|BE039784 | 90.7 | blastp |
| 1157 | safflower|gb162|EL403588 | safflower | 2221 | 234 | rice|gb157.2|BE039784 | 90.1 | blastp |
| 1158 | safflower|gb162|EL408982 | safflower | 2222 | 234 | rice|gb157.2|BE039784 | 86.09 | tblastn |
| 1159 | senecio|gb170|DY663041 | senecio | 2223 | 234 | rice|gb157.2|BE039784 | 88.7 | blastp |
| 1160 | sorghum|gb161.crp|AW120027 | sorghum | 2224 | 234 | rice|gb157.2|BE039784 | 98.7 | blastp |
| 1161 | sorghum|gb161.crp|BE238630 | sorghum | 2225 | 234 | rice|gb157.2|BE039784 | 98.7 | blastp |
| 1162 | sorghum|gb161.crp|BE367365 | sorghum | 2226 | 234 | rice|gb157.2|BE039784 | 98.7 | blastp |
| 1163 | soybean|gb168|AI967817 | soybean | 2227 | 234 | rice|gb157.2|BE039784 | 92.1 | blastp |
| 1164 | soybean|gb168|AJ388676 | soybean | 2228 | 234 | rice|gb157.2|BE039784 | 92.1 | blastp |
| 1165 | soybean|gb168|AW349445 | soybean | 2229 | 234 | rice|gb157.2|BE039784 | 91.4 | blastp |
| 1166 | spikemoss|gb165|DN837720 | spikemoss | 2230 | 234 | rice|gb157.2|BE039784 | 87.4 | blastp |
| 1167 | spikemoss|gb165|FE450939 | spikemoss | 2231 | 234 | rice|gb157.2|BE039784 | 87.4 | blastp |
| 1168 | spruce|gb162|CO216116 | spruce | 2232 | 234 | rice|gb157.2|BE039784 | 92.1 | blastp |
| 1169 | spruce|gb162|CO227952 | spruce | 2233 | 234 | rice|gb157.2|BE039784 | 92.1 | blastp |
| 1170 | spruce|gb162|DR449297 | spruce | 2234 | 234 | rice|gb157.2|BE039784 | 84.8 | blastp |
| 1171 | spruce|gb162|DR449808 | spruce | 2235 | 234 | rice|gb157.2|BE039784 | 82.1 | blastp |
| 1172 | spruce|gb162|DR474303 | spruce | 2236 | 234 | rice|gb157.2|BE039784 | 80.8 | blastp |
| 1173 | spruce|gb162|DR534167 | spruce | 2237 | 234 | rice|gb157.2|BE039784 | 82.1 | blastp |
| 1174 | spruce|gb162|DR579185 | spruce | 2238 | 234 | rice|gb157.2|BE039784 | 80.8 | blastp |
| 1175 | spurge|gb161|BE095303 | spurge | 2239 | 234 | rice|gb157.2|BE039784 | 92.72 | tblastn |
| 1176 | spurge|gb161|DV124297 | spurge | 2240 | 234 | rice|gb157.2|BE039784 | 91.4 | blastp |
| 1177 | strawberry|gb164|CO380977 | strawberry | 2241 | 234 | rice|gb157.2|BE039784 | 92.1 | blastp |
| 1178 | strawberry|gb164|CO817246 | strawberry | 2242 | 234 | rice|gb157.2|BE039784 | 93.4 | blastp |
| 1179 | strawberry|gb164|EX670929 | strawberry | 2243 | 234 | rice|gb157.2|BE039784 | 85.5 | blastp |
| 1180 | sugarcane|gb157.3|BQ529920 | sugarcane | 2244 | 234 | rice|gb157.2|BE039784 | 97.35 | tblastn |
| 1181 | sugarcane|gb157.3|BQ533000 | sugarcane | 2245 | 234 | rice|gb157.2|BE039784 | 98.7 | blastp |
| 1182 | sugarcane|gb157.3|CA076561 | sugarcane | 2246 | 234 | rice|gb157.2|BE039784 | 97.4 | blastp |
| 1183 | sugarcane|gb157.3|CA102375 | sugarcane | 2247 | 234 | rice|gb157.2|BE039784 | 96.03 | tblastn |
| 1184 | sugarcane|gb157.3|CA123229 | sugarcane | 2248 | 234 | rice|gb157.2|BE039784 | 96 | blastp |
| 1185 | sugarcane|gb157.3|CA137141 | sugarcane | 2249 | 234 | rice|gb157.2|BE039784 | 98.7 | blastp |
| 1186 | sugarcane|gb157.3|CA230074 | sugarcane | 2250 | 234 | rice|gb157.2|BE039784 | 92.72 | tblastn |
| 1187 | sunflower|gb162|AJ318263 | sunflower | 2251 | 234 | rice|gb157.2|BE039784 | 90.1 | blastp |
| 1188 | sunflower|gb162|CD848093 | sunflower | 2252 | 234 | rice|gb157.2|BE039784 | 91.4 | blastp |
| 1189 | sunflower|gb162|CD848805 | sunflower | 2253 | 234 | rice|gb157.2|BE039784 | 90.1 | blastp |
| 1190 | sunflower|gb162|EL430967 | sunflower | 2254 | 234 | rice|gb157.2|BE039784 | 82.8 | blastp |
| 1191 | switchgrass|gb167|DN149917 | switchgrass | 2255 | 234 | rice|gb157.2|BE039784 | 96.7 | blastp |
| 1192 | switchgrass|gb167|DN150990 | switchgrass | 2256 | 234 | rice|gb157.2|BE039784 | 98.7 | blastp |
| 1193 | switchgrass|gb167|FE599497 | switchgrass | 2257 | 234 | rice|gb157.2|BE039784 | 96 | blastp |
| 1194 | switchgrass|gb167|FE608350 | switchgrass | 2258 | 234 | rice|gb157.2|BE039784 | 96.7 | blastp |
| 1195 | switchgrass|gb167|FE625398 | switchgrass | 2259 | 234 | rice|gb157.2|BE039784 | 80.13 | tblastn |
| 1196 | switchgrass|gb167|FE627660 | switchgrass | 2260 | 234 | rice|gb157.2|BE039784 | 98.7 | blastp |
| 1197 | switchgrass|gb167|FE634044 | switchgrass | 2261 | 234 | rice|gb157.2|BE039784 | 98 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 1198 | switchgrass\|gb167\|FE637032 | switchgrass | 2262 | 234 | rice\|gb157.2\|BE039784 | 97.4 | blastp |
| 1199 | switchgrass\|gb167\|FL948269 | switchgrass | 2263 | 234 | rice\|gb157.2\|BE039784 | 82.12 | tblastn |
| 1200 | switchgrass\|gb167\|GD043911 | switchgrass | 2264 | 234 | rice\|gb157.2\|BE039784 | 80.13 | tblastn |
| 1201 | tamarix\|gb166\|EG966933 | tamarix | 2265 | 234 | rice\|gb157.2\|BE039784 | 93.4 | blastp |
| 1202 | tamarix\|gb166\|EG972900 | tamarix | 2266 | 234 | rice\|gb157.2\|BE039784 | 82.8 | blastp |
| 1203 | thellungiella\|gb167\|BY818453 | thellungiella | 2267 | 234 | rice\|gb157.2\|BE039784 | 94 | blastp |
| 1204 | thellungiella\|gb167\|DN775374 | thellungiella | 2268 | 234 | rice\|gb157.2\|BE039784 | 94 | blastp |
| 1205 | tobacco\|gb162\|AM816373 | tobacco | 2269 | 234 | rice\|gb157.2\|BE039784 | 81.5 | blastp |
| 1206 | tobacco\|gb162\|CN498843 | tobacco | 2270 | 234 | rice\|gb157.2\|BE039784 | 82.2 | blastp |
| 1207 | tobacco\|gb162\|CV019114 | tobacco | 2271 | 234 | rice\|gb157.2\|BE039784 | 91.4 | blastp |
| 1208 | tobacco\|gb162\|CV020233 | tobacco | 2272 | 234 | rice\|gb157.2\|BE039784 | 91.4 | blastp |
| 1209 | tobacco\|gb162\|CV021807 | tobacco | 2273 | 234 | rice\|gb157.2\|BE039784 | 92.7 | blastp |
| 1210 | tobacco\|gb162\|NTU66262 | tobacco | 2274 | 234 | rice\|gb157.2\|BE039784 | 90.7 | blastp |
| 1211 | tomato\|gb164\|BG123159 | tomato | 2275 | 234 | rice\|gb157.2\|BE039784 | 92.1 | blastp |
| 1212 | tomato\|gb164\|BG123562 | tomato | 2276 | 234 | rice\|gb157.2\|BE039784 | 92.7 | blastp |
| 1213 | tomato\|gb164\|U21078 | tomato | 2277 | 234 | rice\|gb157.2\|BE039784 | 92.7 | blastp |
| 1214 | triphysaria\|gb164\|BM357412 | triphysaria | 2278 | 234 | rice\|gb157.2\|BE039784 | 92.7 | blastp |
| 1215 | triphysaria\|gb164\|EX988766 | triphysaria | 2279 | 234 | rice\|gb157.2\|BE039784 | 91.4 | blastp |
| 1216 | triphysaria\|gb164\|EX990185 | triphysaria | 2280 | 234 | rice\|gb157.2\|BE039784 | 91.4 | blastp |
| 1217 | triphysaria\|gb164\|EX992752 | triphysaria | 2281 | 234 | rice\|gb157.2\|BE039784 | 91.4 | blastp |
| 1218 | volvox\|gb162\|AW676072 | volvox | 2282 | 234 | rice\|gb157.2\|BE039784 | 85 | blastp |
| 1219 | walnuts\|gb166\|CV197623 | walnuts | 2283 | 234 | rice\|gb157.2\|BE039784 | 92.1 | blastp |
| 1220 | walnuts\|gb166\|EL891118 | walnuts | 2284 | 234 | rice\|gb157.2\|BE039784 | 94.7 | blastp |
| 1221 | wheat\|gb164\|AL827137 | wheat | 2285 | 234 | rice\|gb157.2\|BE039784 | 97.4 | blastp |
| 1222 | wheat\|gb164\|BE398647 | wheat | 2286 | 234 | rice\|gb157.2\|BE039784 | 96 | blastp |
| 1223 | wheat\|gb164\|BE398957 | wheat | 2287 | 234 | rice\|gb157.2\|BE039784 | 97.4 | blastp |
| 1224 | wheat\|gb164\|BE405321 | wheat | 2288 | 234 | rice\|gb157.2\|BE039784 | 96 | blastp |
| 1225 | wheat\|gb164\|BE406789 | wheat | 2289 | 234 | rice\|gb157.2\|BE039784 | 95.4 | blastp |
| 1226 | wheat\|gb164\|BJ240969 | wheat | 2290 | 234 | rice\|gb157.2\|BE039784 | 80.79 | tblastn |
| 1227 | wheat\|gb164\|BM135152 | wheat | 2291 | 234 | rice\|gb157.2\|BE039784 | 82.9 | blastp |
| 1228 | wheat\|gb164\|CA616908 | wheat | 2292 | 234 | rice\|gb157.2\|BE039784 | 94.7 | tblastn |
| 1229 | wheat\|gb164\|CJ652504 | wheat | 2293 | 234 | rice\|gb157.2\|BE039784 | 93.4 | blastp |
| 1230 | wheat\|gb164\|DN829631 | wheat | 2294 | 234 | rice\|gb157.2\|BE039784 | 80.92 | tblastn |
| 1231 | zamia\|gb166\|DY032098 | zamia | 2295 | 234 | rice\|gb157.2\|BE039784 | 91.4 | blastp |
| 1232 | barley\|gb157.3\|BE412461 | barley | 2296 | 236 | maize\|gb164\|AI619269 | 87.9 | blastp |
| 1233 | brachypodium\|gb169\|BE404324 | brachypodium | 2297 | 236 | maize\|gb164\|AI619269 | 86.4 | blastp |
| 1234 | cenchrus\|gb166\|EB653779 | cenchrus | 2298 | 236 | maize\|gb164\|AI619269 | 94.8 | blastp |
| 1235 | fescue\|gb161\|DT696747 | fescue | 2299 | 236 | maize\|gb164\|AI619269 | 85.6 | blastp |
| 1236 | leymus\|gb166\|EG375640 | leymus | 2300 | 236 | maize\|gb164\|AI619269 | 88.8 | blastp |
| 1237 | lovegrass\|gb167\|EH189611 | lovegrass | 2301 | 236 | maize\|gb164\|AI619269 | 92 | blastp |
| 1238 | maize\|gb170\|AI944307 | maize | 2302 | 236 | maize\|gb164\|AI619269 | 94.4 | blastp |
| 1239 | oat\|gb164\|BE439172 | oat | 2303 | 236 | maize\|gb164\|AI619269 | 85.58 | tblastn |
| 1240 | pseudoroegneria\|gb167\|FF354244 | pseudoroegneria | 2304 | 236 | maize\|gb164\|AI619269 | 88.4 | blastp |
| 1241 | rice\|gb170\|OS02G53790 | rice | 2305 | 236 | maize\|gb164\|AI619269 | 89.3 | blastp |
| 1242 | rice\|gb170\|OS07G43170 | rice | 2306 | 236 | maize\|gb164\|AI619269 | 90.1 | blastp |
| 1243 | sorghum\|gb161.crp\|AW011679 | sorghum | 2307 | 236 | maize\|gb164\|AI619269 | 95.8 | blastp |
| 1244 | sorghum\|gb161.crp\|CD231888 | sorghum | 2308 | 236 | maize\|gb164\|AI619269 | 90.6 | blastp |
| 1245 | sugarcane\|gb157.3\|CA072943 | sugarcane | 2309 | 236 | maize\|gb164\|AI619269 | 95.3 | blastp |
| 1246 | sugarcane\|gb157.3\|CA090072 | sugarcane | 2310 | 236 | maize\|gb164\|AI619269 | 95.8 | blastp |
| 1247 | switchgrass\|gb167\|DN145249 | switchgrass | 2311 | 236 | maize\|gb164\|AI619269 | 92.5 | blastp |
| 1248 | switchgrass\|gb167\|FE626130 | switchgrass | 2312 | 236 | maize\|gb164\|AI619269 | 93.4 | blastp |
| 1249 | arabidopsis\|gb165\|AT3G01300 | arabidopsis | 2313 | 237 | arabidopsis\|gb157.2\|AT5G15080 | 83.3 | blastp |
| 1250 | b_rapa\|gb162\|CA992096 | b_rapa | 2314 | 237 | arabidopsis\|gb157.2\|AT5G15080 | 82.5 | blastp |
| 1251 | canola\|gb161\|EE473973 | canola | 2315 | 237 | arabidopsis\|gb157.2\|AT5G15080 | 82.3 | blastp |
| 1252 | arabidopsis\|gb165\|AT1G60690 | arabidopsis | 2316 | 239 | arabidopsis\|gb165\|AT1G60680 | 84.1 | blastp |
| 1253 | arabidopsis\|gb165\|AT1G60710 | arabidopsis | 2317 | 239 | arabidopsis\|gb165\|AT1G60680 | 83.2 | blastp |
| 1254 | arabidopsis\|gb165\|AT1G60730 | arabidopsis | 2318 | 239 | arabidopsis\|gb165\|AT1G60680 | 84.44 | tblastn |
| 1255 | b_rapa\|gb162\|ES935213 | b_rapa | 2319 | 239 | arabidopsis\|gb165\|AT1G60680 | 82.1 | blastp |
| 1256 | canola\|gb161\|CD815566 | canola | 2320 | 239 | arabidopsis\|gb165\|AT1G60680 | 80.6 | blastp |
| 1257 | canola\|gb161\|CD819004 | canola | 2321 | 239 | arabidopsis\|gb165\|AT1G60680 | 81.5 | blastp |

TABLE 21-continued

Homologues of the identified polynucleotides and polypeptides which affect nitrogen use efficiency, fertilizer use efficiency, yield, growth rate, vigor, biomass, oil content, abiotic tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 1258 | canola\|gb161\|DY003163 | canola | 2322 | 239 | arabidopsis\|gb165\|AT1G60680 | 81.8 | blastp |
| 1259 | radish\|gb164\|EV524749 | radish | 2323 | 239 | arabidopsis\|gb165\|AT1G60680 | 81.6 | blastp |
| 1260 | radish\|gb164\|EV544729 | radish | 2324 | 239 | arabidopsis\|gb165\|AT1G60680 | 81.8 | blastp |
| 1261 | b_rapa\|gb162\|EX018587 | b_rapa | 2325 | 242 | arabidopsis\|gb165\|AT1G43910 | 85.3 | blastp |
| 1262 | canola\|gb161\|EE452442 | canola | 2326 | 242 | arabidopsis\|gb165\|AT1G43910 | 91.5 | blastp |
| 1263 | radish\|gb164\|EX749875 | radish | 2327 | 243 | arabidopsis\|gb157.2\|AT1G47530 | 91.94 | tblastn |
| 1264 | arabidopsis\|gb165\|AT4G30940 | arabidopsis | 2328 | 244 | arabidopsis\|gb157.2\|AT2G24240 | 88.3 | blastp |
| 1265 | castorbean\|gb160\|EG675736 | castorbean | 2329 | 244 | arabidopsis\|gb157.2\|AT2G24240 | 83.6 | blastp |
| 1266 | cotton\|gb164\|CO495384 | cotton | 2330 | 244 | arabidopsis\|gb157.2\|AT2G24240 | 83.3 | blastp |
| 1267 | nicotiana_benthamiana\|gb162\|CK280239 | nicotiana_benthamiana | 2331 | 244 | arabidopsis\|gb157.2\|AT2G24240 | 80.1 | blastp |
| 1268 | poplar\|gb170\|CA822859 | poplar | 2332 | 244 | arabidopsis\|gb157.2\|AT2G24240 | 81.2 | blastp |
| 1269 | poplar\|gb170\|CV237453 | poplar | 2333 | 244 | arabidopsis\|gb157.2\|AT2G24240 | 81.8 | blastp |
| 1270 | potato\|gb157.2\|CK243505 | potato | 2334 | 244 | arabidopsis\|gb157.2\|AT2G24240 | 83.1 | blastp |
| 1271 | soybean\|gb168\|AW586330 | soybean | 2335 | 244 | arabidopsis\|gb157.2\|AT2G24240 | 80.3 | blastp |
| 1272 | soybean\|gb168\|BP073481 | soybean | 2336 | 244 | arabidopsis\|gb157.2\|AT2G24240 | 80.4 | blastp |
| 1273 | barley\|gb157.3\|AL502083 | barley | 2337 | 246 | rice\|gb157.2\|BI807603 | 89.93 | tblastn |
| 1274 | brachypodium\|gb169\|BE471061 | brachypodium | 2338 | 246 | rice\|gb157.2\|BI807603 | 90.3 | blastp |
| 1275 | maize\|gb170\|AW066842 | maize | 2339 | 246 | rice\|gb157.2\|BI807603 | 88.1 | blastp |
| 1276 | maize\|gb170\|CF021466 | maize | 2340 | 246 | rice\|gb157.2\|BI807603 | 81 | blastp |
| 1277 | maize\|gb170\|LLCD975615 | maize | 2341 | 246 | rice\|gb157.2\|BI807603 | 88.8 | blastp |
| 1278 | maize\|gb170\|T12700 | maize | 2342 | 246 | rice\|gb157.2\|BI807603 | 91.8 | blastp |
| 1279 | sorghum\|gb161.crp\|AW066842 | sorghum | 2343 | 246 | rice\|gb157.2\|BI807603 | 92.9 | blastp |
| 1280 | sorghum\|gb161.crp\|AW747438 | sorghum | 2344 | 246 | rice\|gb157.2\|BI807603 | 82.1 | blastp |
| 1281 | sugarcane\|gb157.3\|BU925651 | sugarcane | 2345 | 246 | rice\|gb157.2\|BI807603 | 88.27 | tblastn |
| 1282 | switchgrass\|gb167\|FL745129 | switchgrass | 2346 | 246 | rice\|gb157.2\|BI807603 | 91.8 | blastp |
| 1283 | wheat\|gb164\|BE471061 | wheat | 2347 | 246 | rice\|gb157.2\|BI807603 | 89.7 | blastp |
| 1284 | rice\|gb170\|OS01G09340 | rice | 2348 | 247 | rice\|gb157.2\|AU068829 | 86.29 | tblastn |
| 1285 | brachypodium\|gb169\|AV835247 | brachypodium | 2349 | 248 | rice\|gb157.2\|AA752451 | 86.7 | blastp |
| 1286 | maize\|gb170\|BG835950 | maize | 2350 | 248 | rice\|gb157.2\|AA752451 | 80.7 | blastp |
| 1287 | sorghum\|gb161.crp\|BE598733 | sorghum | 2351 | 248 | rice\|gb157.2\|AA752451 | 81.4 | blastp |
| 1288 | sugarcane\|gb157.3\|CA101548 | sugarcane | 2352 | 248 | rice\|gb157.2\|AA752451 | 84.5 | blastp |
| 1289 | switchgrass\|gb167\|FE639520 | switchgrass | 2353 | 248 | rice\|gb157.2\|AA752451 | 88.9 | blastp |
| 1290 | barley\|gb157.3\|AL511842 | barley | 2354 | 250 | wheat\|gb164\|BE401454 | 98.4 | blastp |
| 1291 | brachypodium\|gb169\|BE488258 | brachypodium | 2355 | 250 | wheat\|gb164\|BE401454 | 93.4 | blastp |
| 1292 | fescue\|gb161\|DT699211 | fescue | 2356 | 250 | wheat\|gb164\|BE401454 | 90.2 | blastp |
| 1293 | leymus\|gb166\|CD808752 | leymus | 2357 | 250 | wheat\|gb164\|BE401454 | 97.6 | blastp |
| 1294 | pseudoroegneria\|gb167\|FF347865 | pseudoroegneria | 2358 | 250 | wheat\|gb164\|BE401454 | 99.2 | blastp |
| 1295 | rice\|gb170\|OS08G45190 | rice | 2359 | 250 | wheat\|gb164\|BE401454 | 81.9 | blastp |
| 1296 | sorghum\|gb161.crp\|AW287236 | sorghum | 2360 | 250 | wheat\|gb164\|BE401454 | 83.7 | blastp |
| 1297 | wheat\|gb164\|BE488191 | wheat | 2361 | 250 | wheat\|gb164\|BE401454 | 99.2 | blastp |
| 1298 | arabidopsis\|gb165\|AT1G70830 | arabidopsis | 2362 | 251 | arabidopsis\|gb165\|AT1G70850 | 85.4 | blastp |
| 1299 | arabidopsis\|gb165\|AT1G70830T4 | arabidopsis | 2363 | 251 | arabidopsis\|gb165\|AT1G70850 | 88.24 | tblastn |
| 1300 | barley\|gb157.3\|BE420890 | barley | 2364 | 254 | sorghum\|gb161.xeno\|T18303 | 81.5 | blastp |
| 1301 | brachypodium\|gb169\|BE401954 | brachypodium | 2365 | 254 | sorghum\|gb161.xeno\|T18303 | 83 | blastp |
| 1302 | cenchrus\|gb166\|EB656949 | cenchrus | 2366 | 254 | sorghum\|gb161.xeno\|T18303 | 89.1 | blastp |

TABLE 21-continued

Homologues of the identified polynucleotides and polypeptides which affect nitrogen use
efficiency, fertilizer use efficiency, yield, growth rate, vigor, biomass, oil content, abiotic
tress tolerance and/or water use efficiency of a plant

| Polyn. SEQ ID NO: | Cluster name | Organism | Polyp. SEQ ID | Homology to SEQ ID NO: | Core cluster name | % global identity | Algorithm |
|---|---|---|---|---|---|---|---|
| 1303 | fescue\|gb161\|DT686385 | fescue | 2367 | 254 | sorghum\|gb161.xeno\|T18303 | 80.1 | blastp |
| 1304 | leymus\|gb166\|CN466500 | leymus | 2368 | 254 | sorghum\|gb161.xeno\|T18303 | 82.2 | blastp |
| 1305 | maize\|gb170\|AF093538 | maize | 2369 | 254 | sorghum\|gb161.xeno\|T18303 | 91.3 | blastp |
| 1306 | maize\|gb170\|T18303 | maize | 2370 | 254 | sorghum\|gb161.xeno\|T18303 | 94.9 | blastp |
| 1307 | pseudoroegneria\|gb167\|FF348742 | pseudoroegneria | 2371 | 254 | sorghum\|gb161.xeno\|T18303 | 81.2 | blastp |
| 1308 | rice\|gb170\|OS09G19734T3 | rice | 2372 | 254 | sorghum\|gb161.xeno\|T18303 | 83.7 | blastp |
| 1309 | sugarcane\|gb157.3\|BQ533149 | sugarcane | 2373 | 254 | sorghum\|gb161.xeno\|T18303 | 97.5 | blastp |
| 1310 | switchgrass\|gb167\|DN141290 | switchgrass | 2374 | 254 | sorghum\|gb161.xeno\|T18303 | 89.1 | blastp |
| 1311 | switchgrass\|gb167\|DN141310 | switchgrass | 2375 | 254 | sorghum\|gb161.xeno\|T18303 | 89.5 | blastp |
| 1312 | wheat\|gb164\|BE406144 | wheat | 2376 | 254 | sorghum\|gb161.xeno\|T18303 | 81.5 | blastp |
| 1313 | wheat\|gb164\|BF200548 | wheat | 2377 | 254 | sorghum\|gb161.xeno\|T18303 | 81.9 | blastp |
| 1314 | wheat\|gb164\|X77733 | wheat | 2378 | 254 | sorghum\|gb161.xeno\|T18303 | 81.2 | blastp |
| 1315 | maize\|gb170\|CD936650 | maize | 2379 | 269 | sorghum\|gb161.xeno\|AW923465 | 89.12 | tblastn |
| 1315 | maize\|gb170\|CD936650 | maize | 2379 | 256 | sorghum\|gb161.crp\|AW923545 | 88.85 | tblastn |
| 1316 | aquilegia\|gb157.3\|DR915439 | aquilegia | 2380 | 257 | arabidopsis\|gb165\|AT1G71900 | 81.1 | blastp |
| 1317 | arabidopsis\|gb165\|AT1G34470 | arabidopsis | 2381 | 257 | arabidopsis\|gb165\|AT1G71900 | 80.11 | tblastn |
| 1318 | castorbean\|gb160\|EE258327 | castorbean | 2382 | 257 | arabidopsis\|gb165\|AT1G71900 | 81 | blastp |
| 1319 | castorbean\|gb160\|MDL29728M000834 | castorbean | 2383 | 257 | arabidopsis\|gb165\|AT1G71900 | 81.56 | tblastn |
| 1320 | grape\|gb160\|CB035795 | grape | 2384 | 257 | arabidopsis\|gb165\|AT1G71900 | 82.4 | blastp |
| 1321 | radish\|gb164\|EW714634 | radish | 2385 | 257 | arabidopsis\|gb165\|AT1G71900 | 89.74 | tblastn |
| 1322 | maize\|gb170\|CF021816 | maize | 2386 | 259 | sorghum\|gb161.xeno\|AW672541 | 88.3 | blastp |
| 1323 | maize\|gb170\|CO527882 | maize | 2387 | 259 | sorghum\|gb161.xeno\|AW672541 | 85 | blastp |
| 1324 | switchgrass\|gb167\|FE626524 | switchgrass | 2388 | 259 | sorghum\|gb161.xeno\|AW672541 | 85.4 | blastp |
| 1325 | sugarcane\|gb157.3\|CA069240 | sugarcane | 2389 | 262 | sorghum\|gb161.xeno\|BE123399 | 89.08 | tblastn |
| 1326 | sugarcane\|gb157.3\|CA078694 | sugarcane | 2390 | 262 | sorghum\|gb161.xeno\|BE123399 | 88.4 | blastp |
| 1327 | maize\|gb170\|AI901557 | maize | 2391 | 263 | sorghum\|gb161.xeno\|AI901557 | 86.2 | blastp |
| 1328 | sorghum\|gb161.crp\|AW286491 | sorghum | 2392 | 263 | sorghum\|gb161.xeno\|AI901557 | 98.5 | blastp |
| 1329 | sugarcane\|gb157.3\|CA068682 | sugarcane | 2393 | 263 | sorghum\|gb161.xeno\|AI901557 | 93.9 | blastp |
| 1330 | switchgrass\|gb167\|DN146139 | switchgrass | 2394 | 263 | sorghum\|gb161.xeno\|AI901557 | 83.6 | blastp |
| 1331 | switchgrass\|gb167\|FE604486 | switchgrass | 2395 | 263 | sorghum\|gb161.xeno\|AI901557 | 82.7 | blastp |
| 1332 | maize\|gb170\|CD945482 | maize | 2396 | 265 | maize\|gb164\|AI974922 | 81.53 | tblastn |
| 1333 | sorghum\|gb161.crp\|BE599314 | sorghum | 2397 | 265 | maize\|gb164\|AI974922 | 80.49 | tblastn |

Table 21: Provided are the homologous polypeptides (polypep.) and polynucleotides (polynucl.) of the genes and polypeptides identified in Table 20, which are capable of increase nitrogen use efficiency, fertilizer use efficiency, yield, growth rate, vigor, biomass, oil content, abiotic stress tolerance and/or water use efficiency of a plant. Homology was calculated as % of identity over the aligned sequences. The query sequences were polypeptide sequences SEQ ID NOs: 138-269 and the subject sequences are polypeptide sequences or nucleotide sequences which were dynamically translated in all six reading frames identified in the database based on greater than 80% identity to the query polypeptide sequences.

Example 3

Gene Cloning and Generation of Binary Vectors for Expression in Plants

Cloning Strategy

Genes presented in Examples 1 and 2 above were cloned into binary vectors for the generation of transgenic plants. For cloning, the full-length open reading frames (ORF) were first identified. EST clusters and in some cases mRNA sequences were analyzed to identify the entire open reading frame of each gene, by comparing the results of several translation algorithms to known proteins from other plant species.

In order to clone the full-length cDNAs, Reverse Transcription followed by PCR (RT-PCR) was performed on total RNA extracted from leaves, roots, fibers or other plant tissues, growing under either normal, nutrient deficient or other abiotic stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.), which are well known to those skilled in the art. PCR products were purified using PCR purification kit (Qiagen) and sequencing of the amplified PCR products was performed, using ABI 377 sequencer (Applied Biosystems). In case of none or weak PCR product bands were visible on Ethidium Bromide—stained 1% agarose gels, 0.1-1 μL of the PCR product was used as a DNA template, and PCR amplification was effected using either the same or new set of primers, designed internally to the first set of primers. In such cases, the set of primers which is expected to produce the longer PCR product is designated External primers set (EF and ER for External-Forward and External-Reverse, respectively), and the set of primers which expected to produce the shorter PCR product is designated Nested primers set (NF and NR for Nested-Forward and Nested-Reverse, respectively), as illustrated in Table 22 below. Cloning of the cotton genes CT75, CT7, CT76, CT71, CT74, CT11, CT20, CT81, CT22, CT82, CT3, CT40, CT1, CT6, CT27 and CT2 was performed using only one set of primers, as detailed in WO Publication No: WO2005/121364.

To facilitate cloning of the cDNAs, a 7-12 bp extension was added to the 5' prime end of most of the primers. The primer extension includes an endonuclease restriction site (Table 22). The restriction sites were selected using two parameters: (a). The site does not exist in the cDNA sequence; and (b). The restriction sites in the forward and reverse primers are designed such that the digested cDNA is inserted in the sense formation into the binary vector utilized for transformation. Table 22, hereinbelow, provides the primers designation, restriction endonuclease sites added for the subsequent cloning, and sequences of each primer used for the amplification of the genes of the some embodiments of the invention.

TABLE 22

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| NUE227 | SalI, | NUE227_EF_SalI | TTAGTCGACAGAGAAGAGGCAAGAACAACTAG | 2564 | 101-F | GCTATGACCATGATTACGCC | 2860 | pGXN |
|  | XbaI | NUE227_ER_XbaI | TATCTAGACGATCGGTGTCCACTGTACAG | 2565 |  |  |  |  |
|  |  | NUE227_NF_SalI | TTAGTCGACACTAGCTGCATGGCAATGG | 2566 |  |  |  |  |
|  |  | NUE227_NR_XbaI | TTAGTCGACACTAGCTGCATGGCAATGG | 2567 | NUE227_NR_XbaI | TATCTAGATTAACGCGTTGATCGATCAGC | 2861 |  |
| NUE233 | SalI, | NUE233_EF_SalI | TTAGTCGACCTCGAAATCCTTCCCAAGAC | 2568 |  |  |  | pKsJ or Topo |
|  | XbaI | NUE233_ER_XbaI | TATCTAGAGTCACAGAATAGTACACGTACACAAC | 2569 |  |  |  |  |
|  |  | NUE233_NF_SalI | TTAGTCGACCGCACGCTTCTCCATTTC | 2570 |  |  |  |  |
|  |  | NUE233_NR_XbaI | TATCTAGATCAAACTAAGTACTCCAGTAACAAC | 2571 |  |  |  |  |
| NUE237 | SalI, | NUE237_EF_SalI | AAAGTCGACCCTCTCTCTCGTTTCGATTCC | 2572 | 35S_1F | GGAGAGGACAGGCTTCTTGAG | 2862 | pGXN |
|  | XbaI | NUE237_ER_XbaI | ATTCTAGATCAACCACATAGCCTAGAGCAC | 2573 | NUE237_NR_XbaI | ACTCTAGAACTCTATTAACAATGCACGGAG | 2863 |  |
|  |  | NUE237_NF_SalI | AAAGTCGACAGATTCGATCCAACCAAACC | 2574 |  |  |  |  |
|  |  | NUE237_NR_XbaI | ACTCTAGAACTCTATTAACAATGCACGGAG | 2575 |  |  |  |  |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| NUE241 | SalI, | NUE241_EF_SalI | AAAGTCGACAA TTCTTCTTTGTT TGCTTGC | 2576 | 35S_1F | GGAGAGGACA GGCTTCTTGAG | 2864 | pGXN |
| | XbaI | NUE241_ER_XbaI | ATTCTAGATAA ATGCTGATATA GGACAAAGC | 2577 | NUE241_NR_XbaI | ATTCTAGATCA CAATAGAAAC ATCCTCCCTC | 2865 | |
| | | NUE241_NF_SalI | AAAGTCGACGA AGAAAACCCAC AAAACCAG | 2578 | | | | |
| | | NUE241_NR_XbaI | ATTCTAGATCAC AATAGAAACAT CCTCCCTC | 2579 | | | | |
| NUE242 | XbaI, | NUE242_EF_XbaI | TATCTAGAGAG AAGAGAGAGAC TTTGAAGATG | 2580 | p35S_F2 | GGACAGGCTT CTTGAGATCCT | 2866 | pGXN |
| | SacI | NUE242_ER_SacI | TGAGCTCTTAAG AGTAGACACAA CTCCTGCG | 2581 | NUE242_NR_SacI | TGAGCTCTTAT TAGGAAGCAA CTTCAAGAAAT G | 2867 | |
| | SalI, | NUE242_NF_SalI | TTAGTCGACTGA AGATGGAAGCA AACTCTAAC | 2582 | | | | |
| | SacI | NUE242_NR_SacI | TGAGCTCTTATT AGGAAGCAACT TCAAGAAATG | 2583 | | | | |
| NUE255 | EcoRV | NUE255_EF_EcoRV | ATGATATCCCTC CAACCTCTCTCC CAAC | 2584 | p35S_F2 | GGACAGGCTT CTTGAGATCCT | 2868 | Topo |
| | | NUE255_ER_EcoRV | TAGATATCGATT GCTTCTTGTACT CTGATCATC | 2585 | NUE255_NR_EcoRV | TAGATATCTCA TCATTTGATCA GCTTTAGCG | 2869 | |
| | | NUE255_NF_EcoRV | ATGATATCCAA GAATTAAGGTG TAGCAACC | 2586 | | | | |
| | | NUE255_NR_EcoRV | TAGATATCTCAT CATTTGATCAGC TTTAGCG | 2587 | | | | |
| NUE269 | SalI, | NUE269_NF_SalI | TATGTCGACAC AAGGAAATGAT GGCTTCTTGAG | 2588 | 35S_1F | GGAGAGGACA GGCTATTG | 2870 | pGXN |
| | XbaI | NUE269_NR_XbaI | TATCTAGACACC ACAACATGATA GCTTTTG | 2589 | NUE269_NR_XbaI | TATCTAGACAC CACAACATGA TAGCTTTTG | 2871 | |
| NUE521 | Sal, | NUE521 NF Sal | AAGGTCGACCT GGGAGCTAGCT TTGGAG | 2590 | p35S_F2 | GGACAGGCTT CTTGAGATCCT | 2872 | pGXN |
| | Xba | NUE521 ER Xba | ACTCTAGATCAC ACCGATTCCAC ACATAAC | 2591 | NUE521 NR Xba | CGTCTAGATCA GATCGTGTTGA GCACTTGAGC | 2873 | |
| | | NUE521 NF Sal | AAGGTCGACCT GGGAGCTAGCT TTGGAG | 2592 | | | | |
| | | NUE521 NR Xba | CGTCTAGATCA GATCGTGTTGA GCACTTGAGC | 2593 | | | | |
| NUE554 | SmaI, | NUE554_EF_SmaI | TCCCGGGCTCCG TCTCTAGGGTTT GAG | 2594 | 35S_1F | GGAGAGGACA GGCTTCTTGAG | 2874 | pGXN |
| | SacI | NUE554_ER_SacI | TGAGCTCTCAGT GATTGGAACTCT AGATCTTG | 2595 | NUE554_ER_SacI | TGAGCTCTCAG TGATTGGAACT CTAGATCTTG | 2875 | |
| NUE562 | XbaI, | NUE562_EF_XbaI | TATCTAGACTTG AGCTAGGGTTTT ATCGC | 2596 | 35S_1F | GGAGAGGACA GGCTTCTTGAG | 2876 | pGXN |
| | SacI | NUE562_ER_SacI | TGAGCTCTTAAT GCAGACGGTAA CATCTAGG | 2597 | NUE562_NR_SacI | TGAGCTCTTAT GAAGATTACA GCCTCCTACC | 2877 | |
| | | NUE562_NF_XbaI | TATCTAGAAAC AATGTCCGGGA GGAAGAAGAC | 2598 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | NUE562_NR_SacI | TGAGCTCTTATG AAGATTACAGC CTCCTACC | 2599 | | | | |
| NUE567 | Sal, | NUE567_EF_Sal | AGAGTCGACGT GACATAAAATC CATGGCTG | 2600 | 35S_1F | GGAGAGGACA GGCTTCTTGAG | 2878 | pGXN |
| | Xba | NUE567_ER_Xba | TATCTAGATCAG CTTACACAAGC CCTTAGCA | 2601 | NUE567 NR Xba | ACCTCTAGATC ATTAAGTGGCT TTCCAGGAAG | 2879 | |
| | | NUE567_NF Sal | GAGGTCGACAA TCCATGGCTGA AGCTTG | 2602 | | | | |
| | | NUE567 NR Xba | ACCTCTAGATCA TTAAGTGGCTTT CCAGGAAG | 2603 | | | | |
| NUE568 | Sal, | NUE568 EF Sal | AGAGTCGACCG CAACGGAAAAC AAATC | 2604 | 35S_1F | GGAGAGGACA GGCTTCTTGAG | 2880 | pGXN |
| | Xba | NUE568 ER Xba | TATCTAGAAGA TAGGCTTATCTC AATGGCT | 2605 | NUE568 NR Xba | TATCTAGATCA TGTTCACTGAG TAACGATACTA ACAG | 2881 | |
| | | NUE568 NF Sal | TAGGTCGACAC AAATCCGCCAA TGGAAG | 2606 | | | | |
| | | NUE568 NR Xba | TATCTAGATCAT GTTCACTGAGTA ACGATACTAAC AG | 2607 | | | | |
| NUE573 | Sal, | NUE573 EF Sal | TAGGTCGACGA GAGAAATCCAT GGAGACG | 2608 | 35S_1F | GGAGAGGACA GGCTTCTTGAG | 2882 | pKsJ |
| | Sac | NUE573_ER Sac | CGAGCTCAATTT CAGTACAGGAT TTAAACC | 2609 | NUE573 NR Sac | CGAGCTCTCAG TACAGGATTTA AACCAAGACA | 2883 | |
| | Sma, | NUE573_NF Sma | ACCCGGGAGAC GATGACGATGA AGGTTG | 2610 | | | | |
| | Sac | NUE573 NR Sac | CGAGCTCTCAGT ACAGGATTTAA ACCAAGACA | 2611 | | | | |
| NUE575 | EcoRV | NUE575_NF_EcoRV | AAGATATCCCA AACACCAAACC CTCG | 2612 | NUE575_NF_EcoRV | AAGATATCCC AAACACCAAA CCCTCG | 2884 | pKsJ |
| | | NUE575_NR_EcoRV | TAGATATCTCAT CATATTCCTAGC TTATCAACCTC | 2613 | 101_R | AAGTTGGGTA ACGCCAGGGT | 2885 | |
| NUE585 | SalI, | NUE585_EF_SalI | AAAGTCGACCG ATTTCTGCTTCG ATCTCTAC | 2614 | 35S_1F | GGAGAGGACA GGCTTCTTGAG | 2886 | pGXN |
| | XbaI | NUE585_ER_XbaI | ATTCTAGACCTT CTTCGATCTTCT TGAACC | 2615 | NUE585_NR_XbaI | ATTCTAGATTA GTTTGCAGTTA TCGCAGTGG | 2887 | |
| | | NUE585_NF_SalI | AAAGTCGACGT CTGGGTCGAAG TTAAATAGG | 2616 | | | | |
| | | NUE585_NR_XbaI | ATTCTAGATTAG TTTGCAGTTATC GCAGTGG | 2617 | | | | |
| NUE587 | SalI, | NUE587_EF_SalI | AAAGTCGACGT TCCATTGGAGG AGAATCG | 2618 | 35S_1F | GGAGAGGACA GGCTTCTTGAG | 2888 | pGXN |
| | XbaI | NUE587_ER_XbaI | ATTCTAGATTCA AAAGGAAAATG GAGAGG | 2619 | NUE587_NR_XbaI | ATTCTAGATTA TTTCAAACATG AAATGAGTTGC | 2889 | |
| | | NUE587_NF_SalI | AAAGTCGACAA AGGCTTGGAAA GGAAGG | 2620 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | NUE587_NR_XbaI | ATTCTAGATTAT TTCAAACATGA AATGAGTTGC | 2621 | | | | |
| NUE528 | Sac | NUE528_EF_Sac | AGAGCTCAACC CTAACGTTTCGA TCG | 2622 | 101F | GCTATGACCAT GATTACGCC | 2890 | pGXN |
| | SalI, | NUE528_ER_Sac | TGAGCTCTTCCA GAAGTAGCATC TTTCG | 2623 | NUE528_NR_Sac | TGAGCTCTGGC CTTCACCCTCT ATATCTC | 2891 | |
| | | NUE528_NF_SalI | AATGTCGACGA AGCGTCTGAGC CAGTCC | 2624 | | | | |
| | | NUE528_NR_Sac | TGAGCTCTGGCC TTCACCCTCTAT ATCTC | 2625 | | | | |
| NUE535 | Sal, | NUE535_NF_Sal | ATTGTCGACGA GTATGCTTTCCG ATGGG | 2626 | 101_F | GCTATGACCAT GATTACGCC | 2892 | pGXN |
| | XbaI | NUE535_NR_XbaI | TTTCTAGACTAT GAATGAATCCG TGACTCTTG | 2627 | NUE535_NR_XbaI | TTTCTAGACTA TGAATGAATCC GTGACTCTTG | 2893 | |
| NUE538 | Sal, | NUE538_EF_Sal | ATTGTCGACCAC GACCATTCTTCA TTTTCC | 2628 | NUE538_EF_Sal | ATTGTCGACCA CGACCATTCTT CATTTTCC | 2894 | pKSJ |
| | Sma | NUE538_ER_Sma | TCCCGGGTTAG AACTGAGTCTG AAAGGATGG | 2629 | NOS R | GCGGGACTCT AATCATAAAA ACC | 2895 | |
| NUE548 | Sal | NUE548_NF_Sal | AATGTCGACGT CCTAATACTATA CTCGCAATCC | 2630 | 101_F | GCTATGACCAT GATTACGCC | 2896 | pGXN |
| | Xba | NUE548_NR_Xba | AATCTAGATCA ACCAACTAGTTT GCAGCTCCT | 2631 | NUE548_NR_Xba | AATCTAGATCA ACCAACTAGTT TGCAGCTCCT | 2897 | |
| NUE537 | Sal, | NUE537_NF_Sal | TAAGTCGACCA AACAACATGTC TGCCTGTG | 2632 | 101_ER | GAAACACCAT CTTCGTTCTTG | 2898 | pGXN |
| | Xba | NUE537_NR_Xba | ATTCTAGATTAA CACATCGTTTGG TGCATAGC | 2633 | NUE537_NF_Sal | TAAGTCGACC AAACAACATG TCTGCCTGTG | 2899 | |
| NUE551 | Sal, | NUE551_NF_Sal | AATGTCGACGTT GATCAGTCAGC CCACTTC | 2634 | NUE551_seqF | GTCAAGCTGTG CTGTCTTCC | 2900 | pGXN |
| | Xba | NUE551_ER_Xba | TATCTAGAGAC ATAATCCATCA ACGGTTG | 2635 | 101_ER | GAAACACCAT CTTCGTTCTTG | 2901 | |
| NUE553 | Xba. | NUE553_EF_Xba | AATCTAGACTC ACGAATCCACC GATCAG | 2636 | NUE553_NF_Xba | AATCTAGAGA CACGGACCGA ACAGCTAG | 2902 | pGXN |
| | Sma | NUE553_ER_Sma | TCCCGGGACAC ACATCATGGCT GTTACAG | 2637 | NOS_R | GCGGGACTCT AATCATAAAA ACC | 2903 | |
| | | NUE553_NF_Xba | AATCTAGAGAC ACGGACCGAAC AGCTAG | 2638 | | | | |
| | | NUE553_NR_Sma | TCCCGGGCGAC TTCATATACAGA CGGATG | 2639 | | | | |
| NUE511 | Xba. | NUE511_EF_Xba | AATCTAGAGAT TAGGAGCAGGG ACCAATC | 2640 | NUE511_EF_Xba | AATCTAGAGA TTAGGAGCAG GGACCAATC | 2904 | pGXN |
| | Sac | NUE511_NR_Sac | TGAGCTCTTAGG TACATGATGAC ATTTCAGCA | 2641 | 101_ER | GAAACACCAT CTTCGTTCTTG | 2905 | |
| NUE512 | Xba. | NUE512_NF_Xba | AATCTAGACCT ATTGCTCATGAT GTTTGA | 2642 | NUE512_NF_Xba | AATCTAGACCT ATTGCTCATGA TGTTTGA | 2906 | pGXN |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | Sac | NUE512_NR_Sac | TGAGCTCTTACA AAGGCAGGAAA TACAGAAG | 2643 | Nos_R | GCGGGACTCT AATCATAAAA ACC | 2907 | |
| NUE542 | XbaI, | NUE542_EF_XbaI | TATCTAGAAATT TAGCTCGTTGAT GATGG | 2644 | NUE542_seqF | GTACGTCTCCG TCCGACAAC | 2908 | pGXN |
| | SacI | NUE542_ER_SacI | TGAGCTCCTAGT GTCCATGTCAAT GATGTC | 2645 | 101ER | GAAACACCAT CTTCGTTCTTG | 2909 | |
| | | NUE542_NF_XbaI | TATCTAGATAGC TCGTTGATGATG GAGG | 2646 | | | | |
| | | NUE542_NR_SacI | TGAGCTCTTATC CATGTCAATGAT GTCCATC | 2647 | | | | |
| NUE569 | SalI | NUE569_NF_SalI | AAAGTCGACGC TACTGCTTCTTC TGTTCACC | 2648 | 35S_1F | GGAGAGGACA GGCTTCTTGAG | 2910 | pGXN |
| | SacI | NUE569_NR_SacI | TGAGCTCTACTA CCATAGAACTG AAGAAGAAGTC | 2649 | NUE569_seqR | GAGATGGAGC CTTGTCATGA | 2911 | |
| NUE244 | SalI, | NUE244_NF_SalI | TTAGTCGACTAG ACTGATGGGAA GTGTTCC | 2650 | 35S_1F | GGAGAGGACA GGCTTCTTGAG | 2912 | pGXN |
| | XbaI | NUE244_NR_XbaI | TATCTAGACTAC TACACGGATTG CCCAAAC | 2651 | NUE244_NRxbaI | TATCTAGACTA CTACACGGATT GCCCAAAC | 2913 | |
| NUE577 | | NUE577_NF_XbaI | AATCTAGAGTTT ATCTTGTTTTGG GTTTGG | 2652 | 35S1F | GGAGAGGACA GGCTTCTTGAG | 2914 | TopoB |
| | | NUE577_NR_SmaI | TCCCGGGGTGA AGATCTCAGA CCACCTC | 2653 | NUE577_NR_SmaI | TCCCGGGGTG AAAGATCTCA GACCACCTC | 2915 | |
| NUE253 | XbaI, | NUE253_EF_XbaI | TATCTAGACTTC TTCCTCCATATC ACACG | 2654 | 35S_1F | GGAGAGGACA GGCTTCTTGAG | 2916 | pKSJ |
| | SmaI | NUE253_ER_SmaI | TCCCGGGTCAC GTGGCATGCAT GATCTG | 2655 | | | | |
| | | NUE253_NF_XbaI | TATCTAGAAAC AATGGATGGGG AGGAGGAC | 2656 | NUE253_NR_SmaI | TCCCGGGTCAT CACTCGCTCTC GAATTCC | 2917 | |
| | | NUE253_NR_SmaI | TCCCGGGTCATC ACTCGCTCTCGA ATTCC | 2657 | | | | |
| NUE583 | XbaI, | NUE583_EF_XbaI | TATCTAGACAC GAATCAACCCA CCAGAG | 2658 | 35S_1F | GGAGAGGACA GGCTTCTTGAG | 2918 | pGXN |
| | SacI | NUE583_ER_SacI | TGAGCTCTCAAT GCCGATCATCA GTGCTAAG | 2659 | NUE583_NR_SacI | TGAGCTCTCAT CAGAACCGGA AGAAGTTGG | 2919 | |
| | | NUE583_NF_XbaI | TATCTAGAAAC AATGCCTTGGGT TTATCATCC | 2660 | | | | |
| | | NUE583_NR_SacI | TGAGCTCTCATC AGAACCGGAAG AAGTTGG | 2661 | | | | |
| NUE235 | XbaI, | NUE235_EF_XbaI | TATCTAGAATTG AGCAGAGGAGC CATG | 2662 | 35S_1F | GGAGAGGACA GGCTTCTTGAG | 2920 | pGXN |
| | SacI | NUE235_ER_SacI | TGAGCTCCTACA CAGGGTGCCAG ATCTC | 2663 | NUE235_NR_SacI | TGAGCTCTTAA GTGCAAGTTGT CAATCCTATTG | 2921 | |
| | | NUE235_NF_XbaI | TATCTAGAGGA GCCATGGCCAA AATC | 2664 | | | | |
| | | NUE235_NR_SacI | TGAGCTCTTAAG | 2665 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | | TGCAAGTTGTCA ATCCTATTG | | | | | |
| NUE231 GA | | | | | 35S_1F NUE231_GA_R | GGAGAGGACA GGCTTCTTGAG CCTGAGAGGG CGATCATATC | 2922 2923 | |
| NUE513 | XbaI, | NUE513_NF_XbaI | AATCTAGAGAT GATGGTTTGATG CAGATG | 2666 | 35S_1F | GGAGAGGACA GGCTTCTTGAG | 2924 | pKSJ |
| | SmaI | NUE513_NR_SmaI | TCCCGGGCTAA CGTAGTTTCTTA CCAACCAAAC | 2667 | NUE513_seqR | CTGCTTTGACA TGGCTTAGAC | 2925 | |
| NUE516 | SalI, | NUE516_NF_SalI | AATGTCGACGA GAGAAGGGTGT AATGAGCTG | 2668 | p35S_F2 | GGACAGGCTT CTTGAGATCCT | 2926 | pGXN |
| | XbaI | NUE516_NR_XbaI | TATCTAGATCAT CAGTAGGGGTT CCTATGTGG | 2669 | NUE516_NR_XbaI | TATCTAGATCA TCAGTAGGGG TTCCTATGTGG | 2927 | |
| NUE223 | SalI, | NUE223_NF_SalI | AAAGTCGACCA AGAGGTAGCAC ATCCTCTCC | 2670 | 35S_1F | GGAGAGGACA GGCTTCTTGAG | 2928 | pGXN |
| | XbaI | NUE223_NR_XbaI | ATTCTAGACCG GATTGAACTAA TTAACGAC | 2671 | NUE223_NR_XbaI | ATTCTAGACCG GATTGAACTA ATTAACGAC | 2929 | |
| NUE540 | SalI, | NUE540_NF_SalI | AAAGTCGACAG GAAGATTGTGA GCATTGAAG | 2672 | 35S_1F | GGAGAGGACA GGCTTCTTGAG | 2930 | pGXN |
| | XbaI | NUE540_NR_XbaI | ATTCTAGACACC TAATGATCTCAC TTGTAAGG | 2673 | NUE540_ER_NdeI | CATACCAACAT GTTCGACCAC | 2931 | |
| NUE544 | SalI, | NUE544_EF_SalI | TTAGTCGACAG CCTTGCCTTGTT TCTTC | 2674 | 35S_1F | GGAGAGGACA GGCTTCTTGAG | 2932 | pKSJ |
| | SmaI | NUE544_ER_SmaI | TCCCGGGCAAC TTATACACTCAA CCAAAGC | 2675 | NUE544_NR_SmaI | TCCCGGGCTTT CATCCATGTGT GCAGTG | 2933 | |
| | | NUE544_NF_SalI | TTAGTCGACCAT ACACACACAGT GAGAGGTAGG | 2676 | | | | |
| | | NUE544_NR_SmaI | TCCCGGGCTTTC ATCCATGTGTGC AGTG | 2677 | | | | |
| NUE560 | XbaI, | NUE560_EF_XbaI | AATCTAGAAGA AACCCAGAGGA GCAGC | 2678 | 35S_F | GGAGAGGACA GGCTTCTTGAG | 2934 | pGXN |
| | SacI | NUE560_ER_SacI | CGAGCTCAAGG GATTATTATTGC AGGTTG | 2679 | NUE560_NR_SacI | TGAGCTCCTAC TTCTAGGCCTT GTTGCTGC | 2935 | |
| | | NUE560_NF_XbaI | AATCTAGAGAA GCAGGAAGGAA GCAGAG | 2680 | | | | |
| | | NUE560_NR_SacI | TGAGCTCCTACT TCTAGGCCTTGT TGCTGC | 2681 | | | | |
| NUE563 | XbaI, | NUE563_EF_XbaI | AATCTAGAGAT AACATCAGTAG TTCGCAGC | 2682 | NUE563_NF_XbaI | ATTCTAGATCA CAGCAACACA ATCACCAC | 2936 | pGXN |
| | SacI | NUE563_ER_SacI | CGAGCTCAACA CACTCACACCA AAAGTCC | 2683 | 101_R | AAGTTGGGTA ACGCCAGGGT | 2937 | |
| | | NUE563_NF_XbaI | ATTCTAGATCAC AGCAACACAAT CACCAC | 2684 | | | | |
| | | NUE563_NR_SacI | TGAGCTCCACTG CTACTGAAGGC AAATTC | 2685 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| NUE565 | XbaI | NUE565_EF_XbaI | ATTCTAGATTTT CCTGGATTTTGT TTTCTC | 2686 | 35S_1F | GGAGAGGACA GGCTTCTTGAG | 2938 | pGXN |
| | SacI | NUE565_ER_SacI | TGAGCTCTCAAT TAAAGAGTTAC CCTAACG | 2687 | NUE565_NR_SacI | TGAGCTCCTAC TTGAGCCTTCT AGCTCTGTTC | 2939 | |
| | | NUE565_NF_XbaI | ATTCTAGAGATT TGGGGAAAAGC TATGG | 2688 | | | | |
| | | NUE565_NR_SacI | TGAGCTCCTACT TGAGCCTTCTAG CTCTGTTC | 2689 | | | | |
| NUE566 | SalI | NUE566_EF_SalI | TACGTCGACTTC ACATGTCTTGAC TAGTTCATATG | 2690 | 35S_1F | GGAGAGGACA GGCTTCTTGAG | 2940 | Topo |
| | | NUE566_ER_SalI | TAAGTCGACAC GATACATTCAAT ACAATCACC | 2691 | NUE566_R | CGAAGGCATA GACGTCTGTC | 2941 | |
| | | NUE566_NF_SalI | TTAGTCGACCTT CCATCATGCTCC CAAAG | 2692 | | | | |
| | | NUE566_NR_SalI | TAAGTCGACTC AACTCAGCATC ACGTCTCAGC | 2693 | | | | |
| NUE586 | SalI, | NUE586_EF_SalI | AATGTCGACTC GTTTCTCCTCTA ACGTCAAC | 2694 | 35S_1F | GGAGAGGACA GGCTTCTTGAG | 2942 | pKSJ |
| | SmaI | NUE586_ER_SmaI | TCCCGGGTCAG CAGCTCTCTGTC TGTTAC | 2695 | NUE586_R | CATCGAAGCA CTTCTCAACTG | 2943 | |
| | | NUE586_NF_SalI | ATAGTCGACGTT TAACATAGTTG GGGCTAGG | 2696 | | | | |
| | | NUE586_NR_SmaI | CCCCGGGATAA GCCAGGAGATG AAAGGAG | 2697 | | | | |
| NUE588 | SalI, | NUE588_NF_SalI | AAAGTCGACGA TCGAAAAGAGA AGAGGAGC | 2698 | 35S_1F | GGAGAGGACA GGCTTCTTGAG | 2944 | pGXN |
| | XbaI | NUE588_NR_XbaI | ATTCTAGACTAA TCTCTCTCCCTC CCTCC | 2699 | NUE588_NR_XbaI | ATTCTAGACTA ATCTCTCTCCC TCCCTCC | 2945 | |
| NUE591 | | | | | 35S_1F | GGAGAGGACA GGCTTCTTGAG | 2946 | |
| GA | | | | | NUE591_GA_R | CTCTTGCAGCT CTTGATCTTC | 2947 | |
| NUE206 | XbaI, | NUE206_EF_XbaI | ATTCTAGAATTT ACACAGACTTG TCGCTCTC | 2700 | 35S_1F | GGAGAGGACA GGCTTCTTGAG | 2948 | pGN |
| | SalI | NUE206_ER_XbaI | TATCTAGACTTC TGATTCAGTGAC TGTGAGC | 2701 | NUE206_NR_XbaI | TATCTAGATCA TCAGTGACTGT GAGCCTCGT | 2949 | |
| | | NUE206_NF_SalI | ATAGTCGACAA CAATGGACAAA TTTTGGAC | 2702 | | | | |
| | | NUE206_NR_XbaI | TATCTAGATCAT CAGTGACTGTG AGCCTCGT | 2703 | | | | |
| NUE208 | XbaI, | NUE208_EF_XbaI | AATCTAGACTG AAAGAGAGAGA GGTATGGC | 2704 | 35S_1F | GGAGAGGACA GGCTTCTTGAG | 2950 | pGN |
| | SacI | NUE208_ER_SacI | TGAGCTCTGAAT TAGTCATCTATT GGGTCC | 2705 | NUE208_NR_SacI | TGAGCTCTTAT TAGTCATCTAT TGGGTCCTGAG | 2951 | |
| | | NUE208_NF_XbaI | TATCTAGAAAC AATGGCAGGTG AGGCAACTC | 2706 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | NUE208_NR_SacI | TGAGCTCTTATT AGTCATCTATTG GGTCCTGAG | 2707 | | | | |
| NUE209 | SalI, | NUE209_EF_SalI | AATGTCGACTTT GTGATGACCCTT TTAAGG | 2708 | 35S_1F | GGAGAGGACA GGCTTCTTGAG | 2952 | pGN |
| | XbaI | NUE209_ER_XbaI | ATTCTAGAGGT AGTTAGCCGGT CATGTTG | 2709 | NUE209_NR_XbaI | ATTCTAGATTA TTAGCCGGTCA TGTTGTAGTC | 2953 | |
| | | NUE209_NF_SalI | AATGTCGACAA CAATGGATTGG GAAAAACAGC | 2710 | | | | |
| | | NUE209_NR_XbaI | ATTCTAGATTAT TAGCCGGTCAT GTTGTAGTC | 2711 | | | | |
| NUE210 | SalI | NUE210_EF_SalI | TGAGTCGACGT CTTGAAATGTTT GGTGGGT | 2712 | 35S_1F | GGAGAGGACA GGCTTCTTGAG | 2954 | pGN |
| | XbaI | NUE210_ER_XbaI | TGTCTAGACTA CTTGCCCTTTGC TTATGA | 2713 | NUE210_R_XbaI | TATCTA- GACTTA TGCTATGAGG AAAGAAACT AAGC | 2955 | |
| | | NUE210_NF_SalI | AATGTCGACAA CAATGTTTGGTG GGTTCAATGTG | 2714 | | | | |
| | | NUE210_NR_Xba | TGTCTAGACTAT GCTATGAGGAAC | 2715 | | | | |
| NUE211 GeneArt | | | | | 35S_1F NOS_R | GGAGAGGACA GGCTTCTTGAG GCGGGACTCT AATCATAAAA ACC | 2956 2957 | |
| NUE212 | XbaI | NUE212_EF_XbaI | ATTCTAGAATAT CATAATGAAAG GGATTCG | 2716 | 35S_1F | GGAGAGGACA GGCTTCTTGAG | 2958 | pGN |
| | SacI | NUE212_ER_SacI | TGAGCTCTTAT AGAACCGAGAC TGAAG | 2717 | NUE212_NEW_NR_ SacI | TGAGCTC- CCATT TAGAACCGAG ACTGAAGATA CTTA | 2959 | |
| | | NUE212_NF_XbaI | TATCTAGAAAC AATGAAAGGGA TTCGCTCC | 2718 | | | | |
| | | NUE212_NR_SacI | TGAGCTCTTATT AGAACCGAGAC TGAAGATACTT A | 2719 | | | | |
| NUE221 | EcoR V | NUE221_EF_EcoRV | AAGATATCAAT GACTTTCCCCAT CTATCC | 2720 | 35S_1F | GGAGAGGACA GGCTTCTTGAG | 2960 | pKSJ |
| | | NUE221_ER_EcoRV | ACGATATCAAT CGACCAACAAC TAACATTAC | 2721 | NUE221_NR_EcoRV | ATGATATCCAT TACATGTGTGT ATCCGACG | 2961 | |
| | | NUE221_NF_EcoRV | AAGATATCCTTC TAATAATCAAC CGACAGG | 2722 | | | | |
| | | NUE221_NR_EcoRV | ATGATATCCATT ACATGTGTGTAT CCGACG | 2723 | | | | |
| NUE222 | SalI, | NUE222_EF_SalI | ATAGTCGACGG GAAGTATCATT AGTTCATTACC | 2724 | NUE222_seq_F1 | AGTTGCATCGA TCTTGATCTTG | 2962 | pGN |
| | XbaI | NUE222_ER_XbaI | TATCTAGACTAG TATCCCTAACGT AACAAAGACTC | 2725 | 101_ER | CTGCAAGGCG ATTAAGTTGG | 2963 | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | NUE222_NF_SalI | AATGTCGACTTA CCATGGGAGAC TATAACATG | 2726 | | | | |
| | | NUE222_NR_XbaI | TATCTAGACTAC TAACGTAACAA AGACTCTTCACA | 2727 | | | | |
| NUE229 | XbaI | NUE229_EF_XbaI | TATCTAGACTGT CTGTTTGCCTGT CGAG | 2728 | NUE229_seq_F1 | CTTCATGACG GCAAGGTTAG | 2964 | pGN |
| | SmaI | NUE229_ER_SmaI | TCCCGGGATACT CAAATCAAATG AAAGTCCG | 2729 | 101_ER | GAAACACCAT | 2965 | |
| | | NUE229_NF_XbaI | CATCTAGACAA CAATGGCGAGG ATGATC | 2730 | | | | |
| | | NUE229_NR_SmaI | TCCCGGGTTAG ATAGAAGTTTAT CCCATCAGGG | 2731 | | | | |
| NUE254 | SalI | NUE254_EF_SalI | AATGTCGACAG TCTGCACTGGA AGGACAG | 2732 | NUE254_NF_SalI | AATGTCGACCT GGAAGGACAG CATGTCG | 2966 | pGN |
| | XbaI | NUE254_ER_XbaI | TATCTAGACTTG TTGCCAGCATCT CTTATG | 2733 | 101_R | AAGTTGGGTA ACGCCAGGGT | 2967 | |
| | | NUE254_NF_SalI | AATGTCGACCT GGAAGGACAGC ATGTCG | 2734 | | | | |
| | | NUE254_NR_XbaI | TATCTAGACTAT GACTAGCTGAT GGAGTCCTCC | 2735 | | | | |
| NUE267 | | NUE267_F | CTTCTTCAATGG CGACGG | 2736 | NUE267_F | CTTCTTCAATG GCGACGG | 2968 | Topo |
| | | NUE267_R | TAGTCATGCAA ATATTTAATCTT GGAACCC | 2737 | 101_ER | GAAACACCAT CTTCGTTCTTG | 2969 | |
| NUE519 | SalI, | NUE519_NF_SalI | TTAGTCGACTTA AGATGGCCAAG GTTAACG | 2738 | NUE519_NF_SalI | TTAGTCGACTT AAGATGGCCA AGGTTAACG | 2970 | pGN |
| | XbaI | NUE519_NR_XbaI | TATCTAGACTAA TGCCGTTGCTTC TAGTAATAG | 2739 | 101_ER | CTGCAAGGCG ATTAAGTTGG | 2971 | |
| NUE549 | XbaI, | NUE549_EF_XbaI | TATCTAGATCCT CTCCCTAGCTAG CAAG | 2740 | NUE549_seq_F3 | CAGCTGTGGA AGGCATCAAC | 2972 | pGN |
| | SacI | NUE549_ER_SacI | TGAGCTCCTAAT CACCCTGGCTGT TGAC | 2741 | 101_R | AAGTTGGGTA ACGCCAGGGT | 2973 | |
| | | aNUE54a9_NF_aXbaI | TATCTAGATCCC TAGCTAGCAAG CTCTAG | 2742 | | | | |
| | | aNUE54a9_NR_SaacI | TGAGCTCCCTTA ATGCCATGCTGC G | 2743 | | | | |
| NUE572 | XbaI, | NUE572_NF_XbaI | ATTCTAGATACA TCGTCTTCACCT AATTTTC | 2744 | 355_1F | GGAGAGGACA GGCTTCTTGAG | 2974 | pGN |
| | SacI | NUE572_NR_SacI | CGAGCTCAACA AGCAAACTAAA CGTGAAC | 2745 | NUE572_NR_SacI | CGAGCTCAAC AAGCAAACTA AACGTGAAC | 2975 | |
| NUE592 | EcoRV | NUE592_EF_EcoRV | ATGATATCAAA TCCGGTGGAC | 2746 | 35S_1F | GGAGAGGACA GGCTTCTTGAG | 2976 | pKSJ |
| | | NUE592_ER_EcoRV | TAGATATCCAA CACTCACTAGG GAGCACAG | 2747 | NUE592_NR_EcoRV | TAGATATCGTT GAACGCTCCA CATCATG | 2977 | |
| | | NUE592_NF_EcoRV | TAGATATCAGA ATTCGCAGGGA TGCC | 2748 | | | | |
| | | NUE592_NR_EcoRV | TAGATATCGTTG | 2749 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | | | AACGCTCCACA TCATG | | | | | |
| NUE248 | XbaI, | NUE248_NF_XbaI | GCTCTAGAAGG CGAGATGTGGG AGTC | 2750 | NUE248_NF_XbaI | GCTCTAGAAG GCGAGATGTG GGAGTC | 2978 | pGN |
| | SacI | NUE248_NR_SacI | TGAGCTCCTACT AGGCCTTCTCCT TTGTTG | 2751 | NOS_R | GCGGGACTCT AATCATAAAA ACC | 2979 | |
| NUE590 | SacI | NUE590_EF_XbaI | AATCTAGACAA CTGCAACTGCA ACTAGC | 2752 | 35S_1F | GGAGAGGACA GGCTTCTTGAG | 2980 | TopoB |
| | | NUE590_ER_SacI | CGAGCTCACAG CTAAACATCAA TCCTCTTC | 2753 | | | | |
| | | NUE590_NF_SacI | TGAGCTCTGCA AGCAATCACCA GTTTG | 2754 | NUE590_NR_SacI | TGAGCTCCTCA TTTTATTTGCT GCGTG | 2981 | |
| | | NUE590_NR_SacI | TGAGCTCCTCAT TTTATTTGCTGC GTG | 2755 | | | | |
| NUE245 GA | | | | | 35S_1F | GGAGAGGACA GGCTTCTTGAG | 2982 | |
| | | | | | NUE245_GA | CTCGGTGTTCT TGATGGTCAC | 2983 | |
| NUE520 GA | | | | | 35S_1F | GGAGAGGACA GGCTTCTTGAG | 2984 | |
| | | | | | NUE520_GAR2 | TTCTTGACCTT GGTCAGCTTG | 2985 | |
| NUE574 | SmaI | NUE574_EF_SmaI | Agattagtcccaaa gattattcg | 2756 | 35S_1F | GGAGAGGACA GGCTTCTTGAG | 2986 | Topo |
| | | NUE574_ERSmaI | Gacattgtggggaa gctact | 2757 | NUE574_NR_SmaI | gcatgtaat-tgt agctttcttttt | 2987 | |
| | | NUE574_NF_SmaI | Gatacaaagaattc gctttgc | 2758 | | | | |
| | | NUE574_NR_SmaI | gcatgtaattgtag cttttctttt | 2759 | | | | |
| NUE224 | XbaI, | NUE224_EF_XbaI | TATCTAGAGTTT GCTTGCTTACCA GGAG | 2760 | p35S_F1 | GGAGAGGACA GGCTTCTTGAG | 2988 | pGXN |
| | SmaI | NUE224_ER_SmaI | TCCCGGGTTAGC AGCATCGATCG TACACTAG | 2761 | NUE224_ER_SmaI | TCCCGGGTTAG CAGCATCGATC GTACACTAG | 2989 | |
| NUE225 | SalI, | NUE225_NF_SalI | AATGTCGACGA GTTTACAAGAG ACCCAGACG | 2762 | p35S_F1 | GGAGAGGACA GGCTTCTTGAG | 2990 | pGXN |
| | XbaI | NUE225_NR_XbaI | ACTCTAGAATTC AGTCATAGATC GCCTTG | 2763 | NUE225_NR_XbaI | ACTCTAGAATT CAGTCATAGAT CGCCTTG | 2991 | |
| NUE230 GA | | | | | p35S_F1 | GGAGAGGACA GGCTTCTTGAG | 2992 | |
| | | | | | NUE230_GA_R1 | GGATCTTGATG TACACGTTTGG | 2993 | |
| NUE234 GA | | | | | p35S_F1 | GGAGAGGACA GGCTTCTTGAG | 2994 | |
| | | | | | NUE234_GA_R1 | CGATGTTGCAC CTCTTTGG | 2995 | |
| NUE239 GA | | | | | p35S_F1 | GGAGAGGACA GGCTTCTTGAG | 2996 | |
| | | | | | NUE239_GA_R1 | CGAAATCCTCT GGGAATGAC | 2997 | |
| NUE240 GA | | | | | p35S_F1 | GGAGAGGACA GGCTTCTTGAG | 2998 | |
| | | | | | NUE240_GA_R1 | CCTCAGTAGA GAGAGACTCG TCG | 2999 | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| NUE246 | | | | | p35S_F1 | GGAGAGGACA GGCTTCTTGAG | 3000 | |
| GA | | | | | NUE246_GA_R1 | CAACACTTGCA TCACCCTAGTC | 3001 | |
| NUE249 | | | | | p35S_F1 | GGAGAGGACA GGCTTCTTGAG | 3002 | |
| GA | | | | | NUE249_GA_R1 | CCACCTCAAG AACAGTAACG AG | 3003 | |
| NUE250 | | | | | p35S_F1 | GGAGAGGACA GGCTTCTTGAG | 3004 | |
| GA | | | | | NUE250_GA_R1 | GAAGGTAGAG TGCAGCATGG | 3005 | |
| NUE252 | XbaI, | NUE252_EF_XbaI | TATCTAGATTGG TCACAGGGGAT AGGC | 2764 | p35S_F1 | GGAGAGGACA GGCTTCTTGAG | 3006 | pGXN |
| | SacI | NUE252_ER_SacI | TGAGCTCCTAA GATGCTGCTTTC TATGCCAAAG | 2765 | NUE252_NR_SacI | TGAGCTCCTAC TCAGACTATG AACCTTCATG | 3007 | |
| | | NUE252_NF_XbaI | TATCTAGAGAA ATTGTGTTTGTT TGATGGG | 2766 | | | | |
| | | NUE252_NR_SacI | TGAGCTCCTACT ATGCCAAAGAA CCTTCATG | 2767 | | | | |
| NUE265 | XbaI, | NUE265_NF_XbaI | TATCTAGAGAG AAATGACAAGT GTCTGGAAG | 2768 | p35S_F1 | GGAGAGGACA GGCTTCTTGAG | 3008 | pGXN |
| | SacI | NUE265_NR_SacI | TGAGCTCGGAG TGATCACTACTG CTTCTCC | 2769 | NUE265_NR_SacI | TGAGCTCGGA GTGATCACTAC TGCTTCTCC | 3009 | |
| NUE268 | SalI | NUE268_NF_SalI | AATGTCGACTG AAGATGGCTGA CGATTTG | 2770 | p35S_F1 | GGAGAGGACA GGCTTCTTGAG | 3010 | pGXN |
| | XbaI | NUE268_NR_XbaI | TATCTAGACTAG TCTTAGCCACCA CCAGAAC | 2771 | NUE268_NR_XbaI | TATCTAGACTA GTCTTAGCCAC CACCAGAAC | 3011 | |
| NUE514 | XbaI, | NUE514_EF_XbaI | AATCTAGAGGA TTGAGACATGC ACTTAACAG | 2772 | p35S_F1 | GGAGAGGACA GGCTTCTTGAG | 3012 | pGXN |
| | SacI | NUE514_ER_SacI | TGAGCTCTTTTG AGCACCTCTTAT TTAGC | 2773 | NUE514_NR_SacI | TGAGCTCCTAC AATACACCTCT TGACATCCTTC | 3013 | |
| | | NUE514_NF_XbaI | AATCTAGAACT CATCAGCAACT ACAACGTG | 2774 | | | | |
| | | NUE514_NR_SacI | TGAGCTCCTACA ATACACCTCTTG ACATCCTTC | 2775 | | | | |
| NUE515 | SalI, | NUE515_NF_SalI | TAAGTCGACGA TACAATGAGAA TGTTAGTTCTTC G | 2776 | p35S_F1 | GGAGAGGACA GGCTTCTTGAG | 3014 | pGXN |
| | XbaI | NUE515_NR_XbaI | TATCTAGATCAT CACCATCGTCTT ATCAATGAAG | 2777 | NUE515_NR_XbaI | TATCTAGATCA TCACCATCGTC TTATCAATGAA G | 3015 | |
| NUE523 | SmaI, | NUE523_EF_SmaI | ACCCGGGTCGT CTCATCAATTCA AGATCC | 2778 | p35S_F1 | GGAGAGGACA GGCTTCTTGAG | 3016 | Topo |
| | SacI | NUE523_ER_SacI | TGAGCTCCCCTT CAAACTAATCA ATCTTG | 2779 | NUE523_ER_SacI | TGAGCTCCCCT TCAAACTAATC AATCTTG | 3017 | |
| NUE525 | | | | | p35S_F1 | GGAGAGGACA GGCTTCTTGAG | 3018 | pQXYN |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| GA | | | | | NUE525_GA_R | GTACTGAAGCT CGTCCTGGAC | 3019 | |
| NUE527 | XbaI | NUE527_EFXbaI | AATCTAGAAAG AGCACCACCAG AGCAG | 2780 | p35S_F1 | GGAGAGGACA GGCTTCTTGAG | 3020 | pKSJ |
| | EcoRV | NUE527_ER_EcoRV | TTGATATCCTTT ATGTCACCATTC ATCTCAG | 2781 | NUE527_ER_EcoRV | TTGATATCCTT TATGTCACCAT TCATCTCAG | 3021 | |
| NUE532 | XbaI, | NUE532_EF_XbaI | AATCTAGACTG GTTTAGGAGAC GAAAAGG | 2782 | p35S_F1 | GGAGAGGACA GGCTTCTTGAG | 3022 | pGXN |
| | SacI | NUE532_ER_SacI | AGAGCTCCTATC TCAACTCCATCG CCTCAG | 2783 | NUE532_NR_SacI | AGAGCTCCTAC TACTCAACTTC TCTGATGATTC TC | 3023 | |
| | | NUE532_NF_XbaI | AATCTAGAAGT GCTCTCCGGTTT GAGG | 2784 | | | | |
| | | NUE532_NR_SacI | AGAGCTCCTACT ACTCAACTTCTC TGATGATTCTC | 2785 | | | | |
| NUE533 | | | | | p35S_F1 | GGAGAGGACA GGCTTCTTGAG | 3024 | pQXYN |
| GA | | | | | NUE533_GA_R | GGTTAGACAC GAGCTTCTCAG AC | 3025 | |
| NUE536 | XbaI, | NUE536_EF_XbaI | ATTCTAGAGCCT TCTGATTCCCAC TCC | 2786 | p35S_F1 | GGAGAGGACA GGCTTCTTGAG | 3026 | pGXN |
| | SacI | NUE536_ER_SacI | TGAGCTCTGGA GTATCTGGTTTA GTTCGTC | 2787 | NUE536_NR_SacI | CGAGCTCAAA GTCTCACTCCG CACTACAC | 3027 | |
| | | NUE536_NF_XbaI | AATCTAGACCT ACTATACTTGCA ACCTCTCC | 2788 | | | | |
| | | NUE536_NR_SacI | CGAGCTCAAAG TCTCACTCCGCA CTACAC | 2789 | | | | |
| NUE547 | | | | | p35S_F1 | GGAGAGGACA GGCTTCTTGAG | 3028 | pQXYN |
| GA | | | | | NUE547_GA_R | GTGTGCAGCTC GAACTTGG | 3029 | |
| NUE550 | SmaI | NUE550_EF_SmaI | ACCCGGGGTAA CACTATCAAGA GACGATGAAG | 2790 | p35S_F2 | GGACAGGCTT CTTGAGATCCT | 3030 | pKSJ |
| | | NUE550_ER_SmaI | TCCCGGGGTTTA CATTGTTCTCGT TTCAAATC | 2791 | NUE550_NR_SmaI | TCCCGGGAATC TTTATTAACGA AACAGCAG | 3031 | |
| | | NUE550_NF_SmaI | ACCCGGGCTAT CAAGAGACGAT GAAGGTTG | 2792 | | | | |
| | | NUE550_NR_SmaI | TCCCGGGAATCT TTATTAACGAA ACAGCAG | 2793 | | | | |
| NUE564 | XbaI, | NUE564_EF_XbaI | AATCTAGACTTC AAGCAGGCAGC ACAC | 2794 | p35SF1 | GGAGAGGACA GGCTTCTTGAG | 3032 | pGXN |
| | SacI | NUE564_ER_SacI | CGAGCTCAAAG GGTCCATCATA ATCACAG | 2795 | NUE564_NR_SacI | TGAGCTCCTAC ATGTCCCTTAG ATTGCTCTATT C | 3033 | |
| | | NUE564_NF_XbaI | TATCTAGAGGA AACCTTGAGCC ATGG | 2796 | | | | |
| | | NUE564_NR_SacI | TGAGCTCCTACA TGTCCCTTAGAT TGCTCTATTC | 2797 | | | | |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| NUE576 | SalI, | NUE576_EF_SalI | AAAGTCGACAG GAACAGCAACA AAAGTAAGC | 2798 | p35S_F1 | GGAGAGGACA GGCTTCTTGAG | 3034 | pGXN |
| | SmaI | NUE576_ER_SmaI | TCCCGGGCTAA ACTGTCCCATTC TCTAGAGCTTG | 2799 | NUE576_NR_SmaI | TCCCGGGCTAA GTAGCATGAG TGCGTGG | 3035 | pGXN |
| | | NUE576_NF_SalI | AAAGTCGACCA ACAACCACACA CACTCACAG | 2800 | | | | |
| | | NUE576_NR_SmaI | TCCCGGGCTAA GTAGCATGAGT CTAGAGCTTGG | 2801 | | | | |
| NUE579 | SalI, | NUE579_NF_SalI | AATGTCGACTCT CAAAACCCTAA CTGTTTCC_ | 2802 | p35S_F1 | GGAGAGGACA GGCTTCTTGAG | 3036 | pGXN |
| | XbaI | NUE579_NR_XbaI | ATTCTAGACAG GATAATAGATA GTCACACGAGG | 2803 | NUE579_NR_XbaI | ATTCTAGACAG GATAATAGAT AGTCACACGA GG | 3037 | |
| NUE581 | SalI, | NUE581_EF_SalI | AAAGTCGACCA AAAGAATCTGT CTTCTTCTCTG | 2804 | p35S_F1 | GGAGAGGACA GGCTTCTTGAG | 3038 | pGXN |
| | XbaI | NUE581_ER_XbaI | ATTCTAGACTAT CCAAGAAGGAA CAATGAGG | 2805 | NUE581_NR_XbaI | ACTCTAGATTA GAACCACAAA AGATTACAAC ATC | 3039 | |
| | | NUE581_NF_SalI | AAAGTCGACGG TAAAATATCTTT CTTGTGCAG | 2806 | | | | |
| | | NUE581_NR_XbaI | ACTCTAGATTAG AACCACAAAAG ATTACAACATC | 2807 | | | | |
| MAB52 GA | | | | 6669 | F MAB52_R_Seq | TCAGCCACCCA AACCATGAC GAAGTCCTGAG ACCGTTGATAG | 3040 3041 | pGN |
| MAB106 | EcoRV, | MAB106_EF | GTTCCAGTTGAG CGAGCAG | 2808 | T7_1 | TACGACTCACT ATAGGGCGA | 3042 | pGN |
| | | MAB106_ER_EcoRV | TTGATATCCCAG TCTGTTTATTGC ATCATC | 2809 | MAB106_NR_EcoRV | AAGATATCGT GCTAAACTATA CATCAAACGT G | 3043 | |
| | PstI | MAB106_NF_PstI | AACTGCAGGAT CATCCTCACATT GCGAG | 2810 | | | | |
| | | MAB106_NR_EcoRV | AAGATATCGTG CTAAACTATAC ATCAAACGTG | 2811 | | | | |
| NUE251 GA | | | | | 35S_1F NUE251_GA_R | GGAGAGGACA GGCTTCTTGAG GAAGTACCAC CAGTTGAAGA AGC | 3044 3045 | |
| NUE545 | SalI, | NUE545_NF_SalI | TATGTCGACAG GTTATGGGGAA GAAGCTAG | 2812 | NUE545_F | GCAACAATTGT GGAGTCAACA C | 3046 | pGXN |
| | XbaI | NUE545_NR_XbaI | TATCTAGATCAT CAGTAGCCACG AACTTGTCTAG | 2813 | 101_R | AAGTTGGGTA ACGCCAGGGT | 3047 | |
| NUE570 | Sal, | NUE570_NFSal | TTCGTCGACTAA GCACAAATGGC GACTC | 2814 | NUE570 SeqF | CTTTGAGACGT TAGCTGTTGAG | 3048 | pKSJ |
| | Sma | NUE570 NRSma | ACCCGGGTCAA GGAGCTGAAAC ACTAGAGTTACT | 2815 | 101_R | AAGTTGGGTA ACGCCAGGGT | 3049 | |
| NUE571 | Sal, | NUE571_NF_Sal | GTAGTCGACTTC ACATGGGAAAG | 2816 | NUE571_NF_Sal | GTAGTCGACTT CACATGGGAA | 3050 | pGXN |

TABLE 22-continued

PCR primers used for cloning and for screening positive clones

| Gene ID | Enz. | Primers for cloning | | SEQ ID NO: | Primers for screening | | SEQ ID NO: | Plas. |
|---|---|---|---|---|---|---|---|---|
| | Xba | NUE571 NRXba | GATAAGAC AATCTAGATCA CTGATATAGTCC ACGTCCTAAGG | 2817 | 101_R | AGGATAAGAC AAGTTGGGTA ACGCCAGGGT | 3051 | |
| NUE578 | XbaI, | NUE578_EF_XbaI | AATCTAGAATA TCCTCCCATTCT CATTCTG | 2818 | 35S_1F | GGAGAGGACA GGCTTCTTGAG | 3052 | pGXN |
| | SmaI | NUE578_ER_SmaI | TCCCGGGCTAAT GCAATCTCCAA CTCCAAG | 2819 | NUE578_NR_SmaI | TCCCGGGCTAA GAAAAGGTAG GAGAAGGAAG G | 3053 | |
| | | NUE578_NF_XbaI | AATCTAGAAGC GGAGAAGAGGA AGGAG | 2820 | | | | |
| | | NUE578_NR_SmaI | TCCCGGGCTAA GAAAAGGTAGG AGAAGGAAGG | 2821 | | | | |
| NUE580 | XbaI, | NUE580_NF_XbaI | AATCTAGACGG AATATACATTTG CTTTGTG | 2822 | 35S_1F | GGAGAGGACA GGCTTCTTGAG | 3054 | pGXN |
| | SmaI | NUE580_NR_SmaI | TCCCGGGCTACT GCTGAATGCTCT CTTTGC | 2823 | NUE580_NR_SmaI | TCCCGGGCTAC TGCTGAATGCT CTCTTTGC | 3055 | |
| NUE582 | XbaI, | NUE582_NF_XbaI | AATCTAGAAAT CATCCTTCCCCA ACCTC | 2824 | 35S_1F | GGAGAGGACA GGCTTCTTGAG | 3056 | pGXN |
| | SmaI | NUE582_NR_SmaI | CCCCGGGACCC AAACAGTCATG CTAGG | 2825 | NUE582_NR_SmaI | CCCCGGGACC CAAACAGTCA TGCTAGG | 3057 | |
| NUE584 | SalI, | NUE584_NF_SalI | AAAGTCGACAA GGTTGGAGATT GTGAAATTG | 2826 | 35S_1F | GGAGAGGACA GGCTTCTTGAG | 3058 | pGXN |
| | SacI | NUE584_NR_SacI | CGAGCTCATACT CTACGTTCCCGT GTGG | 2827 | NUE584_NR_SacI | CGAGCTCATAC TCTACGTTCCC GTGTGG | 3059 | |
| NUE593 GA | | | | | 35S_1F NUE593_GA_R | GGAGAGGACA GGCTTCTTGAG GTAGCCTGAA CAGCAGAACC | 3060 3061 | |
| CT1 | SmaI | Reverse | AAGTTGGGTAA CGCCAGGGT | 2828 | | | | pKS |
| | SacI | Forward | GGTGGCTCCTAC AAATGCCATC | 2829 | | | | |
| CT11 | SmaI | Reverse | AAGTTGGGTAA CGCCAGGGT | 2830 | | | | pKS |
| | SacI | Forward | GGTGGCTCCTAC AAATGCCATC | 2831 | | | | |
| CT2 | XbaI | Reverse | AAGTTGGGTAA CGCCAGGGT | 2832 | | | | pKS |
| | | Forward | ATGGGGCAACA TCACTTGGG | 2833 | | | | |
| CT20 | SmaI | Reverse | AAGTTGGGTAA CGCCAGGGT | 2834 | | | | pKS |
| | SacI | Forward | GGTGGCTCCTAC AAATGCCATC | 2835 | | | | |
| CT22 | SmaI | Reverse | AAGTTGGGTAA CGCCAGGGT | 2836 | | | | pKS |
| | SacI | Forward | GGTGGCTCCTAC AAATGCCATC | 2837 | | | | |
| CT27 | SmaI | Reverse | AAGTTGGGTAA CGCCAGGGT | 2838 | | | | pKS |
| | EcoRV | Forward | GGTGGCTCCTAC AAATGCCATC | 2839 | | | | |

TABLE 22-continued

PCR primers used for cloning and for screening positive clones

| Gene ID | Enz. | Primers for cloning | | SEQ ID NO: | Primers for screening | SEQ ID NO: | Plas. |
|---|---|---|---|---|---|---|---|
| CT3 | SmaI | Reverse | AAGTTGGGTAA CGCCAGGGT | 2840 | | | pKS |
| | SacI | Forward | GGTGGCTCCTAC AAATGCCATC | 2841 | | | |
| CT40 | SmaI | Reverse | AAGTTGGGTAA CGCCAGGGT | 2842 | | | pKS |
| | SacI | Forward | GGTGGCTCCTAC AAATGCCATC | 2843 | | | |
| CT6 | SmaI | Reverse | AAGTTGGGTAA CGCCAGGGT | 2844 | | | pKS |
| | SacI | Forward | GGTGGCTCCTAC AAATGCCATC | 2845 | | | |
| CT7 | SmaI | Reverse | AAGTTGGGTAA CGCCAGGGT | 2846 | | | pKS |
| | EcoRV | Forward | GGTGGCTCCTAC AAATGCCATC | 2847 | | | |
| CT71 | XbaI | Reverse | AAGTTGGGTAA CGCCAGGGT | 2848 | | | |
| | SacI | Forward | GGTGGCTCCTAC AAATGCCATC | 2849 | | | |
| CT74 | SmaI | Reverse | AAGTTGGGTAA CGCCAGGGT | 2850 | | | pKS |
| | SacI | Forward | GGTGGCTCCTAC AAATGCCATC | 2851 | | | |
| CT75 | SmaI | Reverse | AAGTTGGGTAA CGCCAGGGT | 2852 | | | pKS |
| | EcoRV | Forward | GGTGGCTCCTAC AAATGCCATC | 2853 | | | |
| CT76 | SmaI | Reverse | AAGTTGGGTAA CGCCAGGGT | 2854 | | | pKS |
| | SacI | Forward | GGTGGCTCCTAC AAATGCCATC | 2855 | | | |
| CT81 | SmaI | Reverse | AAGTTGGGTAA CGCCAGGGT | 2856 | | | pKS |
| | SacI | Forward | GGTGGCTCCTAC AAATGCCATC | 2857 | | | |
| CT82 | SmaI | Reverse | AAGTTGGGTAA CGCCAGGGT | 2858 | | | pKS |
| | SacI | Forward | GGTGGCTCCTAC AAATGCCATC | 2859 | | | |

Table 22: Provided are the sequences of the primers used for cloning the indicated genes and for screening of cloned binary plasmids. Primers are provided from 5' → 3'. "EF" = external forward primer; "ER" external reverse primer; "NF" nested forward primer; "NR" nested reverse primer. Unless indicated otherwise, all genes were cloned from RNA molecules. "GA" = GeneArt, synthetically prepared genes; "Enz." = Enzyme; "Plas." = Plasmid.

Each digested PCR product was inserted into a high copy vector originated from pBlue-script KS plasmid vector (pBlue-script KS plasmid vector, Hypertext Transfer Protocol://World Wide Web (dot) stratagene (dot) com/manuals/212205 (dot) pdf). In case of the high copy vector originated from pBlue-script KS plasmid vector (pGN) PCR product was inserted in the high copy plasmid upstream to the NOS terminator (SEQ ID NO:3064) originated from pBI 101.3 binary vector (GenBank Accession No. U12640, nucleotides 4417 to 4693). In other cases the PCR product was inserted into the pCR®-BluntII-TOPO® high copy vector (ZeroBlunt® TOPO® PCR cloning Kit, Invitrogen). Some of the genes were synthetically synthesized ordered from a commercial supplier (GeneArt, GmbH) those genes were received into the pQXYN, pGXN high copy vectors obtained from the suppliers.

Sequencing of the inserted genes was performed, using the ABI 377 sequencer (Applied Biosystems). In some cases, after confirming the sequences of the cloned genes, the cloned cDNA accompanied with the NOS terminator was introduced into the binary vectors pGI containing the 35S promoter via digestion with appropriate restriction endonucleases. In other cases the cloned cDNA accompanied with the 35S promoter was introduced into the pGI vector. In any case the insert was followed by single copy of the NOS terminator (SEQ ID NO:

3064). The digested products and the linearized plasmid vector were ligated using T4 DNA ligase enzyme (Roche, Switzerland)

For some of the cloned polynucleotides, instead of amplifying the sequence from cDNA, synthetic sequences were ordered from a commercial supplier (GeneArt, GmbH). Thus, no primers were used for the amplification of the synthetic genes. To optimize the coding sequences of the synthetic genes, codon-usage Tables calculated from plant transcriptomes were used (example of such Tables can be found in the Codon Usage Database available online at Hypertext Transfer Protocol://World Wide Web (dot) kazusa (dot) or (dot) jp/codon/). The optimized coding sequences is designed in a way that no changes are introduced in the encoded amino acid sequence while using codons preferred for expression in dicotyledonous plants mainly tomato and *Arabidopsis*; and monocotyledonous plants such as maize. Such optimized sequences promote better translation rate and therefore higher protein expression levels. To the optimized sequences flanking additional unique restriction enzymes sites were added- to facilitate the cloning of the genes into the binary vectors.

The pPI and pGI binary vector plasmids were used to introduce the gene constructs into plants. pPI plasmid was constructed by inserting a synthetic poly-(A) signal sequence, originating from pGL3 basic plasmid vector (Promega, Acc. No. U47295; by 4658-4811) into the HindIII restriction site of the binary vector pBI101.3 (Clontech, Acc. No. U12640). In some cases the backbone binary plasmid used was pGI which is similar to pPI but the GUS gene was replaced by the GUS-Intron gene (Vancanneyt. G, et al MGG 220, 245-50, 1990). pPI or pGI plasmid was used to clone the polynucleotide sequences, initially under the control of 35S promoter [Odell, J T, et al. Nature 313, 810-812 (28 Feb. 1985); SEQ ID NO: 3063] or *Arabidopsis thaliana* promoter At6669 (SEQ ID NO:3064, PCT Publication No. WO2004/104162). The At6669 or the CaMV 35S promoter sequence (set forth in SEQ ID NO: 3063) is inserted in the pPI or pGI binary vector, upstream to the cloned genes by using the restriction enzymes HindIII and SalI or BamHI (Roche, Switzerland). The digested PCR product and the linearized plasmid vector were ligated using T4 DNA ligase enzyme (Roche, Switzerland), as described above.

60 μL of *E. coli*, strain DH5-α competent cells (about $10^9$ cells/mL) were transformed using 1 μl of ligation reaction mixture by electroporation, using a MicroPulser electroporator (Biorad), 0.2 cm cuvettes (Biorad) and EC-2 electroporation program (Biorad). *E. coli* cells were grown on 0.8 mL LB liquid medium at 37° C. for 1 hrs and 0.2 mL of the cell suspension were plated on LB-agar plates supplemented with the antibiotics kanamycin 50 mg/L (Sigma). Plates were then incubated at 37° C. for 16 hrs. Bacteria colonies were grown and expression was confirmed by PCR amplification using the primers sets detailed in Table 22, above, which were designed to span the inserted sequence in the binary vector.

PCR products were separated on 1.5% agarose gels and product sizes were estimated by comparing to DNA ladder (MBI Fermentas).

TABLE 23

Cloned sequences

| SEQ ID NO: of cloned or synthetic gene | Gene Name | SEQ ID NO: of the encoded polypeptide | Cluster | Cloning Method |
|---|---|---|---|---|
| 2398 | CT1 | 2523 | cotton\|gb164\|AI725990_T1 | cloned |
| 2399 | CT11 | 2524 | cotton\|gb164\|AI725968_T1 | cloned |
| 2400 | CT2 | 2525 | cotton\|gb164\|AI727334_T1 | cloned |
| 2401 | CT20 | 2526 | cotton\|gb164\|AI726497_T1 | cloned |
| 2402 | CT22 | 2527 | cotton\|gb164\|BG440027_T1 | cloned |
| 2403 | CT27 | 2528 | cotton\|gb164\|AF336280_T1 | cloned |
| 2404 | CT3 | 144 | cotton\|gb164\|AI725456_T1 | cloned |
| 2405 | CT40 | 145 | cotton\|gb164\|BE052317_T1 | cloned |
| 2406 | CT6 | 2529 | cotton\|gb164\|AI726479_T1 | cloned |
| 2407 | CT7 | 147 | cotton\|gb164\|AI727027_T1 | cloned |
| 2408 | CT71 | 148 | cotton\|gb164\|AI725508_T1 | cloned |
| 2409 | CT74 | 149 | cotton\|gb164\|AI725950_T1 | cloned |
| 2410 | CT75 | 2530 | cotton\|gb164\|AI726599_T1 | cloned |
| 2411 | CT76 | 2531 | cotton\|gb164\|AI726155_T1 | cloned |
| 2412 | CT81 | 2532 | cotton\|gb164\|AI726693_T1 | cloned |
| 2413 | CT82 | 153 | cotton\|gb164\|BQ402794_T1 | cloned |
| 2414 | MAB106 | 154 | barley\|gb157.2\|AL450627_T1 | cloned |
| 2415 | MAB52 | 155 | rice\|gb157.2\|AU070543_T1 | synthesized_optimized |
| 2416 | NUE206 | 158 | arabidopsis\|gb165\|AT4G24960_T1 | cloned |
| 2417 | NUE208 | 2533 | tomato\|gb164\|BG124666_T1 | cloned |
| 2418 | NUE209 | 160 | tomato\|gb164\|BG134403_T1 | cloned |
| 2419 | NUE210 | 2534 | tomato\|gb157\|TOMTRALTAB_T1 | cloned |
| 2420 | NUE211 | 162 | rice\|gb157.2\|AU174544_T1 | synthesized_optimized |
| 2421 | NUE212 | 163 | cotton\|gb164\|CO081293_T1 | cloned |
| 2422 | NUE221 | 164 | rice\|gb157.2\|BI305241_T1 | cloned |
| 2423 | NUE222 | 165 | arabidopsis\|gb165\|AT1G31820_T1 | cloned |
| 2424 | NUE223 | 166 | rice\|gb157.2\|AW069985_T1 | cloned |
| 2425 | NUE224 | 167 | rice\|gb157.2\|AW155063_T1 | cloned |
| 2426 | NUE225 | 168 | rice\|gb157.2\|BE039221_T1 | cloned |
| 2427 | NUE227 | 169 | rice\|gb157.2\|AU056888_T1 | cloned |
| 2428 | NUE228 | 170 | rice\|gb157.2\|AA753730_T1 | synthesized_optimized |
| 2429 | NUE229 | 2535 | maize\|gb164\|AW455682_T1 | cloned |
| 2430 | NUE230 | 172 | rice\|gb157.2\|AA749861_T1 | synthesized_optimized |
| 2431 | NUE231 | 173 | rice\|gb157.2\|AK108994_T1 | synthesized_optimized |
| 2432 | NUE233 | 174 | rice\|gb157.2\|CB640732_T1 | cloned |
| 2433 | NUE234 | 175 | poplar\|gb157.2\|BU868634_T1 | synthesized_optimized |
| 2434 | NUE235 | 176 | soybean\|gb162\|CA852963_T1 | cloned |

TABLE 23-continued

Cloned sequences

| SEQ ID NO: of cloned or synthetic gene | Gene Name | SEQ ID NO: of the encoded polypeptide | Cluster | Cloning Method |
|---|---|---|---|---|
| 2435 | NUE237 | 177 | rice\|gb157.2\|BI811377__T1 | cloned |
| 2436 | NUE239 | 178 | poplar\|gb157.2\|BU880014__T1 | synthesized_optimized |
| 2437 | NUE240 | 179 | poplar\|gb157.2\|AJ407707__T1 | synthesized_optimized |
| 2438 | NUE241 | 180 | tomato\|gb164\|BG129806__T1 | cloned |
| 2439 | NUE242 | 2536 | tomato\|gb164\|BG791300__T1 | cloned |
| 2440 | NUE244 | 182 | soybean\|gb162\|CF808561__T1 | cloned |
| 2441 | NUE245 | 2537 | rice\|gb157.2\|AT003383__T1 | synthesized_optimized |
| 2442 | NUE246 | 184 | grape\|gb160\|CF207859__T1 | synthesized |
| 2443 | NUE248 | 2538 | maize\|gb157\|BG354535__T1 | cloned |
| 2444 | NUE249 | 186 | rice\|gb157.2\|AU029933__T1 | synthesized_optimized |
| 2445 | NUE250 | 187 | rice\|gb157.2\|AK102239__T1 | synthesized_optimized |
| 2446 | NUE251 | 188 | sorghum\|gb161.xeno\|AI947781__T1 | synthesized_optimized |
| 2447 | NUE252 | 189 | arabidopsis\|gb165\|AT1G58030__T1 | cloned |
| 2448 | NUE253 | 190 | rice\|gb157.2\|AF145730__T1 | cloned |
| 2449 | NUE254 | 2539 | maize\|gb164\|AI600563__T1 | cloned |
| 2450 | NUE255 | 2540 | rice\|gb157.2\|CB000630__T1 | cloned |
| 2451 | NUE256 | 193 | wheat\|gb164\|BE415875__T1 | synthesized_optimized |
| 2452 | NUE265 | 194 | rice\|gb157.2\|BE039218__T1 | cloned |
| 2453 | NUE267 | 195 | arabidopsis\|gb165\|AT5G60680__T1 | cloned |
| 2454 | NUE268 | 196 | rice\|gb157.2\|AA750934__T1 | cloned |
| 2455 | NUE269 | 2541 | cotton\|gb164\|AI730085__T1 | cloned |
| 2456 | NUE49 | 2542 | maize\|gb154\|AW037179__T1 | synthesized_optimized |
| 2457 | NUE50 | 2543 | maize\|gb164\|AW287760__T1 | cloned |
| 2458 | NUE511 | 2544 | maize\|gb157\|AW360667__T1 | cloned |
| 2459 | NUE512 | 201 | arabidopsis\|gb157.2\|AT5G23460__T1 | cloned |
| 2460 | NUE513 | 2545 | arabidopsis\|gb157.2\|AT3G26100__T1 | cloned |
| 2461 | NUE514 | 2546 | soybean\|gb162\|SOYHPR__T1 | cloned |
| 2462 | NUE515 | 2547 | arabidopsis\|gb165\|AT1G44920__T1 | cloned |
| 2463 | NUE516 | 205 | arabidopsis\|gb157.2\|AT1G48210__T1 | cloned |
| 2464 | NUE519 | 2548 | wheat\|gb164\|BE445396__T1 | cloned |
| 2465 | NUE520 | 207 | rice\|gb157.2\|BI305493__T1 | synthesized |
| 2466 | NUE521 | 208 | rice\|gb157.2\|AU077950__T1 | cloned |
| 2467 | NUE523 | 209 | sorghum\|gb161.xeno\|AI901439__T1 | cloned |
| 2468 | NUE525 | 210 | sorghum\|gb161.xeno\|AW052978__T1 | synthesized_optimized |
| 2469 | NUE527 | 211 | sorghum\|gb161.xeno\|AW055409__T1 | cloned |
| 2470 | NUE528 | 212 | sorghum\|gb161.xeno\|AI372194__T1 | cloned |
| 2471 | NUE531 | 213 | rice\|gb157.2\|BI805136__T1 | synthesized_optimized |
| 2472 | NUE532 | 214 | maize\|gb164\|AW054475__T1 | cloned |
| 2473 | NUE533 | 215 | soybean\|gb166\|AW350050__T1 | cloned |
| 2474 | NUE535 | 2549 | sorghum\|gb161.crp\|BE599042__T1 | cloned |
| 2475 | NUE536 | 217 | maize\|gb164\|BQ279657__T1 | cloned |
| 2476 | NUE537 | 218 | barley\|gb157.2\|AJ234408__T1 | cloned |
| 2477 | NUE538 | 219 | sorghum\|gb161.xeno\|AW923729__T1 | cloned |
| 2478 | NUE539 | 220 | rice\|gb157.2\|AW155216__T1 | synthesized_optimized |
| 2479 | NUE540 | 2550 | arabidopsis\|gb157.2\|AT1G13980__T1 | cloned |
| 2480 | NUE542 | 2551 | arabidopsis\|gb157.2\|AT3G46280__T1 | cloned |
| 2481 | NUE543 | 223 | rice\|gb157.2\|AK063415__T1 | synthesized_optimized |
| 2482 | NUE544 | 2552 | cotton\|gb164\|BQ412384__T1 | cloned |
| 2483 | NUE545 | 2553 | cotton\|gb164\|AI055737__T1 | cloned |
| 2484 | NUE547 | 226 | sorghum\|gb161.xeno\|BI139559__T1 | synthesized_optimized |
| 2485 | NUE548 | 227 | sorghum\|gb161.xeno\|BQ279657__T1 | cloned |
| 2486 | NUE549 | 228 | sorghum\|gb161.xeno\|AF019147__T1 | cloned |
| 2487 | NUE550 | 229 | canola\|gb161\|EE559843__T1 | cloned |
| 2488 | NUE551 | 2554 | barley\|gb157.3\|BE420701__T1 | cloned |
| 2489 | NUE553 | 231 | barley\|gb157.3\|BE421829__T1 | cloned |
| 2490 | NUE554 | 232 | sorghum\|gb161.xeno\|AA011880__T1 | cloned |
| 2491 | NUE560 | 233 | rice\|gb157.2\|BE229552__T1 | cloned |
| 2492 | NUE562 | 2555 | rice\|gb157.2\|BE039784__T1 | cloned |
| 2493 | NUE563 | 235 | rice\|gb157.2\|AU057884__T1 | cloned |
| 2494 | NUE564 | 236 | maize\|gb164\|AI619269__T1 | cloned |
| 2495 | NUE565 | 237 | arabidopsis\|gb157.2\|AT5G15080__T1 | cloned |
| 2496 | NUE566 | 238 | arabidopsis\|gb165\|AT2G43700__T1 | cloned |
| 2497 | NUE567 | 239 | arabidopsis\|gb165\|AT1G60680__T1 | cloned |
| 2498 | NUE568 | 240 | arabidopsis\|gb165\|AT1G78450__T1 | cloned |
| 2499 | NUE569 | 241 | arabidopsis\|gb165\|AT2G03890__T1 | cloned |
| 2500 | NUE570 | 242 | arabidopsis\|gb165\|AT1G43910__T1 | cloned |
| 2501 | NUE571 | 243 | arabidopsis\|gb157.2\|AT1G47530__T1 | cloned |
| 2502 | NUE572 | 244 | arabidopsis\|gb157.2\|AT2G24240__T1 | cloned |
| 2503 | NUE573 | 245 | arabidopsis\|gb165\|AT4G15390__T1 | cloned |
| 2504 | NUE574 | 2556 | rice\|gb157.2\|BI807603__T1 | cloned |
| 2505 | NUE575 | 247 | rice\|gb157.2\|AU068829__T1 | cloned |
| 2506 | NUE576 | 2557 | rice\|gb157.2\|AA752451__T1 | cloned |
| 2507 | NUE577 | 249 | arabidopsis\|gb165\|AT1G67800__T1 | cloned |
| 2508 | NUE578 | 250 | wheat\|gb164\|BE401454__T1 | cloned |

TABLE 23-continued

Cloned sequences

| SEQ ID NO: of cloned or synthetic gene | Gene Name | SEQ ID NO: of the encoded polypeptide | Cluster | Cloning Method |
|---|---|---|---|---|
| 2509 | NUE579 | 2558 | arabidopsis\|gb165\|AT1G70850_T1 | cloned |
| 2510 | NUE580 | 2559 | arabidopsis\|gb165\|AT2G35880_T1 | cloned |
| 2511 | NUE581 | 253 | arabidopsis\|gb165\|AT1G12845_T1 | cloned |
| 2512 | NUE582 | 2560 | sorghum\|gb161.xeno\|T18303_T1 | cloned |
| 2513 | NUE583 | 255 | rice\|gb157.2\|AU172665_T1 | cloned |
| 2514 | NUE584 | 2561 | sorghum\|gb161.crp\|AW923545_T1 | cloned |
| 2515 | NUE585 | 257 | arabidopsis\|gb165\|AT1G71900_T1 | cloned |
| 2516 | NUE586 | 2562 | arabidopsis\|gb165\|AT1G72320_T1 | cloned |
| 2517 | NUE587 | 259 | sorghum\|gb161.xeno\|AW672541_T1 | cloned |
| 2518 | NUE588 | 260 | rice\|gb157.2\|AA750816_T1 | cloned |
| 2519 | NUE590 | 2563 | sorghum\|gb161.xeno\|AI622209_T1 | cloned |
| 2520 | NUE591 | 262 | sorghum\|gb161.xeno\|BE123399_T1 | synthesized_optimized |
| 2521 | NUE592 | 263 | sorghum\|gb161.xeno\|AI901557_T1 | cloned |
| 2522 | NUE593 | 264 | arabidopsis\|gb165\|AT2G04066_T1 | synthesized_optimized |

Table 23. Provided are the cloned or synthetically produced genes and their encoded polypeptides, along with the sequence identifiers, organisms from which the genes were cloned.

Example 4

Generation of Transgenic Plants Expressing the Polynucleotides of Some Embodiments of the Invention

*Arabidopsis* transformation was performed according to Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (20000 Female reproductive tissues are the primary targets of *Agrobacterium*-mediated transformation by the *Arabidopsis* floral-dip method. Plant Physiol. 123(3): 895-904.). Briefly—*Arabidopsis thaliana* var *Columbia* ($T_0$ plants) were transformed using the Floral Dip procedure described by Clough S J and Bent A F (10) and by Desfeux C et al. (11), with minor modifications. *Arabidopsis thaliana* Columbia (Col0) $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The $T_0$ plants were ready for transformation six days prior to anthesis. Single colonies of *Agrobacterium* carrying the binary vectors harboring the polynucleotides of some embodiments of the invention were cultured in LB medium supplemented with kanamycin (50 mg/L) and gentamycin (50 mg/L). The cultures were incubated at 28° C. for 48 hrs under vigorous shaking and centrifuged at 4000 rpm for 5 minutes. The pellets comprising *Agrobacterium* cells were resuspended in a transformation medium which contained half-strength (2.15 g/L) Murashige-Skoog (MS) medium (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the flowering stem is submerged for 3-5 seconds. Each inoculated $T_0$ plant was immediately placed in a plastic tray, then covered with clear plastic dome to maintain humidity and kept in the dark at room temperature for 18 hrs to facilitate infection and transformation. Transformed (transgenic) plants were then uncovered and transferred to a greenhouse for recovery and maturation. The transgenic $T_0$ plants were grown in the greenhouse for 3-5 weeks until siliques maturation, and then seeds were harvested and kept at room temperature until sowing.

For generating T1 and $T_2$ transgenic plants harboring the polynucleotides of some embodiments of the invention, seeds collected from transgenic $T_0$ plants were surface-sterilized by soaking in 70% ethanol for 1 minute, followed by soaking in 5% sodium hypochlorite and 0.05% Triton X-100 for 5 minutes. The surface-sterilized seeds were thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to fresh culture plates for another week of incubation. Following incubation, the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants. At least 10 independent transformation events were created from each construct for which bulk of T2 seeds were collected.

The NUE584 (SEQ ID NO: 2514), NUE253 (SEQ ID NO: 2448), NUE533 (SEQ ID NO: 2473), NUE577 (SEQ ID NO: 2507), NUE590 (SEQ ID NO: 2519) and NUE562 (SEQ ID NO: 2492) genes were cloned, introduced in *Arabidopsis* and T2 seeds were produced.

NUE540 (SEQ ID NO: 2479), NUE549 (SEQ ID NO: 2486), and NUE533 (SEQ ID NO: 2473) developed purple healthy plants, suggesting increased vigor of the transgenic plants.

NUE591 (SEQ ID NO: 2520) produced light green plants. This phenotype relates the gene to the photosynthetic capacity of the plant at different nitrogen fertilization levels.

Example 5

Assay 1

Improved Nitrogen Use Efficiency In Vitro (Tissue Culture Assay)

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

Figure 3A:
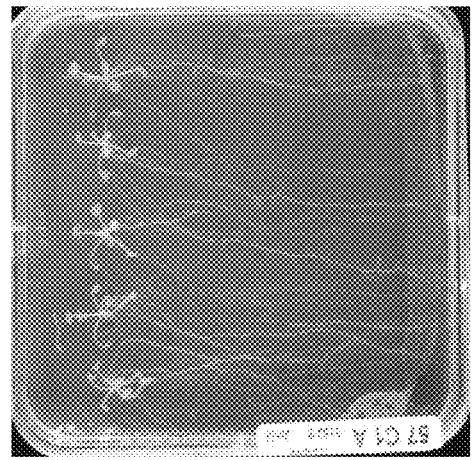
FIGS. 3A-B are images depicting visualization of root development of plants grown in transparent agar plates. The different transgenes were grown in transparent agar plates for 10 days and the plates were photographed every 3-4 days starting at day 1.
Figure 3B:
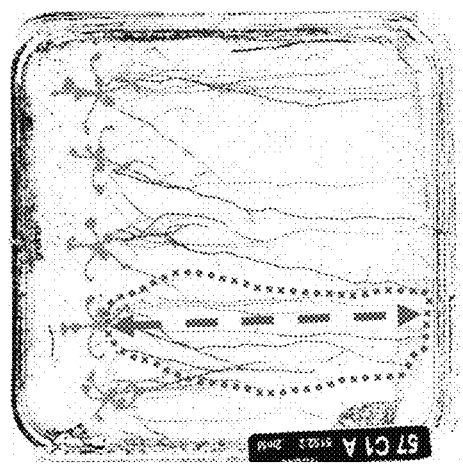

The image capturing process was repeated every 3-4 days starting at day 1 till day 10 (see for example the images in FIGS. 3 A-B). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following formulas V, VI and VII.

Relative growth rate of leaf area=Regression coefficient of leaf area along time course.     Formula V Relative growth rate of root coverage=Regression coefficient of root coverage along time course.     Formula V Relative growth rate of root length=Regression coefficient of root coverage along time course.     Formula VII At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical Analyses—

To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p-value was calculated. Results were considered significant if $p \leq 0.1$. The JMP statistics software package was used (Version 5.2.1, SAS Institute Inc., Cary, N.C., USA).

Experimental Results

The genes presented in Tables 24-25, hereinbelow, were found to improve nitrogen use efficiency (NUE) by producing larger plant biomass when grown under limiting nitrogen growth conditions, compared to control plants.

Tables 24 and 25 depict analyses of plant biomass (plant fresh and dry weight and leaf area) when grown under limiting nitrogen conditions [low nitrogen or nitrogen deficient conditions (0.75 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the second experiment confirmed the significant increment in plant biomass. Event with p-value<0.1 was considered statistically significant.

TABLE 24

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] | | | Gene Name | Event # | Plant Biomass Dry Weight [mg] | | |
|---|---|---|---|---|---|---|---|---|---|
| | | Average | p-value | % incr. | | | Average | p-value | % incr. |
| CT11 | 4892.1 | 204.50 | 6.3E−02 | 16.5 | CT11 | 4894.3 | 7.80 | 7.7E−02 | 39.29 |
| Control | | 175.55 | | | CT11 | 4892.3 | 8.85 | 1.3E−01 | 58.04 |
| CT22 | 5023.1 | 184.08 | 2.6E−04 | 43.5 | CT11 | 4892.2 | 7.85 | 4.5E−02 | 40.18 |
| Control | | 128.24 | | | CT11 | 4893.2 | 5.98 | 6.8E−01 | 6.70 |
| CT27 | 5033.7 | 195.00 | 3.2E−02 | 55.4 | CT11 | 4892.1 | 9.20 | 3.7E−02 | 64.29 |
| CT27 | 5031.4 | 150.93 | 3.2E−01 | 20.3 | Control | | 5.60 | | |
| CT27 | 5035.2 | 233.40 | 2.7E−02 | 86.0 | CT27 | 5033.7 | 7.68 | 1.2E−01 | 37.05 |
| CT27 | 5033.6 | 150.63 | 4.2E−01 | 20.0 | CT27 | 5031.4 | 6.73 | 2.2E−01 | 20.09 |
| CT27 | 5033.4 | 179.95 | 1.8E−01 | 43.4 | CT27 | 5035.2 | 9.68 | 4.3E−02 | 72.77 |
| CT27 | 5033.8 | 189.30 | 2.0E−02 | 50.9 | CT27 | 5033.6 | 6.40 | 3.1E−01 | 14.29 |
| CT27 | 5033.5 | 146.98 | 3.6E−01 | 17.1 | CT27 | 5033.4 | 8.03 | 1.4E−01 | 43.30 |
| Control | | 125.47 | | | CT27 | 5033.8 | 7.60 | 7.7E−02 | 35.71 |
| CT6 | 4943.1 | 184.30 | 8.3E−02 | 46.9 | CT27 | 5033.5 | 6.40 | 9.6E−02 | 14.29 |

TABLE 24-continued

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] Average | p-value | % incr. | Gene Name | Event # | Plant Biomass Dry Weight [mg] Average | p-value | % incr. |
|---|---|---|---|---|---|---|---|---|---|
| CT6 | 4941.4 | 188.38 | 3.0E−02 | 50.1 | Control | | 5.60 | | |
| Control | | 125.47 | | | CT6 | 4943.1 | 7.78 | 1.9E−01 | 38.84 |
| CT76 | 5044.6 | 213.08 | 1.8E−01 | 21.4 | CT6 | 4941.4 | 9.60 | 1.3E−03 | 71.43 |
| CT76 | 5041.5 | 250.50 | 1.6E−01 | 42.7 | Control | | 5.60 | | |
| CT76 | 5043.5 | 207.00 | 2.5E−01 | 17.9 | CT76 | 5044.6 | 7.83 | 1.1E−01 | 22.21 |
| CT76 | 5041.7 | 204.53 | 1.6E−01 | 16.5 | CT76 | 5041.5 | 9.10 | 2.0E−01 | 42.12 |
| CT76 | 5041.9 | 209.00 | 8.4E−02 | 19.1 | CT76 | 5043.5 | 11.05 | 1.7E−02 | 72.57 |
| CT76 | 5041.6 | 256.10 | 9.0E−02 | 45.9 | CT76 | 5041.7 | 7.35 | 1.9E−01 | 14.79 |
| Control | | 175.55 | | | CT76 | 5041.9 | 7.33 | 2.0E−01 | 14.40 |
| CT81 | 4992.1 | 223.50 | 1.8E−02 | 27.3 | CT76 | 5041.6 | 9.28 | 9.6E−02 | 44.85 |
| Control | | 175.55 | | | Control | | 6.40 | | |
| NUE208 | 8354.8 | 118.28 | 9.1E−02 | 17.3 | CT81 | 4992.1 | 9.60 | 7.2E−04 | 49.93 |
| NUE208 | 8351.3 | 138.15 | 8.5E−02 | 37.0 | CT81 | 4993.5 | 6.60 | 8.0E−01 | 3.07 |
| NUE208 | 8355.3 | 128.53 | 4.9E−02 | 27.5 | Control | | 6.40 | | |
| NUE208 | 8351.5 | 112.93 | 3.5E−01 | 12.0 | NUE206 | 6731.2 | 7.65 | 8.4E−01 | 4.97 |
| Control | | 100.81 | | | NUE206 | 6732.9 | 10.70 | 7.4E−02 | 46.83 |
| NUE209 | 8191.2 | 135.83 | 4.0E−01 | 34.7 | NUE206 | 6732.5 | 7.98 | 7.0E−01 | 9.43 |
| NUE209 | 8192.13 | 118.85 | 2.3E−01 | 17.9 | Control | | 7.2875 | | |
| NUE209 | 8192.14 | 160.40 | 1.7E−01 | 59.1 | NUE208 | 8354.8 | 6.05 | 1.0E−01 | 55.63 |
| NUE209 | 8191.5 | 119.28 | 1.9E−01 | 18.3 | NUE208 | 8351.3 | 7.95 | 4.3E−02 | 104.50 |
| NUE209 | 8192.1 | 134.45 | 4.5E−01 | 33.4 | NUE208 | 8355.3 | 6.63 | 9.8E−03 | 70.42 |
| Control | | 100.81 | | | NUE208 | 8351.5 | 6.33 | 1.0E−02 | 62.70 |
| NUE211 | 8265.1 | 118.48 | 6.7E−02 | 47.0 | Control | | 3.89 | | |
| Control | | 80.58 | | | NUE209 | 8191.2 | 6.20 | 2.2E−01 | 59.49 |
| NUE212 | 8331.1 | 115.18 | 4.7E−01 | 14.2 | NUE209 | 8192.13 | 5.80 | 4.4E−02 | 49.20 |
| NUE212 | 8335.2 | 182.98 | 6.6E−03 | 81.5 | NUE209 | 8192.14 | 7.58 | 6.3E−02 | 94.86 |
| NUE212 | 8334.1 | 121.25 | 2.6E−01 | 20.3 | NUE209 | 8191.5 | 7.85 | 5.2E−02 | 101.93 |
| NUE212 | 8331.4 | 177.68 | 1.1E−01 | 76.2 | NUE209 | 8192.1 | 5.85 | 9.5E−02 | 50.48 |
| Control | | 100.81 | | | Control | | 3.89 | | |
| NUE221 | 9802.8 | 134.30 | 1.6E−01 | 18.0 | NUE210 | 8202.1 | 4.83 | 4.9E−01 | 24.12 |
| NUE221 | 9806.1 | 138.60 | 9.0E−02 | 21.8 | NUE210 | 8202.2 | 6.35 | 6.3E−03 | 63.34 |
| Control | | 113.81 | | | NUE210 | 8201.3 | 5.50 | 4.7E−02 | 41.48 |
| NUE222 | 8851.4 | 131.68 | 5.8E−03 | 44.1 | Control | | 3.89 | | |
| NUE222 | 8854.1 | 108.37 | 6.9E−02 | 18.6 | NUE212 | 8334.1 | 5.18 | 2.2E−01 | 42.76 |
| NUE222 | 8853.2 | 119.23 | 1.9E−02 | 30.4 | NUE212 | 8332.1 | 3.83 | 7.5E−01 | 5.52 |
| NUE222 | 8851.3 | 161.75 | 2.1E−02 | 77.0 | NUE212 | 8331.4 | 4.75 | 6.6E−02 | 31.03 |
| Control | | 91.40 | | | Control | | 3.63 | | |
| NUE227 | 9851.2 | 102.75 | 1.2E−01 | 26.1 | NUE221 | 9806.1 | 6.025 | 1.9E−01 | 18.7 |
| NUE227 | 9854.2 | 84.70 | 8.3E−01 | 4.0 | Control | | 5.075 | | |
| NUE227 | 9853.4 | 102.83 | 2.9E−01 | 26.2 | NUE222 | 8851.4 | 4.03 | 7.9E−01 | 3.54 |
| NUE227 | 9853.1 | 103.23 | 1.3E−01 | 26.7 | NUE222 | 8853.2 | 4.65 | 2.2E−01 | 19.61 |
| NUE227 | 9852.3 | 101.98 | 1.4E−01 | 25.2 | NUE222 | 8851.3 | 6.45 | 3.3E−03 | 65.92 |
| Control | | 81.48 | | | Control | | 3.89 | | |
| NUE230 | 9154.2 | 181.58 | 2.3E−02 | 48.8 | NUE224 | 9002.2 | 6.93 | 2.1E−02 | 39.55 |
| NUE230 | 9151.2 | 125.18 | 8.8E−01 | 2.6 | NUE224 | 9001.3 | 6.83 | 2.8E−01 | 37.70 |
| Control | | 122.05 | | | Control | | 4.96 | | |
| NUE231 | 10633.3 | 138.98 | 8.5E−02 | 22.1 | NUE227 | 9851.2 | 4.90 | 3.6E−01 | 24.05 |
| Control | | 113.81 | | | NUE227 | 9854.2 | 4.60 | 4.8E−01 | 16.46 |
| NUE233 | 10174.3 | 156.40 | 3.7E−02 | 60.8 | NUE227 | 9853.4 | 4.55 | 5.3E−01 | 15.19 |
| NUE233 | 10174.1 | 176.20 | 4.0E−03 | 81.2 | NUE227 | 9853.1 | 4.83 | 1.4E−01 | 22.15 |
| NUE233 | 10173.7 | 103.68 | 7.4E−01 | 6.6 | NUE227 | 9852.3 | 5.18 | 7.7E−02 | 31.01 |
| Control | | 97.24 | | | Control | | 3.95 | | |
| NUE233 | 10174.1 | 117.95 | 8.1E−03 | 37.2 | NUE228 | 10092.2 | 6.75 | 2.8E−02 | 35.34 |
| NUE233 | 10173.7 | 95.40 | 4.6E−01 | 10.9 | Control | | 4.99 | | |
| Control | | 86.00 | | | NUE230 | 9154.2 | 7.83 | 2.2E−02 | 57.68 |
| NUE235 | 9691.1 | 175.50 | 3.2E−01 | 43.8 | NUE230 | 9151.2 | 5.40 | 5.4E−01 | 8.82 |
| NUE235 | 9693.3 | 178.60 | 3.1E−03 | 46.3 | NUE230 | 9153.3 | 5.28 | 6.9E−01 | 6.30 |
| NUE235 | 9694.3 | 156.28 | 2.1E−01 | 28.0 | NUE230 | 9153.1 | 5.48 | 3.3E−01 | 10.33 |
| Control | | 122.05 | | | Control | | 4.96 | | |
| NUE237 | 9651.1 | 159.43 | 1.6E−01 | 30.6 | NUE231 | 10633.3 | 8.425 | 1.0E−05 | 66.0 |
| NUE237 | 9654.4 | 170.70 | 4.1E−02 | 39.9 | Control | | 5.075 | | |
| NUE237 | 9654.1 | 128.70 | 7.1E−01 | 5.4 | NUE233 | 10174.3 | 6.05 | 5.1E−02 | 44.05 |
| NUE237 | 9653.3 | 133.33 | 6.1E−01 | 9.2 | NUE233 | 10174.1 | 8.15 | 2.7E−03 | 94.05 |
| Control | | 122.05 | | | NUE233 | 10173.7 | 4.45 | 7.3E−01 | 5.95 |
| NUE239 | 9192.3 | 168.58 | 5.1E−02 | 27.4 | Control | | 4.20 | | |
| NUE239 | 9192.1 | 142.68 | 1.7E−01 | 7.8 | NUE235 | 9694.2 | 5.25 | 7.9E−01 | 5.79 |
| NUE239 | 9191.2 | 136.75 | 5.8E−01 | 3.3 | NUE235 | 9691.1 | 7.28 | 1.6E−01 | 46.60 |
| Control | | 132.34 | | | NUE235 | 9694.4 | 5.83 | 4.1E−01 | 17.38 |
| NUE240 | 9172.1 | 157.53 | 5.3E−03 | 19.0 | NUE235 | 9693.3 | 7.28 | 6.0E−02 | 46.60 |
| NUE240 | 9174.3 | 143.65 | 1.7E−01 | 8.5 | NUE235 | 9694.3 | 7.88 | 1.5E−02 | 58.69 |
| Control | | 132.34 | | | Control | | 4.96 | | |

TABLE 24-continued

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] Average | p-value | % incr. | Gene Name | Event # | Plant Biomass Dry Weight [mg] Average | p-value | % incr. |
|---|---|---|---|---|---|---|---|---|---|
| NUE241 | 9632.5 | 133.63 | 1.4E−01 | 64.0 | NUE237 | 9651.1 | 7.03 | 3.2E−01 | 41.56 |
| NUE241 | 9631.3 | 148.18 | 3.8E−03 | 81.9 | NUE237 | 9654.4 | 8.88 | 2.0E−02 | 78.84 |
| NUE241 | 9632.3 | 137.60 | 8.0E−03 | 68.9 | NUE237 | 9654.1 | 6.23 | 6.5E−02 | 25.44 |
| NUE241 | 9632.4 | 131.93 | 1.9E−02 | 61.9 | NUE237 | 9653.3 | 7.08 | 8.5E−02 | 42.57 |
| Control | | 81.48 | | | Control | | 4.96 | | |
| NUE242 | 9212.1 | 124.50 | 2.7E−02 | 48.7 | NUE239 | 9191.1 | 9.00 | 5.3E−02 | 60.71 |
| NUE242 | 9214.1 | 89.98 | 7.5E−01 | 7.4 | NUE239 | 9191.2 | 6.13 | 5.2E−01 | 9.38 |
| NUE242 | 9211.2 | 95.30 | 4.3E−01 | 13.8 | Control | | 5.60 | | |
| NUE242 | 9213.4 | 125.50 | 2.8E−02 | 49.9 | NUE240 | 9172.4 | 7.35 | 3.5E−02 | 18.55 |
| Control | | 83.75 | | | NUE240 | 9174.3 | 6.53 | 6.1E−01 | 5.24 |
| NUE244 | 9061.1 | 119.60 | 2.8E−03 | 30.9 | Control | | 6.20 | | |
| NUE244 | 9061.5 | 148.80 | 1.4E−01 | 62.8 | NUE241 | 9633.4 | 5.68 | 6.1E−02 | 43.67 |
| Control | | 91.40 | | | NUE241 | 9632.3 | 6.55 | 1.3E−02 | 65.82 |
| NUE246 | 9033.6 | 140.75 | 1.4E−01 | 41.2 | NUE241 | 9632.2 | 6.20 | 4.4E−02 | 56.96 |
| NUE246 | 9033.8 | 111.20 | 4.8E−01 | 11.6 | NUE241 | 9632.4 | 5.68 | 7.9E−04 | 43.67 |
| NUE246 | 9033.4 | 148.63 | 2.7E−03 | 49.1 | Control | | 3.95 | | |
| NUE246 | 9034.1 | 138.50 | 6.0E−03 | 39.0 | NUE246 | 9033.6 | 4.40 | 3.2E−01 | 19.32 |
| NUE246 | 9031.1 | 131.63 | 3.5E−01 | 32.1 | NUE246 | 9033.8 | 5.13 | 1.8E−01 | 38.98 |
| Control | | 99.68 | | | NUE246 | 9033.4 | 4.73 | 8.2E−02 | 28.14 |
| NUE248 | 8981.5 | 197.35 | 1.3E−02 | 30.1 | NUE246 | 9034.1 | 6.43 | 1.7E−02 | 74.46 |
| Control | | 151.66 | | | NUE246 | 9031.1 | 4.80 | 2.5E−01 | 30.17 |
| NUE249 | 9124.2 | 82.68 | 9.2E−01 | 3.4 | Control | | 3.69 | | |
| NUE249 | 9121.4 | 125.13 | 2.0E−03 | 56.5 | NUE248 | 8981.5 | 7.98 | 6.0E−02 | 23.17 |
| NUE249 | 9123.3 | 89.55 | 2.3E−01 | 12.0 | NUE248 | 8984.1 | 6.75 | 7.1E−01 | 4.25 |
| Control | | 79.94 | | | NUE248 | 8981.2 | 7.35 | 3.3E−01 | 13.51 |
| NUE250 | 9132.1 | 149.53 | 4.6E−02 | 22.5 | Control | | 6.48 | | |
| NUE250 | 9133.2 | 193.20 | 1.3E−02 | 58.3 | NUE249 | 9124.2 | 5.05 | 7.6E−01 | 11.60 |
| NUE250 | 9132.2 | 152.38 | 1.8E−01 | 24.8 | NUE249 | 9121.4 | 5.50 | 2.3E−02 | 21.55 |
| NUE250 | 9134.1 | 205.50 | 5.0E−02 | 68.4 | Control | | 4.53 | | |
| Control | | 122.05 | | | NUE250 | 9132.1 | 7.38 | 4.8E−02 | 48.61 |
| NUE251 | 10181.3 | 175.35 | 4.7E−03 | 80.3 | NUE250 | 9133.2 | 7.95 | 2.5E−03 | 60.20 |
| NUE251 | 10183.2 | 127.58 | 1.7E−01 | 31.2 | NUE250 | 9132.2 | 7.23 | 1.0E−01 | 45.59 |
| NUE251 | 10183.1 | 118.03 | 3.6E−01 | 21.4 | NUE250 | 9134.1 | 8.03 | 1.1E−02 | 61.71 |
| Control | | 97.24 | | | Control | | 4.96 | | |
| NUE252 | 9011.3 | 252.23 | 1.3E−02 | 40.9 | NUE251 | 10181.3 | 7.03 | 2.9E−02 | 67.26 |
| NUE252 | 9012.2 | 201.53 | 3.1E−01 | 12.5 | NUE251 | 10183.2 | 5.35 | 2.6E−01 | 27.38 |
| Control | | 179.06 | | | NUE251 | 10183.1 | 4.93 | 4.6E−01 | 17.26 |
| NUE256 | 10063.4 | 127.55 | 1.7E−01 | 31.2 | Control | | 4.2 | | |
| NUE256 | 10064.1 | 155.88 | 3.1E−02 | 60.3 | NUE256 | 10063.4 | 5.78 | 1.0E−01 | 37.50 |
| NUE256 | 10061.2 | 158.93 | 1.1E−02 | 63.4 | NUE256 | 10064.1 | 7.40 | 1.0E−02 | 76.19 |
| NUE256 | 10062.4 | 147.40 | 1.4E−01 | 51.6 | NUE256 | 10061.2 | 6.35 | 1.8E−02 | 51.19 |
| NUE256 | 10063.2 | 134.18 | 1.9E−01 | 38.0 | NUE256 | 10062.4 | 7.43 | 1.4E−01 | 76.79 |
| NUE256 | 10061.1 | 101.35 | 8.3E−01 | 4.2 | NUE256 | 10063.2 | 5.73 | 1.4E−01 | 36.31 |
| Control | | 97.24 | | | NUE256 | 10061.1 | 4.40 | 8.0E−01 | 4.76 |
| NUE256 | 10061.2 | 104.20 | 5.5E−01 | 21.2 | Control | | 4.20 | | |
| NUE256 | 10061.4 | 127.68 | 1.8E−01 | 48.5 | NUE512 | 9284.3 | 4.65 | 6.8E−01 | 5.38 |
| NUE256 | 10063.2 | 88.28 | 8.5E−01 | 2.6 | NUE512 | 9282.3 | 7.78 | 1.3E−02 | 76.20 |
| Control | | 86.00 | | | NUE512 | 9284.4 | 6.70 | 2.6E−02 | 51.84 |
| NUE268 | 8992.1 | 108.25 | 4.3E−01 | 10.4 | Control | | 4.41 | | |
| NUE268 | 8996.3 | 118.68 | 5.5E−01 | 21.0 | NUE515 | 9713.6 | 6.725 | 2.4E−02 | 32.5 |
| NUE268 | 8996.5 | 177.25 | 8.4E−02 | 80.8 | Control | | 5.075 | | |
| NUE268 | 8996.2 | 112.10 | 3.7E−01 | 14.3 | NUE516 | 9291.1 | 5.78 | 2.4E−01 | 16.37 |
| Control | | 98.05 | | | NUE516 | 9291.4 | 7.43 | 2.7E−02 | 49.62 |
| NUE269 | 9104.1 | 93.80 | 3.0E−01 | 23.1 | NUE516 | 9293.2 | 5.78 | 4.3E−01 | 16.37 |
| NUE269 | 9101.3 | 94.65 | 6.2E−03 | 24.2 | Control | | 4.96 | | |
| Control | | 76.20 | | | NUE519 | 9371.2 | 11.75 | 4.8E−02 | 89.52 |
| NUE512 | 9284.2 | 166.53 | 6.1E−05 | 73.7 | NUE519 | 9371.1 | 8.50 | 1.5E−02 | 37.10 |
| NUE512 | 9284.3 | 112.35 | 2.1E−01 | 17.2 | NUE519 | 9372.2 | 6.60 | 6.7E−01 | 6.45 |
| NUE512 | 9282.3 | 181.10 | 1.3E−02 | 88.9 | Control | | 6.20 | | |
| NUE512 | 9284.4 | 171.70 | 7.6E−02 | 79.1 | NUE525 | 9531.2 | 5.25 | 3.6E−01 | −10.45 |
| Control | | 95.88 | | | NUE525 | 9534.1 | 5.40 | 4.4E−01 | −7.89 |
| NUE515 | 9712.5 | 116.43 | 8.6E−01 | 2.3 | NUE525 | 9531.3 | 6.73 | 4.6E−01 | 14.71 |
| NUE515 | 9713.6 | 148.18 | 2.0E−02 | 30.2 | NUE525 | 9533.1 | 7.43 | 1.2E−02 | 26.65 |
| Control | | 113.81 | | | NUE525 | 9531.1 | 7.20 | 9.9E−02 | 22.81 |
| NUE514 | 9404.1 | 113.98 | 8.5E−02 | 36.1 | Control | | 5.86 | | |
| NUE514 | 9403.2 | 94.58 | 1.2E−01 | 12.9 | NUE531 | 10083.1 | 6.58 | 4.2E−02 | 31.83 |
| NUE514 | 9402.5 | 99.38 | 3.5E−01 | 18.7 | NUE531 | 10082.2 | 6.25 | 1.6E−01 | 25.31 |
| Control | | 83.75 | | | NUE531 | 10081.4 | 8.50 | 2.4E−02 | 70.43 |
| NUE516 | 9291.1 | 128.58 | 6.7E−01 | 5.3 | NUE531 | 10081.5 | 8.03 | 2.5E−02 | 60.90 |
| NUE516 | 9291.4 | 165.93 | 1.5E−01 | 35.9 | Control | | 4.99 | | |
| NUE516 | 9293.2 | 139.73 | 5.7E−01 | 14.5 | NUE532 | 9222.4 | 6.15 | 3.5E−05 | 44.71 |

TABLE 24-continued

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] Average | p-value | % incr. | Gene Name | Event # | Plant Biomass Dry Weight [mg] Average | p-value | % incr. |
|---|---|---|---|---|---|---|---|---|---|
| Control | | 122.05 | | | NUE532 | 9222.1 | 6.98 | 1.3E−02 | 64.12 |
| NUE519 | 9371.2 | 182.10 | 1.5E−02 | 37.6 | NUE532 | 9223.3 | 5.53 | 1.4E−01 | 30.00 |
| Control | | 132.34 | | | NUE532 | 9224.4 | 4.43 | 4.4E−01 | 4.12 |
| NUE521 | 9363.1 | 107.40 | 3.1E−01 | 28.2 | Control | | 4.25 | | |
| NUE521 | 9362.2 | 119.80 | 2.6E−02 | 43.0 | NUE536 | 9233.3 | 6.03 | 4.8E−03 | 63.39 |
| NUE521 | 9361.2 | 136.10 | 3.5E−04 | 62.5 | NUE536 | 9234.1 | 4.55 | 3.3E−01 | 23.39 |
| NUE521 | 9361.3 | 104.15 | 3.8E−01 | 24.4 | NUE536 | 9231.3 | 4.08 | 5.7E−01 | 10.51 |
| NUE521 | 9363.4 | 132.95 | 5.8E−03 | 58.7 | NUE536 | 9232.4 | 3.98 | 6.1E−01 | 7.80 |
| Control | | 83.75 | | | Control | | 3.69 | | |
| NUE523 | 9412.5 | 190.08 | 2.4E−01 | 25.3 | NUE537 | 9391.1 | 5.08 | 3.5E−01 | 15.01 |
| NUE523 | 9414.2 | 192.23 | 1.9E−01 | 26.7 | NUE537 | 9393.2 | 4.53 | 9.2E−01 | 2.55 |
| NUE523 | 9412.1 | 187.50 | 2.8E−02 | 23.6 | NUE537 | 9394.4 | 5.90 | 2.8E−01 | 33.71 |
| Control | | 151.66 | | | NUE537 | 9391.2 | 5.53 | 2.2E−01 | 25.21 |
| NUE527 | 9201.1 | 111.28 | 3.2E−03 | 273.7 | NUE537 | 9393.3 | 5.63 | 2.7E−02 | 27.48 |
| NUE527 | 9202.6 | 51.70 | 2.1E−02 | 73.6 | Control | | 4.41 | | |
| NUE527 | 9203.2 | 49.77 | 4.3E−02 | 67.1 | NUE539 | 10101.5 | 6.78 | 4.4E−03 | 61.31 |
| NUE527 | 9204.1 | 45.83 | 3.0E−01 | 53.9 | NUE539 | 10103.5 | 5.63 | 1.7E−01 | 33.93 |
| Control | | 29.78 | | | NUE539 | 10101.2 | 7.43 | 4.4E−02 | 76.79 |
| NUE531 | 10083.1 | 159.05 | 9.2E−02 | 38.1 | NUE539 | 10101.7 | 7.05 | 2.3E−02 | 67.86 |
| NUE531 | 10082.2 | 154.43 | 1.6E−02 | 34.1 | NUE539 | 10103.4 | 4.88 | 3.6E−01 | 16.07 |
| NUE531 | 10081.4 | 173.70 | 5.9E−02 | 50.8 | Control | | 4.20 | | |
| NUE531 | 10081.5 | 154.38 | 1.9E−02 | 34.0 | NUE542 | 9333.2 | 8.35 | 2.6E−02 | 89.24 |
| Control | | 115.16 | | | NUE542 | 9334.1 | 4.80 | 5.2E−01 | 8.78 |
| NUE531 | 10081.4 | 128.20 | 3.4E−02 | 49.1 | NUE542 | 9331.3 | 4.83 | 6.9E−01 | 9.35 |
| NUE531 | 10083.2 | 91.95 | 6.4E−01 | 6.9 | NUE542 | 9334.3 | 4.65 | 8.1E−01 | 5.38 |
| NUE531 | 10081.5 | 165.43 | 5.5E−02 | 92.4 | Control | | 4.41 | | |
| Control | | 86.00 | | | NUE548 | 9095.2 | 8.05 | 2.6E−01 | 44.07 |
| NUE532 | 9222.4 | 143.08 | 9.9E−02 | 70.8 | NUE548 | 9095.4 | 8.60 | 4.7E−02 | 53.91 |
| NUE532 | 9222.1 | 106.98 | 2.3E−01 | 27.7 | NUE548 | 9091.1 | 6.43 | 3.0E−01 | 14.99 |
| NUE532 | 9223.3 | 100.20 | 1.3E−01 | 19.6 | Control | | 5.59 | | |
| Control | | 83.75 | | | NUE549 | 9343.7 | 7.67 | 2.2E−02 | 54.88 |
| NUE532 | 9222.4 | 118.33 | 7.6E−02 | 41.3 | Control | | 4.95 | | |
| NUE532 | 9222.1 | 170.88 | 1.1E−01 | 104.0 | NUE550 | 9143.1 | 5.75 | 3.9E−04 | 35.29 |
| NUE532 | 9223.3 | 115.80 | 3.1E−01 | 38.3 | NUE550 | 9143.4 | 6.85 | 7.3E−03 | 61.18 |
| NUE532 | 9223.5 | 104.90 | 7.7E−01 | 25.3 | NUE550 | 9142.2 | 6.45 | 1.6E−02 | 51.76 |
| NUE532 | 9224.4 | 110.48 | 6.3E−01 | 31.9 | Control | | 4.25 | | |
| Control | | 98.05 | | | NUE553 | 9181.5 | 5.55 | 7.6E−02 | 30.59 |
| NUE535 | 9082.2 | 32.95 | 4.7E−01 | 10.7 | NUE553 | 9184.3 | 4.58 | 6.3E−01 | 7.65 |
| NUE535 | 9086.2 | 73.97 | 3.2E−02 | 148.4 | NUE553 | 9182.2 | 4.70 | 2.4E−01 | 10.59 |
| NUE535 | 9086.3 | 51.43 | 6.0E−02 | 72.7 | Control | | 4.25 | | |
| NUE535 | 9081.1 | 61.90 | 1.9E−01 | 107.9 | NUE554 | 9114.1 | 4.33 | 9.4E−01 | 1.76 |
| NUE535 | 9084.4 | 57.00 | 9.3E−03 | 91.4 | NUE554 | 9115.2 | 6.88 | 1.3E−02 | 61.76 |
| Control | | 29.78 | | | NUE554 | 9114.2 | 5.35 | 1.8E−02 | 25.88 |
| NUE537 | 9391.1 | 131.75 | 2.2E−01 | 37.4 | NUE554 | 9115.3 | 4.45 | 5.9E−01 | 4.71 |
| NUE537 | 9393.2 | 110.88 | 3.9E−01 | 15.6 | Control | | 4.25 | | |
| NUE537 | 9394.4 | 214.60 | 6.4E−02 | 123.8 | NUE564 | 9242.3 | 4.55 | 6.7E−05 | 114.12 |
| NUE537 | 9391.2 | 141.33 | 3.2E−02 | 47.4 | NUE564 | 9243.2 | 4.03 | 7.8E−02 | 89.41 |
| NUE537 | 9393.3 | 136.40 | 2.1E−04 | 42.3 | NUE564 | 9242.4 | 3.28 | 3.6E−02 | 54.12 |
| Control | | 95.88 | | | NUE564 | 9242.2 | 3.90 | 7.6E−02 | 83.53 |
| NUE538 | 9782.4 | 108.85 | 2.7E−01 | 33.6 | NUE564 | 9243.4 | 4.35 | 2.2E−06 | 104.71 |
| NUE538 | 9781.4 | 95.73 | 4.5E−01 | 17.5 | Control | | 2.13 | | |
| NUE538 | 9781.1 | 94.65 | 2.6E−01 | 16.2 | NUE567 | 9263.2 | 3.15 | 2.1E−01 | 48.24 |
| NUE538 | 9782.1 | 145.73 | 8.8E−02 | 78.9 | NUE567 | 9261.3 | 3.05 | 1.8E−02 | 43.53 |
| Control | | 81.48 | | | NUE567 | 9263.3 | 3.28 | 8.5E−03 | 54.12 |
| NUE539 | 10101.5 | 163.80 | 2.4E−02 | 68.5 | NUE567 | 9261.4 | 3.28 | 5.9E−03 | 54.12 |
| NUE539 | 10103.5 | 124.98 | 2.8E−01 | 28.5 | Control | | 2.13 | | |
| NUE539 | 10101.2 | 177.98 | 2.7E−02 | 83.0 | NUE569 | 9384.4 | 2.63 | 3.0E−01 | 23.53 |
| NUE539 | 10101.7 | 162.73 | 2.5E−02 | 67.3 | NUE569 | 9381.2 | 5.20 | 1.8E−02 | 144.71 |
| NUE539 | 10103.4 | 105.13 | 7.6E−01 | 8.1 | NUE569 | 9381.5 | 2.90 | 5.3E−01 | 36.47 |
| Control | | 97.24 | | | NUE569 | 9381.3 | 4.53 | 1.3E−01 | 112.94 |
| NUE542 | 9333.2 | 165.80 | 6.0E−02 | 72.9 | NUE569 | 9384.2 | 3.58 | 4.5E−01 | 68.24 |
| NUE542 | 9331.3 | 150.08 | 9.7E−02 | 56.5 | Control | | 2.13 | | |
| NUE542 | 9334.3 | 153.73 | 2.9E−03 | 60.3 | NUE570 | 9311.4 | 4.23 | 1.6E−01 | 98.82 |
| NUE542 | 9332.1 | 167.08 | 1.0E−01 | 74.3 | NUE570 | 9313.3 | 3.85 | 5.1E−02 | 81.18 |
| Control | | 95.88 | | | NUE570 | 9314.4 | 3.58 | 8.1E−01 | 68.24 |
| NUE542 | 9333.2 | 169.30 | 1.0E−02 | 38.7 | NUE570 | 9314.1 | 4.25 | 4.3E−02 | 100.00 |
| NUE542 | 9332.1 | 165.13 | 3.6E−02 | 35.3 | NUE570 | 9312.3 | 4.33 | 4.8E−01 | 103.53 |
| Control | | 122.05 | | | Control | | 2.13 | | |
| NUE543 | 10051.2 | 99.90 | 1.4E−01 | 22.6 | NUE571 | 9304.2 | 4.28 | 1.1E−02 | 101.18 |
| NUE543 | 10051.6 | 113.23 | 1.8E−01 | 39.0 | NUE571 | 9304.3 | 4.15 | 1.7E−02 | 95.29 |
| NUE543 | 10053.1 | 97.10 | 3.1E−01 | 19.2 | NUE571 | 9303.2 | 5.13 | 6.8E−05 | 141.18 |

TABLE 24-continued

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] Average | p-value | % incr. | Gene Name | Event # | Plant Biomass Dry Weight [mg] Average | p-value | % incr. |
|---|---|---|---|---|---|---|---|---|---|
| NUE543 | 10054.2 | 121.08 | 9.3E−03 | 48.6 | NUE571 | 9302.3 | 3.63 | 7.7E−02 | 70.59 |
| Control | | 81.48 | | | NUE571 | 9301.4 | 3.90 | 1.9E−02 | 83.53 |
| NUE544 | 9764.1 | 143.68 | 3.0E−02 | 33.9 | Control | | 2.13 | | |
| NUE544 | 9763.4 | 115.60 | 4.9E−01 | 7.7 | NUE572 | 9321.3 | 3.35 | 2.6E−02 | 57.65 |
| NUE544 | 9764.2 | 127.50 | 1.6E−01 | 18.8 | NUE572 | 9321.1 | 4.50 | 2.2E−02 | 111.76 |
| NUE544 | 9763.3 | 123.08 | 3.5E−02 | 14.7 | NUE572 | 9322.1 | 3.03 | 1.2E−01 | 42.35 |
| Control | | 107.29 | | | NUE572 | 9324.3 | 4.10 | 1.5E−02 | 92.94 |
| NUE549 | 9343.7 | 142.03 | 1.9E−02 | 19.6 | NUE572 | 9322.2 | 3.63 | 1.2E−02 | 70.59 |
| Control | | 118.75 | | | Control | | 2.13 | | |
| NUE550 | 9141.3 | 109.05 | 5.0E−01 | 11.2 | NUE573 | 9491.4 | 5.65 | 3.2E−01 | 14.14 |
| NUE550 | 9143.1 | 136.53 | 1.7E−01 | 39.2 | NUE573 | 9491.1 | 6.18 | 1.2E−01 | 24.75 |
| NUE550 | 9143.4 | 161.73 | 1.3E−02 | 64.9 | NUE573 | 9493.2 | 5.53 | 3.2E−01 | 11.78 |
| NUE550 | 9142.2 | 131.30 | 5.7E−02 | 33.9 | Control | | 4.95 | | |
| Control | | 98.05 | | | NUE574 | 10364.2 | 5.73 | 2.9E−01 | 11.98 |
| NUE553 | 9181.5 | 52.48 | 2.2E−04 | 76.2 | NUE574 | 10366.2 | 7.08 | 5.3E−02 | 38.39 |
| NUE553 | 9184.1 | 57.30 | 3.2E−03 | 92.4 | Control | | 5.11 | | |
| NUE553 | 9184.3 | 82.23 | 1.3E−05 | 176.2 | NUE576 | 9791.3 | 6.70 | 8.6E−04 | 69.62 |
| NUE553 | 9185.2 | 56.35 | 8.3E−04 | 89.3 | NUE576 | 9792.4 | 5.18 | 6.6E−02 | 31.01 |
| NUE553 | 9182.2 | 68.93 | 8.8E−03 | 131.5 | NUE576 | 9794.1 | 4.78 | 4.0E−01 | 20.89 |
| Control | | 29.78 | | | NUE576 | 9793.3 | 5.65 | 8.4E−04 | 43.04 |
| NUE554 | 9115.2 | 215.73 | 3.9E−02 | 120.0 | Control | | 3.95 | | |
| NUE554 | 9114.2 | 116.98 | 1.9E−01 | 19.3 | NUE581 | 9723.6 | 5.875 | 2.7E−01 | 15.8 |
| Control | | 98.05 | | | NUE581 | 9724.9 | 5.425 | 6.3E−01 | 6.9 |
| NUE564 | 9242.3 | 120.53 | 8.6E−03 | 25.7 | Control | | 5.075 | | |
| NUE564 | 9243.2 | 130.18 | 2.3E−02 | 35.8 | NUE582 | 9564.2 | 5.28 | 5.6E−01 | 6.30 |
| NUE564 | 9242.2 | 221.87 | 6.4E−02 | 131.4 | NUE582 | 9562.4 | 6.45 | 1.8E−01 | 29.97 |
| NUE564 | 9243.4 | 121.85 | 1.0E−01 | 27.1 | NUE582 | 9561.2 | 6.95 | 1.4E−03 | 40.05 |
| Control | | 95.88 | | | Control | | 4.96 | | |
| NUE567 | 9263.2 | 133.50 | 8.5E−02 | 39.2 | NUE583 | 9673.1 | 5.80 | 1.1E−01 | 46.84 |
| NUE567 | 9261.2 | 133.75 | 2.6E−01 | 39.5 | NUE583 | 9673.2 | 4.33 | 2.7E−01 | 9.49 |
| Control | | 95.88 | | | NUE583 | 9671.2 | 5.28 | 2.1E−01 | 33.54 |
| NUE568 | 9461.2 | 164.90 | 7.0E−02 | 38.9 | NUE583 | 9671.1 | 4.88 | 3.7E−01 | 23.42 |
| Control | | 118.75 | | | Control | | 3.95 | | |
| NUE569 | 9381.2 | 97.40 | 1.5E−01 | 20.5 | NUE585 | 9662.4 | 4.65 | 3.3E−01 | 26.10 |
| NUE569 | 9381.3 | 108.85 | 7.3E−02 | 34.7 | NUE585 | 9661.5 | 4.78 | 5.4E−02 | 29.49 |
| NUE569 | 9384.2 | 93.95 | 9.3E−02 | 16.2 | NUE585 | 9661.3 | 3.90 | 6.6E−01 | 5.76 |
| Control | | 80.83 | | | NUE585 | 9662.1 | 4.00 | 6.9E−01 | 8.47 |
| NUE570 | 9311.4 | 127.53 | 1.3E−01 | 33.0 | NUE585 | 9661.1 | 4.43 | 2.5E−01 | 20.00 |
| NUE570 | 9314.1 | 135.55 | 3.8E−01 | 41.4 | Control | | 3.69 | | |
| NUE570 | 9312.3 | 143.83 | 3.5E−02 | 50.0 | NUE586 | 9751.1 | 5.38 | 1.9E−01 | 22.86 |
| Control | | 95.88 | | | NUE586 | 9751.7 | 6.43 | 1.4E−01 | 46.86 |
| NUE573 | 9491.1 | 135.18 | 6.0E−02 | 13.8 | NUE586 | 9752.1 | 8.15 | 3.7E−04 | 86.29 |
| Control | | 118.75 | | | Control | | 4.38 | | |
| NUE574 | 10364.2 | 110.48 | 2.1E−02 | 28.5 | NUE587 | 9643.2 | 7.45 | 8.6E−03 | 70.29 |
| NUE574 | 10362.2 | 89.95 | 7.8E−01 | 4.6 | NUE587 | 9643.1 | 5.58 | 9.3E−02 | 27.43 |
| NUE574 | 10366.2 | 153.38 | 8.1E−02 | 78.3 | NUE587 | 9642.2 | 4.50 | 8.7E−01 | 2.86 |
| Control | | 86.00 | | | NUE587 | 9641.3 | 6.88 | 4.2E−02 | 57.14 |
| NUE576 | 9791.3 | 164.75 | 1.6E−02 | 102.2 | Control | | 4.38 | | |
| NUE576 | 9792.3 | 90.20 | 4.8E−01 | 10.7 | NUE588 | 9591.3 | 5.03 | 5.9E−02 | 36.27 |
| NUE576 | 9792.4 | 106.40 | 1.0E−01 | 30.6 | NUE588 | 9591.4 | 3.75 | 9.4E−01 | 1.69 |
| NUE576 | 9794.1 | 108.43 | 1.9E−01 | 33.1 | NUE588 | 9592.2 | 4.68 | 1.2E−01 | 26.78 |
| NUE576 | 9793.3 | 136.93 | 6.6E−02 | 68.1 | NUE588 | 9592.4 | 4.98 | 1.7E−01 | 34.92 |
| Control | | 81.48 | | | NUE588 | 9592.1 | 3.98 | 7.2E−01 | 7.80 |
| NUE583 | 9673.4 | 171.65 | 5.2E−03 | 99.6 | Control | | 3.69 | | |
| NUE583 | 9673.2 | 117.30 | 3.2E−03 | 36.4 | NUE592 | 9744.5 | 9.000 | 3.7E−07 | 77.3 |
| Control | | 86.00 | | | NUE592 | 9747.5 | 7.900 | 2.1E−05 | 55.7 |
| NUE585 | 9662.4 | 135.60 | 1.7E−01 | 36.0 | Control | | 5.075 | | |
| NUE585 | 9661.5 | 122.20 | 6.2E−02 | 22.6 | | | | | |
| Control | | 99.68 | | | | | | | |
| NUE586 | 9751.1 | 153.83 | 2.1E−01 | 88.8 | | | | | |
| NUE586 | 9752.1 | 194.23 | 2.2E−02 | 138.4 | | | | | |
| Control | | 129.73 | | | | | | | |
| NUE587 | 9643.2 | 156.78 | 2.0E−01 | 92.4 | | | | | |
| NUE587 | 9641.3 | 180.28 | 6.6E−02 | 121.3 | | | | | |
| Control | | 129.73 | | | | | | | |

TABLE 24-continued

Transgenic plants exogenously expressing the polynucleotides of some embodiments of the invention exhibit improved plant biomass (fresh and dry weight) under nitrogen deficient conditions

| Gene Name | Event # | Plant Biomass Fresh Weight [mg] Average | p-value | % incr. | Gene Name | Event # | Plant Biomass Dry Weight [mg] Average | p-value | % incr. |
|---|---|---|---|---|---|---|---|---|---|
| NUE592 | 9744.5 | 187.48 | 1.8E−06 | 64.7 | | | | | |
| NUE592 | 9747.5 | 155.45 | 5.0E−03 | 36.6 | | | | | |
| Control | | 113.81 | | | | | | | |

Table 24: Analyses of plant biomass (plant fresh and dry weight) of transgenic plants overexpressing the exogenous polynucleotides of some embodiments of the invention (using the cloned or synthetic genes listed in Table 23 above) under the regulation of a constitutive promoter (35S) when grown under limiting nitrogen conditions [low nitrogen or nitrogen deficient conditions (0.75 mM N)] as compared to control plants.
"Incr." = increment.

TABLE 25

Transgenic plants exogenously expressing the polynucleotides of some embodiments of the invention exhibit improved plant biomass (leaf area) under nitrogen deficient conditions

| Gene Name | Event # | Leaf Area [cm$^2$] Average | p-value | % increment |
|---|---|---|---|---|
| CT11 | 4894.3 | 0.70 | 4.9E−02 | 43.10 |
| CT11 | 4892.3 | 0.77 | 4.0E−02 | 57.27 |
| CT11 | 4892.2 | 0.65 | 7.4E−02 | 33.68 |
| CT11 | 4893.2 | 0.51 | 6.3E−01 | 4.12 |
| CT11 | 4892.1 | 0.93 | 1.2E−02 | 91.25 |
| Control | | 0.49 | | |
| CT27 | 5033.7 | 0.40 | 8.2E−01 | 3.15 |
| CT27 | 5031.4 | 0.59 | 7.3E−04 | 50.88 |
| CT27 | 5035.2 | 0.52 | 9.6E−03 | 33.43 |
| CT27 | 5033.4 | 0.45 | 5.2E−01 | 14.02 |
| Control | | 0.39 | | |
| CT6 | 4943.1 | 0.58 | 1.1E−01 | 47.28 |
| CT6 | 4941.4 | 0.56 | 6.0E−02 | 43.93 |
| Control | | 0.39 | | |
| CT76 | 5044.6 | 0.58 | 2.9E−01 | 19.76 |
| CT76 | 5041.5 | 0.74 | 1.1E−01 | 50.86 |
| CT76 | 5043.5 | 0.81 | 2.8E−04 | 66.21 |
| CT76 | 5041.9 | 0.79 | 5.4E−02 | 61.76 |
| CT76 | 5041.6 | 0.80 | 7.2E−03 | 64.90 |
| Control | | 0.49 | | |
| CT81 | 4992.1 | 0.70 | 3.0E−04 | 44.35 |
| CT81 | 4993.6 | 0.50 | 8.2E−01 | 3.08 |
| CT81 | 4993.5 | 0.59 | 3.2E−01 | 20.36 |
| CT81 | 4992.2 | 0.69 | 8.9E−02 | 41.46 |
| Control | | 0.49 | | |
| NUE206 | 6731.2 | 0.34 | 1.4E−02 | 30.90 |
| NUE206 | 6732.7 | 0.30 | 1.9E−01 | 15.55 |
| Control | | 0.26 | | |
| NUE208 | 8354.8 | 0.33 | 4.7E−01 | 8.19 |
| NUE208 | 8351.3 | 0.43 | 5.8E−02 | 44.03 |
| NUE208 | 8355.3 | 0.37 | 7.4E−02 | 22.98 |
| NUE208 | 8351.5 | 0.31 | 7.3E−01 | 3.72 |
| Control | | 0.30 | | |
| NUE209 | 8192.13 | 0.39 | 1.6E−01 | 30.67 |
| NUE209 | 8192.14 | 0.47 | 5.9E−02 | 56.92 |
| NUE209 | 8191.5 | 0.32 | 6.9E−01 | 4.74 |
| Control | | 0.30 | | |
| NUE209 | 8192.13 | 0.45 | 4.7E−03 | 34.55 |
| NUE209 | 8191.5 | 0.51 | 2.8E−02 | 53.15 |
| NUE209 | 8192.14 | 0.40 | 1.5E−01 | 20.45 |
| Control | | 0.33 | | |
| NUE211 | 8265.1 | 0.35 | 7.9E−02 | 17.46 |
| Control | | 0.30 | | |
| NUE212 | 8335.2 | 0.43 | 1.7E−03 | 43.62 |
| NUE212 | 8334.1 | 0.33 | 5.3E−01 | 10.76 |
| NUE212 | 8331.4 | 0.44 | 3.5E−02 | 44.45 |
| Control | | 0.30 | | |
| NUE221 | 9801.1 | 0.500 | 1.0E−01 | 20.5 |
| NUE221 | 9802.8 | 0.505 | 8.2E−02 | 21.8 |
| NUE221 | 9806.1 | 0.666 | 4.2E−06 | 60.5 |
| Control | | 0.415 | | |
| NUE224 | 9001.3 | 0.62 | 1.7E−03 | 38.99 |
| Control | | 0.44 | | |
| NUE225 | 9732.8 | 0.445 | 5.6E−01 | 7.2 |
| NUE225 | 9734.5 | 0.484 | 1.8E−01 | 16.6 |
| NUE225 | 9734.9 | 0.439 | 6.4E−01 | 5.7 |
| Control | | 0.415 | | |
| NUE230 | 9154.2 | 0.52 | 7.3E−02 | 17.73 |
| NUE230 | 9151.2 | 0.50 | 1.2E−01 | 12.59 |
| Control | | 0.44 | | |
| NUE231 | 10633.3 | 0.573 | 2.8E−04 | 38.1 |
| Control | | 0.415 | | |
| NUE233 | 10174.3 | 0.47 | 8.4E−03 | 54.39 |
| NUE233 | 10174.1 | 0.75 | 2.8E−04 | 146.46 |
| NUE233 | 10172.5 | 0.32 | 6.6E−01 | 6.03 |
| NUE233 | 10173.7 | 0.39 | 3.5E−02 | 26.43 |
| Control | | 0.31 | | |
| NUE237 | 9651.1 | 0.52 | 4.4E−01 | 17.13 |
| NUE237 | 9654.4 | 0.57 | 1.1E−01 | 29.19 |
| NUE237 | 9654.1 | 0.54 | 2.2E−02 | 21.91 |
| Control | | 0.44 | | |
| NUE239 | 9191.1 | 0.66 | 4.6E−02 | 57.34 |
| Control | | 0.42 | | |
| NUE240 | 9172.2 | 0.68 | 1.4E−03 | 63.63 |
| NUE240 | 9174.3 | 0.55 | 7.7E−02 | 32.26 |
| Control | | 0.42 | | |
| NUE240 | 9174.2 | 0.54 | 7.7E−01 | 4.29 |
| NUE240 | 9172.1 | 0.71 | 7.8E−03 | 35.86 |
| NUE240 | 9174.3 | 0.57 | 4.2E−01 | 9.74 |
| Control | | 0.52 | | |
| NUE241 | 9633.4 | 0.56 | 2.1E−05 | 47.36 |
| NUE241 | 9632.2 | 0.44 | 1.4E−01 | 15.74 |
| NUE241 | 9632.4 | 0.49 | 2.4E−01 | 28.11 |
| Control | | 0.38 | | |
| NUE241 | 9631.3 | 0.53 | 3.9E−03 | 36.03 |
| NUE241 | 9632.3 | 0.54 | 7.5E−02 | 40.72 |
| NUE241 | 9632.4 | 0.49 | 1.1E−01 | 26.49 |
| Control | | 0.39 | | |
| NUE242 | 9212.1 | 0.56 | 2.9E−02 | 50.18 |
| NUE242 | 9213.4 | 0.43 | 1.3E−01 | 14.72 |
| Control | | 0.37 | | |
| NUE246 | 9033.6 | 0.44 | 8.7E−01 | 3.16 |
| NUE246 | 9033.8 | 0.51 | 1.8E−01 | 21.26 |
| NUE246 | 9033.4 | 0.50 | 2.6E−01 | 18.30 |
| NUE246 | 9034.1 | 0.64 | 2.1E−02 | 52.45 |
| NUE246 | 9031.1 | 0.49 | 4.7E−01 | 15.11 |
| Control | | 0.42 | | |
| NUE248 | 8981.5 | 0.58 | 4.6E−02 | 38.97 |
| NUE248 | 8981.2 | 0.51 | 3.1E−02 | 22.19 |
| Control | | 0.42 | | |

TABLE 25-continued

Transgenic plants exogenously expressing the polynucleotides of some embodiments of the invention exhibit improved plant biomass (leaf area) under nitrogen deficient conditions

| Gene Name | Event # | Leaf Area [cm$^2$] Average | p-value | % increment |
|---|---|---|---|---|
| NUE251 | 10181.3 | 0.54 | 7.6E−06 | 75.63 |
| NUE251 | 10183.2 | 0.42 | 2.3E−02 | 38.78 |
| NUE251 | 10183.1 | 0.42 | 5.4E−03 | 38.58 |
| Control | | 0.31 | | |
| NUE251 | 10183.2 | 0.84 | 1.0E−02 | 72.56 |
| NUE251 | 10182.1 | 0.57 | 1.2E−01 | 18.26 |
| Control | | 0.49 | | |
| NUE256 | 10063.4 | 0.43 | 6.3E−01 | 5.53 |
| NUE256 | 10064.1 | 0.54 | 1.3E−02 | 30.76 |
| NUE256 | 10061.1 | 0.45 | 5.2E−01 | 10.87 |
| Control | | 0.41 | | |
| NUE256 | 10063.4 | 0.58 | 6.6E−02 | 90.27 |
| NUE256 | 10064.1 | 0.59 | 1.1E−02 | 94.09 |
| NUE256 | 10061.2 | 0.68 | 9.5E−06 | 122.00 |
| NUE256 | 10062.4 | 0.64 | 8.2E−03 | 108.97 |
| NUE256 | 10063.2 | 0.52 | 9.2E−03 | 68.33 |
| Control | | 0.31 | | |
| NUE256 | 10061.2 | 0.75 | 5.3E−05 | 53.75 |
| NUE256 | 10061.4 | 0.71 | 1.4E−02 | 46.02 |
| NUE256 | 10063.2 | 0.52 | 4.1E−01 | 6.83 |
| Control | | 0.49 | | |
| NUE268 | 8996.5 | 0.65 | 4.3E−02 | 21.87 |
| Control | | 0.53 | | |
| NUE511 | 9273.1 | 0.47 | 4.7E−01 | 13.04 |
| NUE511 | 9271.2 | 0.54 | 2.2E−01 | 28.41 |
| Control | | 0.42 | | |
| NUE512 | 9282.3 | 0.72 | 2.1E−02 | 68.37 |
| NUE512 | 9284.4 | 0.60 | 7.8E−03 | 39.86 |
| Control | | 0.43 | | |
| NUE514 | 9404.1 | 0.49 | 1.1E−02 | 30.78 |
| NUE514 | 9402.2 | 0.41 | 5.1E−01 | 10.03 |
| NUE514 | 9403.2 | 0.42 | 1.5E−01 | 12.66 |
| NUE514 | 9402.5 | 0.42 | 5.1E−01 | 13.45 |
| Control | | 0.37 | | |
| NUE515 | 9712.5 | 0.454 | 4.5E−01 | 9.4 |
| NUE515 | 9713.6 | 0.648 | 1.7E−05 | 56.1 |
| Control | | 0.415 | | |
| NUE520 | 9771.4 | 0.40 | 3.1E−03 | 31.70 |
| Control | | 0.31 | | |
| NUE521 | 9362.2 | 0.50 | 7.5E−02 | 33.38 |
| NUE521 | 9361.2 | 0.43 | 1.6E−01 | 14.92 |
| NUE521 | 9363.4 | 0.57 | 1.3E−03 | 54.08 |
| Control | | 0.37 | | |
| NUE521 | 9363.4 | 0.63 | 8.6E−02 | 31.31 |
| Control | | 0.48 | | |
| NUE523 | 9412.5 | 0.59 | 1.9E−01 | 40.65 |
| NUE523 | 9414.2 | 0.48 | 1.6E−01 | 16.08 |
| NUE523 | 9412.1 | 0.65 | 7.4E−03 | 55.07 |
| Control | | 0.42 | | |
| NUE525 | 9531.2 | 0.44 | 2.9E−01 | 15.42 |
| NUE525 | 9534.1 | 0.45 | 3.8E−01 | 17.35 |
| NUE525 | 9531.3 | 0.51 | 6.2E−02 | 34.94 |
| NUE525 | 9533.1 | 0.54 | 6.9E−02 | 42.25 |
| NUE525 | 9531.1 | 0.49 | 2.7E−03 | 29.15 |
| Control | | 0.38 | | |
| NUE527 | 9201.1 | 0.44 | 6.7E−02 | 22.51 |
| Control | | 0.36 | | |
| NUE528 | 9072.1 | 0.48 | 4.5E−02 | 17.39 |
| NUE528 | 9073.1 | 0.42 | 7.8E−01 | 3.17 |
| Control | | 0.41 | | |
| NUE531 | 10083.1 | 0.74 | 2.0E−02 | 31.74 |
| NUE531 | 10082.2 | 0.69 | 3.0E−02 | 22.95 |
| NUE531 | 10081.4 | 0.75 | 8.8E−02 | 32.91 |
| NUE531 | 10081.5 | 0.75 | 1.3E−01 | 33.71 |
| Control | | 0.56 | | |
| NUE535 | 9082.2 | 0.37 | 4.1E−01 | 22.10 |
| NUE535 | 9084.2 | 0.37 | 4.6E−01 | 22.19 |
| NUE535 | 9081.1 | 0.43 | 1.7E−01 | 41.23 |
| NUE535 | 9083.1 | 0.63 | 2.8E−03 | 105.40 |
| NUE535 | 9084.4 | 0.46 | 8.7E−03 | 50.93 |
| Control | | 0.31 | | |
| NUE537 | 9391.2 | 0.65 | 1.6E−02 | 51.35 |
| NUE537 | 9393.3 | 0.76 | 3.4E−03 | 76.76 |
| Control | | 0.43 | | |
| NUE539 | 10101.5 | 0.53 | 1.2E−02 | 74.32 |
| NUE539 | 10103.5 | 0.50 | 6.6E−05 | 63.28 |
| NUE539 | 10101.2 | 0.60 | 7.3E−05 | 96.27 |
| NUE539 | 10101.7 | 0.68 | 3.9E−03 | 121.77 |
| NUE539 | 10103.4 | 0.32 | 8.9E−01 | 4.57 |
| Control | | 0.31 | | |
| NUE542 | 9333.2 | 0.56 | 2.0E−02 | 25.55 |
| Control | | 0.44 | | |
| NUE543 | 10051.2 | 0.43 | 4.6E−01 | 11.78 |
| NUE543 | 10051.6 | 0.52 | 1.7E−02 | 33.53 |
| Control | | 0.39 | | |
| NUE544 | 9764.2 | 0.49 | 9.7E−02 | 19.20 |
| Control | | 0.41 | | |
| NUE548 | 9095.2 | 0.59 | 3.4E−03 | 41.28 |
| NUE548 | 9095.3 | 0.47 | 3.1E−01 | 13.55 |
| NUE548 | 9092.2 | 0.55 | 1.8E−01 | 32.59 |
| Control | | 0.42 | | |
| NUE548 | 9095.2 | 0.67 | 3.3E−01 | 10.81 |
| NUE548 | 9095.4 | 0.82 | 5.7E−02 | 36.33 |
| NUE548 | 9091.1 | 0.71 | 2.4E−02 | 17.16 |
| Control | | 0.60 | | |
| NUE568 | 9471.3 | 0.54 | 3.5E−02 | 18.92 |
| NUE568 | 9472.2 | 0.64 | 3.6E−04 | 41.93 |
| Control | | 0.45 | | |
| NUE573 | 9491.4 | 0.59 | 6.8E−02 | 29.98 |
| NUE573 | 9491.1 | 0.51 | 6.1E−01 | 13.35 |
| NUE573 | 9494.3 | 0.52 | 2.8E−01 | 14.77 |
| Control | | 0.45 | | |
| NUE574 | 10364.2 | 0.63 | 8.1E−04 | 28.96 |
| NUE574 | 10366.2 | 0.81 | 4.0E−03 | 66.05 |
| Control | | 0.49 | | |
| NUE576 | 9791.3 | 0.47 | 8.9E−02 | 21.80 |
| NUE576 | 9792.3 | 0.39 | 9.8E−01 | 0.42 |
| NUE576 | 9792.4 | 0.48 | 1.5E−01 | 24.25 |
| NUE576 | 9794.1 | 0.46 | 1.3E−01 | 19.07 |
| NUE576 | 9793.3 | 0.49 | 6.6E−02 | 25.95 |
| Control | | 0.39 | | |
| NUE581 | 9723.6 | 0.449 | 5.0E−01 | 8.3 |
| NUE581 | 9724.9 | 0.583 | 1.5E−03 | 40.6 |
| Control | | 0.415 | | |
| NUE582 | 9562.4 | 0.54 | 7.0E−02 | 21.31 |
| NUE582 | 9561.2 | 0.51 | 6.2E−02 | 14.15 |
| Control | | 0.44 | | |
| NUE583 | 9673.1 | 0.56 | 6.5E−02 | 46.13 |
| Control | | 0.39 | | |
| NUE583 | 9673.4 | 0.91 | 2.1E−02 | 88.22 |
| NUE583 | 9673.2 | 0.65 | 8.8E−02 | 34.45 |
| Control | | 0.49 | | |
| NUE586 | 9751.7 | 0.52 | 3.8E−01 | 11.42 |
| NUE586 | 9752.1 | 0.62 | 1.1E−02 | 31.98 |
| Control | | 0.47 | | |
| NUE586 | 9751.7 | 0.50 | 2.3E−01 | 23.80 |
| NUE586 | 9751.3 | 0.42 | 6.9E−01 | 3.28 |
| NUE586 | 9752.4 | 0.53 | 3.2E−02 | 30.20 |
| NUE586 | 9752.1 | 0.53 | 2.9E−01 | 30.75 |
| Control | | 0.41 | | |
| NUE587 | 9643.2 | 0.58 | 1.5E−02 | 24.86 |
| Control | | 0.47 | | |
| NUE592 | 9741.7 | 0.462 | 3.7E−01 | 11.3 |
| NUE592 | 9744.5 | 0.721 | 4.3E−08 | 73.7 |
| NUE592 | 9747.4 | 0.472 | 2.7E−01 | 13.8 |
| NUE592 | 9747.5 | 0.711 | 1.0E−07 | 71.4 |
| Control | | | | |

Table 25: Analyses of plant biomass (leaf area) of transgenic plants overexpressing the exogenous polynucleotides of some embodiments of the invention (using the cloned or synthetic genes listed in Table 23 above) under the regulation of a constitutive promoter (35S) when grown under limiting nitrogen conditions [low nitrogen or nitrogen deficient conditions (0.75 mM N)] as compared to control plants.

The genes presented in Table 26, hereinbelow, have improved plant NUE since they produced larger root biomass when grown under limiting nitrogen growth conditions, compared to control plants. Plants producing larger root biomass have better possibilities to absorb larger amount of nitrogen from soil.

Table 26 depicts analyses of root biomass (root length and root coverage) when grown under limiting nitrogen conditions [low nitrogen or nitrogen deficient conditions (0.75 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the second experiment confirmed the significant increment in root performance. Event with p-value<0.1 was considered statistically significant.

TABLE 26

Transgenic plants exogenously expressing the polynucleotides of some embodiments of the invention exhibit improved root performance under nitrogen deficient conditions

| Gene Name | Event # | Roots Length [cm] | | | Gene Name | Event # | Roots Coverage [cm$^2$] | | |
|---|---|---|---|---|---|---|---|---|---|
| | | Ave. | p-value | % incr. | | | Ave. | p-value | % incr. |
| CT1 | 4844.5 | 3.445 | 1.1E−01 | 19.68 | CT11 | 4894.3 | 8.833 | 4.1E−01 | 16.49 |
| CT1 | 4841.2 | 3.580 | 2.6E−01 | 24.38 | CT11 | 4892.2 | 8.345 | 6.3E−01 | 10.06 |
| Control | | 2.879 | | | CT11 | 4892.1 | 9.792 | 8.1E−02 | 29.14 |
| CT27 | 5035.2 | 4.246 | 1.7E−03 | 47.50 | Control | | 7.582 | | |
| Control | | 2.879 | | | CT22 | 5023.1 | 4.110 | 2.1E−01 | 49.46 |
| CT27 | 5033.4 | 4.384 | 2.4E−02 | 29.17 | Control | | 2.750 | | |
| Control | | 3.394 | | | CT27 | 5031.4 | 5.380 | 5.8E−01 | 10.31 |
| CT75 | 4873.4 | 4.829 | 3.9E−01 | 9.29 | CT27 | 5033.4 | 6.993 | 1.0E−01 | 43.38 |
| CT75 | 4873.3 | 6.119 | 2.2E−03 | 38.51 | Control | | 4.877 | | |
| Control | | 4.418 | | | CT27 | 5035.2 | 5.220 | 3.8E−02 | 89.83 |
| CT76 | 5044.6 | 3.723 | 1.9E−01 | 9.70 | Control | | 2.750 | | |
| CT76 | 5041.5 | 4.025 | 3.1E−02 | 18.59 | CT6 | 4943.1 | 7.564 | 2.3E−01 | 55.08 |
| CT76 | 5043.5 | 3.614 | 6.2E−01 | 6.49 | CT6 | 4941.4 | 7.260 | 1.8E−01 | 48.86 |
| CT76 | 5041.6 | 3.651 | 2.9E−01 | 7.58 | Control | | 4.877 | | |
| CT76 | 5041.9 | 3.970 | 5.6E−02 | 16.98 | CT75 | 4873.4 | 5.384 | 6.2E−01 | 10.40 |
| Control | | 3.394 | | | CT75 | 4873.3 | 6.378 | 1.6E−01 | 30.78 |
| NUE206 | 6731.2 | 4.717 | 1.4E−03 | 36.19 | Control | | 4.877 | | |
| NUE206 | 6732.9 | 3.952 | 1.7E−01 | 14.11 | CT76 | 5044.6 | 4.762 | 2.6E−02 | 39.62 |
| NUE206 | 6732.5 | 3.624 | 7.7E−01 | 4.64 | CT76 | 5041.5 | 4.729 | 6.0E−02 | 38.66 |
| Control | | 3.463 | | | CT76 | 5043.5 | 5.470 | 1.3E−01 | 60.38 |
| NUE208 | 8355.3 | 4.721 | 7.5E−02 | 36.30 | CT76 | 5041.9 | 5.282 | 1.3E−02 | 54.87 |
| Control | | 3.463 | | | Control | | 3.410 | | |
| NUE209 | 8192.14 | 4.584 | 5.7E−02 | 32.34 | NUE206 | 6731.2 | 7.467 | 1.3E−01 | 95.14 |
| Control | | 3.463 | | | NUE206 | 6732.7 | 4.706 | 3.7E−01 | 22.98 |
| NUE212 | 8331.1 | 5.110 | 2.1E−01 | 9.85 | Control | | 3.826 | | |
| NUE212 | 8332.2 | 5.868 | 9.1E−02 | 26.14 | NUE206 | 6731.2 | 6.249 | 2.8E−02 | 92.41 |
| NUE212 | 8331.4 | 4.910 | 5.8E−01 | 5.55 | NUE206 | 6732.5 | 4.433 | 4.0E−01 | 36.49 |
| Control | | 4.652 | | | Control | | 3.248 | | |
| NUE221 | 9801.1 | 4.34 | 1.6E−01 | 13.5 | NUE208 | 8351.3 | 4.799 | 5.0E−01 | 17.29 |
| NUE221 | 9801.7 | 3.84 | 9.0E−01 | 0.4 | NUE208 | 8354.8 | 5.763 | 7.7E−02 | 40.86 |
| NUE221 | 9802.8 | 4.68 | 2.1E−02 | 22.5 | Control | | 4.091 | | |
| Control | | 3.82 | | | NUE209 | 8192.13 | 5.110 | 7.0E−02 | 24.91 |
| NUE222 | 8854.1 | 4.997 | 7.0E−02 | 7.48 | NUE209 | 8192.14 | 5.450 | 1.7E−01 | 33.21 |
| Control | | 4.649 | | | Control | | 4.091 | | |
| NUE223 | 9613.1 | 4.236 | 5.0E−01 | 10.38 | NUE209 | 8192.14 | 5.624 | 5.5E−02 | 73.16 |
| NUE223 | 9611.5 | 5.091 | 6.8E−03 | 32.67 | Control | | 3.248 | | |
| NUE223 | 9612.3 | 4.868 | 1.6E−01 | 26.86 | NUE210 | 8202.2 | 5.208 | 1.0E−01 | 27.29 |
| Control | | 3.837 | | | Control | | 4.091 | | |
| NUE225 | 9731.7 | 4.58 | 4.0E−02 | 20.0 | NUE212 | 8335.2 | 6.338 | 2.8E−02 | 54.92 |
| NUE225 | 9731.8 | 4.30 | 2.0E−01 | 12.5 | NUE212 | 8334.1 | 4.541 | 3.4E−01 | 10.99 |
| NUE225 | 9732.8 | 4.09 | 4.7E−01 | 6.9 | NUE212 | 8331.4 | 6.188 | 1.3E−01 | 51.26 |
| NUE225 | 9734.5 | 4.07 | 4.9E−01 | 6.5 | Control | | 4.091 | | |
| NUE225 | 9734.9 | 4.26 | 2.3E−01 | 11.5 | NUE212 | 8332.2 | 8.847 | 2.5E−01 | 56.56 |
| Control | | 3.82 | | | NUE212 | 8331.4 | 6.998 | 2.5E−01 | 23.84 |
| NUE228 | 10092.2 | 4.242 | 1.4E−01 | 13.89 | Control | | 5.651 | | |
| NUE228 | 10093.1 | 4.106 | 2.5E−01 | 10.23 | NUE221 | 9801.1 | 5.06 | 1.4E−01 | 29.7 |
| Control | | 3.725 | | | NUE221 | 9802.8 | 5.89 | 1.2E−03 | 50.9 |
| NUE231 | 10631.3 | 4.27 | 2.3E−01 | 11.6 | NUE221 | 9806.1 | 4.39 | 5.4E−01 | 12.3 |
| NUE231 | 10631.4 | 4.08 | 4.8E−01 | 6.8 | Control | | | | |
| NUE231 | 10633.3 | 4.34 | 1.6E−01 | 13.5 | NUE223 | 9613.1 | 5.411 | 2.9E−01 | 16.86 |
| Control | | 3.82 | | | NUE223 | 9612.3 | 5.162 | 2.9E−01 | 11.49 |
| NUE233 | 10174.3 | 3.942 | 4.0E−01 | 7.65 | Control | | 4.630 | | |
| NUE233 | 10174.1 | 4.973 | 2.8E−02 | 35.83 | NUE223 | 9611.5 | 8.701 | 1.9E−02 | 67.39 |
| NUE233 | 10173.5 | 4.903 | 2.0E−02 | 33.89 | NUE223 | 9612.3 | 6.493 | 2.6E−01 | 24.90 |
| NUE233 | 10172.5 | 4.240 | 1.3E−01 | 15.78 | Control | | 5.198 | | |
| NUE233 | 10173.7 | 4.289 | 1.7E−01 | 17.14 | NUE225 | 9731.7 | 4.77 | 2.7E−01 | 22.1 |
| Control | | 3.662 | | | Control | | 3.90 | | |
| NUE233 | 10174.1 | 4.253 | 1.5E−02 | 16.86 | NUE228 | 10092.2 | 5.763 | 7.2E−02 | 34.52 |
| NUE233 | 10173.5 | 4.101 | 3.7E−01 | 12.66 | NUE228 | 10093.3 | 5.099 | 1.5E−01 | 19.02 |
| NUE233 | 10172.5 | 3.911 | 1.0E−01 | 7.44 | NUE228 | 10093.1 | 5.468 | 1.2E−01 | 27.63 |
| NUE233 | 10173.7 | 4.544 | 1.3E−01 | 24.84 | Control | | 4.284 | | |

TABLE 26-continued

Transgenic plants exogenously expressing the polynucleotides of some embodiments of the invention exhibit improved root performance under nitrogen deficient conditions

| | | Roots Length [cm] | | | | | Roots Coverage [cm$^2$] | | |
|---|---|---|---|---|---|---|---|---|---|
| Gene Name | Event # | Ave. | p-value | % incr. | Gene Name | Event # | Ave. | p-value | % incr. |
| Control | | 3.640 | | | NUE231 | 10631.3 | 4.31 | 5.9E−01 | 10.5 |
| NUE234 | 9162.1 | 4.574 | 9.8E−02 | 23.62 | NUE231 | 10631.4 | 4.87 | 2.1E−01 | 24.8 |
| Control | | 3.700 | | | NUE231 | 10633.3 | 6.21 | 3.6E−03 | 59.1 |
| NUE235 | 9693.4 | 4.908 | 6.4E−02 | 22.32 | Control | | 3.492 | | |
| NUE235 | 9691.1 | 4.310 | 4.9E−01 | 7.43 | NUE233 | 10174.3 | 4.340 | 2.8E−01 | 24.27 |
| NUE235 | 9694.4 | 4.347 | 4.0E−01 | 8.36 | NUE233 | 10174.1 | 7.195 | 2.6E−04 | 106.04 |
| NUE235 | 9694.3 | 5.377 | 3.4E−02 | 34.03 | NUE233 | 10173.5 | 4.086 | 3.5E−01 | 17.00 |
| Control | | 4.012 | | | NUE233 | 10173.7 | 4.955 | 5.4E−02 | 41.90 |
| NUE239 | 9192.3 | 5.241 | 4.4E−04 | 36.59 | Control | | 3.492 | | |
| NUE239 | 9192.1 | 4.041 | 5.6E−01 | 5.31 | NUE235 | 9693.4 | 6.311 | 7.2E−03 | 44.37 |
| NUE239 | 9191.2 | 4.081 | 4.2E−01 | 6.35 | NUE235 | 9691.1 | 5.246 | 3.3E−02 | 20.00 |
| Control | | 3.837 | | | NUE235 | 9694.4 | 5.145 | 1.4E−01 | 17.69 |
| NUE240 | 9172.1 | 4.624 | 1.3E−02 | 20.49 | NUE235 | 9694.3 | 6.927 | 4.8E−02 | 58.46 |
| Control | | 3.837 | | | Control | | 4.371 | | |
| NUE241 | 9633.4 | 6.137 | 3.4E−06 | 52.97 | NUE237 | 9654.4 | 7.760 | 1.1E−01 | 38.68 |
| NUE241 | 9632.3 | 4.772 | 2.4E−01 | 18.94 | NUE237 | 9654.1 | 7.127 | 3.0E−01 | 27.37 |
| NUE241 | 9632.2 | 5.157 | 3.2E−04 | 28.54 | Control | | 5.596 | | |
| NUE241 | 9632.4 | 5.016 | 2.0E−01 | 25.02 | NUE239 | 9192.3 | 8.844 | 6.5E−05 | 70.14 |
| Control | | 4.012 | | | NUE239 | 9191.2 | 5.903 | 2.8E−01 | 13.55 |
| NUE242 | 9212.1 | 4.373 | 4.9E−01 | 6.96 | Control | | 5.198 | | |
| NUE242 | 9211.2 | 4.328 | 5.2E−01 | 5.86 | NUE240 | 9172.2 | 5.902 | 5.7E−02 | 27.47 |
| NUE242 | 9213.4 | 5.474 | 1.3E−03 | 33.89 | NUE240 | 9174.3 | 5.530 | 1.2E−01 | 19.43 |
| Control | | 4.088 | | | Control | | 4.630 | | |
| NUE242 | 9212.1 | 4.552 | 1.0E−01 | 29.06 | NUE240 | 9172.1 | 7.568 | 1.8E−02 | 45.59 |
| Control | | 3.527 | | | Control | | 5.198 | | |
| NUE245 | 10641.7 | 4.388 | 9.4E−02 | 20.56 | NUE241 | 9633.4 | 9.643 | 7.2E−07 | 120.61 |
| NUE245 | 10641.8 | 4.657 | 7.4E−03 | 27.95 | NUE241 | 9632.3 | 5.344 | 3.9E−01 | 22.26 |
| NUE245 | 10643.4 | 3.906 | 2.1E−01 | 7.31 | NUE241 | 9632.2 | 6.559 | 3.6E−02 | 50.05 |
| Control | | 3.640 | | | NUE241 | 9632.4 | 6.451 | 1.3E−01 | 47.58 |
| NUE246 | 9033.4 | 4.695 | 4.8E−01 | 7.49 | Control | | 4.371 | | |
| NUE246 | 9031.1 | 5.062 | 8.4E−02 | 15.90 | NUE241 | 9632.5 | 5.170 | 5.1E−01 | 15.54 |
| Control | | 4.368 | | | NUE241 | 9632.3 | 6.198 | 8.3E−02 | 38.51 |
| NUE250 | 9134.1 | 4.593 | 1.6E−01 | 5.15 | NUE241 | 9632.4 | 5.754 | 1.6E−01 | 28.58 |
| NUE250 | 9132.2 | 4.590 | 3.3E−01 | 5.09 | Control | | 4.475 | | |
| Control | | 4.088 | | | NUE242 | 9212.1 | 5.873 | 4.1E−01 | 11.59 |
| NUE251 | 10181.3 | 3.907 | 2.6E−01 | 7.34 | NUE242 | 9213.4 | 8.125 | 1.6E−02 | 54.40 |
| NUE251 | 10183.2 | 4.763 | 7.9E−02 | 30.87 | Control | | 5.262 | | |
| Control | | 3.640 | | | NUE242 | 9212.1 | 5.679 | 1.2E−01 | 67.87 |
| NUE256 | 10063.4 | 5.259 | 1.4E−02 | 43.63 | NUE242 | 9213.4 | 4.572 | 2.4E−01 | 35.15 |
| NUE256 | 10064.1 | 4.734 | 2.3E−02 | 29.28 | Control | | 3.383 | | |
| NUE256 | 10061.2 | 4.281 | 1.3E−01 | 16.92 | NUE245 | 10641.8 | 4.795 | 1.3E−01 | 22.01 |
| NUE256 | 10062.4 | 3.855 | 7.0E−01 | 5.28 | Control | | 3.930 | | |
| NUE256 | 10063.2 | 5.276 | 5.5E−03 | 44.10 | NUE246 | 9033.8 | 6.003 | 2.5E−01 | 20.21 |
| Control | | 3.662 | | | NUE246 | 9033.4 | 5.693 | 4.7E−01 | 14.00 |
| NUE512 | 9284.3 | 4.875 | 1.0E−01 | 17.48 | NUE246 | 9034.1 | 6.292 | 1.7E−01 | 25.99 |
| NUE512 | 9282.3 | 4.442 | 4.4E−01 | 7.05 | NUE246 | 9031.1 | 7.329 | 6.6E−03 | 46.77 |
| NUE512 | 9284.4 | 6.172 | 3.9E−04 | 48.73 | Control | | 4.994 | | |
| Control | | 4.150 | | | NUE250 | 9134.1 | 5.762 | 4.8E−01 | 9.49 |
| NUE513 | 9681.6 | 5.009 | 1.7E−03 | 30.52 | NUE250 | 9132.2 | 7.281 | 2.7E−01 | 38.35 |
| NUE513 | 9683.2 | 4.506 | 8.6E−02 | 17.42 | Control | | 5.262 | | |
| Control | | 3.837 | | | NUE251 | 10181.3 | 4.289 | 1.9E−01 | 22.81 |
| NUE514 | 9404.1 | 4.333 | 5.3E−01 | 5.99 | NUE251 | 10183.2 | 4.689 | 1.4E−01 | 34.27 |
| NUE514 | 9404.5 | 4.906 | 4.1E−02 | 20.00 | NUE251 | 10183.1 | 4.709 | 1.9E−01 | 34.86 |
| NUE514 | 9403.2 | 4.451 | 6.9E−02 | 8.87 | Control | | 3.492 | | |
| NUE514 | 9402.5 | 4.644 | 2.1E−01 | 13.59 | NUE251 | 10183.2 | 6.691 | 3.8E−02 | 70.25 |
| Control | | 4.088 | | | NUE251 | 10181.1 | 4.687 | 4.8E−01 | 19.25 |
| NUE514 | 9403.2 | 4.874 | 2.1E−02 | 38.20 | Control | | 3.930 | | |
| NUE514 | 9402.5 | 4.044 | 2.9E−01 | 14.65 | NUE256 | 10063.4 | 7.393 | 2.9E−02 | 111.70 |
| Control | | 3.527 | | | NUE256 | 10064.1 | 7.214 | 2.6E−02 | 106.59 |
| NUE515 | 9712.5 | 4.43 | 1.0E−01 | 15.9 | NUE256 | 10061.2 | 6.139 | 2.2E−03 | 75.81 |
| NUE515 | 9712.6 | 4.05 | 5.0E−01 | 5.8 | NUE256 | 10062.4 | 6.337 | 7.9E−02 | 81.46 |
| NUE515 | 9713.6 | 5.34 | 1.0E−04 | 39.7 | NUE256 | 10063.2 | 6.594 | 1.7E−02 | 88.81 |
| Control | | 3.82 | | | Control | | 3.492 | | |
| NUE520 | 9771.4 | 4.327 | 6.9E−02 | 16.16 | NUE256 | 10061.3 | 4.798 | 3.9E−02 | 22.09 |
| NUE520 | 9771.7 | 4.332 | 1.7E−01 | 16.28 | NUE256 | 10061.2 | 5.141 | 1.9E−02 | 30.82 |
| NUE520 | 9771.2 | 4.303 | 1.2E−01 | 15.52 | NUE256 | 10061.4 | 5.617 | 9.8E−02 | 42.92 |
| NUE520 | 9771.3 | 4.345 | 1.6E−01 | 16.66 | NUE256 | 10063.2 | 5.303 | 1.5E−02 | 34.95 |
| Control | | 3.725 | | | Control | | 3.930 | | |
| NUE520 | 9771.4 | 4.377 | 1.4E−01 | 19.54 | NUE268 | 8996.5 | 7.789 | 1.6E−02 | 40.04 |
| NUE520 | 9771.2 | 4.684 | 3.1E−02 | 27.93 | Control | | 5.562 | | |
| NUE520 | 9771.3 | 3.878 | 5.2E−01 | 5.90 | NUE512 | 9284.3 | 4.930 | 1.1E−01 | 21.84 |
| Control | | 3.662 | | | NUE512 | 9282.3 | 5.873 | 1.4E−01 | 45.13 |

TABLE 26-continued

Transgenic plants exogenously expressing the polynucleotides of some embodiments of the invention exhibit improved root performance under nitrogen deficient conditions

| Gene Name | Event # | Roots Length [cm] Ave. | p-value | % incr. | Gene Name | Event # | Roots Coverage [cm²] Ave. | p-value | % incr. |
|---|---|---|---|---|---|---|---|---|---|
| NUE523 | 9412.5 | 4.031 | 3.9E−01 | 14.28 | NUE512 | 9284.4 | 7.912 | 1.6E−03 | 95.53 |
| NUE523 | 9414.2 | 5.032 | 1.5E−03 | 42.68 | Control | | 4.047 | | |
| NUE523 | 9413.4 | 3.766 | 2.8E−01 | 6.78 | NUE513 | 9681.6 | 6.591 | 3.6E−02 | 26.79 |
| Control | | 3.527 | | | Control | | 5.198 | | |
| NUE523 | 9412.5 | 5.066 | 6.2E−01 | 7.98 | NUE514 | 9404.5 | 6.570 | 9.0E−02 | 24.84 |
| NUE523 | 9414.2 | 5.879 | 2.1E−04 | 25.30 | Control | | 5.262 | | |
| Control | | 4.692 | | | NUE514 | 9403.2 | 5.579 | 1.2E−02 | 64.94 |
| NUE525 | 9531.2 | 5.029 | 1.0E−03 | 25.34 | NUE514 | 9402.5 | 4.299 | 3.2E−01 | 27.09 |
| NUE525 | 9534.1 | 5.116 | 4.0E−02 | 27.51 | Control | | 3.383 | | |
| NUE525 | 9533.1 | 4.471 | 2.8E−01 | 11.43 | NUE515 | 9712.5 | 4.93 | 26.3 | 1.9E−01 |
| NUE525 | 9531.1 | 5.184 | 1.9E−01 | 29.21 | NUE515 | 9712.6 | 4.09 | 4.7 | 8.1E−01 |
| Control | | 4.012 | | | NUE515 | 9713.6 | 7.39 | 89.4 | 1.9E−05 |
| NUE531 | 10081.5 | 5.029 | 9.2E−02 | 35.00 | Control | | 3.90 | | |
| Control | | 3.725 | | | NUE519 | 9371.2 | 7.868 | 4.7E−01 | 51.36 |
| NUE531 | 10083.3 | 4.502 | 2.7E−03 | 23.69 | NUE519 | 9371.1 | 7.813 | 1.7E−01 | 50.30 |
| NUE531 | 10081.4 | 3.894 | 1.4E−01 | 6.98 | Control | | 5.198 | | |
| NUE531 | 10083.2 | 4.655 | 3.2E−02 | 27.89 | NUE520 | 9771.4 | 4.820 | 3.0E−01 | 12.51 |
| NUE531 | 10081.5 | 5.026 | 2.1E−02 | 38.08 | NUE520 | 9771.7 | 5.879 | 1.4E−02 | 37.23 |
| Control | | 3.640 | | | NUE520 | 9771.2 | 6.392 | 3.3E−02 | 49.20 |
| NUE536 | 9233.3 | 5.416 | 1.2E−02 | 24.00 | NUE520 | 9771.3 | 7.265 | 1.4E−02 | 69.57 |
| Control | | 4.368 | | | Control | | 4.284 | | |
| NUE539 | 10101.5 | 4.107 | 4.7E−01 | 12.17 | NUE520 | 9771.4 | 6.158 | 1.8E−02 | 76.34 |
| NUE539 | 10103.5 | 4.561 | 5.0E−02 | 24.57 | NUE520 | 9771.2 | 6.839 | 1.7E−02 | 95.84 |
| NUE539 | 10101.7 | 4.953 | 2.0E−02 | 35.27 | NUE520 | 9771.3 | 5.440 | 5.3E−03 | 55.77 |
| Control | | 3.662 | | | NUE520 | 9773.1 | 4.655 | 9.8E−02 | 33.29 |
| NUE539 | 10101.7 | 4.344 | 8.5E−02 | 19.36 | Control | | 3.492 | | |
| Control | | 3.640 | | | NUE521 | 9362.2 | 4.458 | 3.1E−01 | 31.79 |
| NUE543 | 10051.1 | 4.030 | 3.5E−01 | 8.20 | NUE521 | 9363.4 | 5.071 | 5.6E−02 | 49.90 |
| NUE543 | 10052.3 | 4.347 | 8.1E−02 | 16.70 | Control | | 3.383 | | |
| NUE543 | 10053.1 | 4.034 | 4.0E−01 | 8.29 | NUE523 | 9412.5 | 4.834 | 3.0E−01 | 42.92 |
| Control | | 3.725 | | | NUE523 | 9414.2 | 5.371 | 1.7E−04 | 58.79 |
| NUE563 | 9452.3 | 5.668 | 7.3E−02 | 41.27 | Control | | 3.383 | | |
| NUE563 | 9451.2 | 4.348 | 2.6E−01 | 8.38 | NUE523 | 9413.3 | 6.532 | 5.1E−01 | 20.78 |
| NUE563 | 9452.1 | 4.415 | 3.9E−01 | 10.04 | NUE523 | 9414.2 | 8.479 | 4.6E−02 | 56.78 |
| Control | | 4.012 | | | Control | | 5.408 | | |
| NUE566 | 9513.1 | 4.306 | 4.5E−01 | 7.32 | NUE525 | 9531.2 | 6.497 | 1.7E−04 | 48.62 |
| NUE566 | 9512.2 | 4.118 | 6.3E−01 | 2.63 | NUE525 | 9534.1 | 6.805 | 6.9E−02 | 55.67 |
| NUE566 | 9512.4 | 4.411 | 3.9E−01 | 9.95 | NUE525 | 9531.3 | 4.928 | 6.1E−01 | 12.73 |
| NUE566 | 9512.1 | 5.392 | 9.6E−02 | 34.39 | NUE525 | 9533.1 | 7.002 | 3.6E−02 | 60.17 |
| NUE566 | 9514.1 | 5.583 | 1.8E−05 | 39.15 | NUE525 | 9531.1 | 8.063 | 1.5E−01 | 84.46 |
| Control | | 4.012 | | | Control | | 4.371 | | |
| NUE574 | 10363.4 | 4.132 | 3.5E−01 | 13.52 | NUE531 | 10083.3 | 4.905 | 2.4E−02 | 24.81 |
| NUE574 | 10366.2 | 4.697 | 7.2E−02 | 29.04 | NUE531 | 10081.4 | 6.308 | 1.3E−02 | 60.52 |
| NUE574 | 10366.1 | 4.264 | 6.0E−03 | 17.15 | NUE531 | 10083.2 | 5.480 | 8.6E−02 | 39.45 |
| Control | | 3.640 | | | NUE531 | 10081.5 | 7.516 | 4.3E−02 | 91.25 |
| NUE581 | 9724.9 | 4.35 | 1.5E−01 | 13.8 | Control | | 3.930 | | |
| Control | | 3.82 | | | NUE536 | 9233.3 | 7.107 | 3.3E−02 | 42.30 |
| NUE583 | 9673.4 | 5.145 | 8.6E−02 | 41.35 | Control | | 4.994 | | |
| NUE583 | 9673.2 | 4.621 | 1.6E−02 | 26.95 | NUE537 | 9393.3 | 7.508 | 5.7E−02 | 85.53 |
| NUE583 | 9671.2 | 4.181 | 1.0E−01 | 14.88 | Control | | 4.047 | | |
| NUE583 | 9671.1 | 3.903 | 3.2E−01 | 7.24 | NUE539 | 10101.5 | 5.026 | 1.1E−01 | 43.93 |
| Control | | 3.640 | | | NUE539 | 10103.5 | 5.622 | 7.6E−03 | 60.99 |
| NUE586 | 9751.1 | 4.510 | 4.7E−01 | 7.36 | NUE539 | 10101.7 | 6.622 | 4.1E−03 | 89.62 |
| NUE586 | 9751.7 | 5.845 | 3.0E−03 | 39.13 | Control | | 3.492 | | |
| NUE586 | 9751.3 | 5.259 | 7.3E−02 | 25.20 | NUE543 | 10051.1 | 5.204 | 9.1E−02 | 21.47 |
| NUE586 | 9752.2 | 4.903 | 1.1E−01 | 16.71 | NUE543 | 10052.3 | 4.978 | 2.0E−01 | 16.20 |
| NUE586 | 9752.1 | 6.626 | 1.3E−05 | 57.73 | NUE543 | 10051.2 | 5.086 | 3.6E−01 | 18.73 |
| Control | | 4.201 | | | Control | | 4.284 | | |
| NUE586 | 9751.1 | 5.290 | 3.0E−01 | 13.71 | NUE544 | 9764.2 | 8.303 | 9.5E−02 | 46.92 |
| NUE586 | 9751.6 | 6.090 | 1.6E−03 | 30.92 | NUE544 | 9763.3 | 6.821 | 1.1E−01 | 20.71 |
| NUE586 | 9751.3 | 5.181 | 3.1E−01 | 11.38 | Control | | 5.651 | | |
| NUE586 | 9752.4 | 5.952 | 2.9E−03 | 27.96 | NUE548 | 9095.2 | 7.731 | 2.2E−01 | 46.90 |
| NUE586 | 9752.1 | 6.660 | 2.1E−04 | 43.17 | NUE548 | 9095.4 | 7.888 | 1.3E−01 | 49.89 |

TABLE 26-continued

Transgenic plants exogenously expressing the polynucleotides of some embodiments of the invention exhibit improved root performance under nitrogen deficient conditions

| Gene Name | Event # | Roots Length [cm] | | | Gene Name | Event # | Roots Coverage [cm$^2$] | | |
|---|---|---|---|---|---|---|---|---|---|
| | | Ave. | p-value | % incr. | | | Ave. | p-value | % incr. |
| Control | | 4.652 | | | NUE548 | 9091.1 | 6.011 | 2.7E−01 | 14.23 |
| NUE593 | 10391.2 | 4.849 | 8.9E−03 | 30.18 | Control | | 5.262 | | |
| NUE593 | 10394.1 | 4.390 | 2.4E−01 | 17.85 | NUE554 | 9115.2 | 7.603 | 3.2E−02 | 36.68 |
| NUE593 | 10394.2 | 4.698 | 3.3E−02 | 26.13 | Control | | 5.562 | | |
| Control | | 3.725 | | | NUE563 | 9452.3 | 9.266 | 1.7E−01 | 111.97 |
| NUE592 | 9741.7 | 4.08 | 4.8E−01 | 6.8 | NUE563 | 9451.2 | 6.068 | 1.3E−01 | 38.82 |
| NUE592 | 9747.4 | 4.00 | 6.2E−01 | 4.8 | NUE563 | 9452.1 | 5.145 | 1.2E−01 | 17.70 |
| NUE592 | 9747.5 | 4.70 | 1.8E−02 | 23.0 | Control | | 4.371 | | |
| Control | | 3.82 | | | NUE566 | 9513.1 | 5.537 | 2.0E−01 | 26.67 |
| | | | | | NUE566 | 9512.2 | 5.086 | 1.3E−01 | 16.36 |
| | | | | | NUE566 | 9512.1 | 7.608 | 1.0E−01 | 74.05 |
| | | | | | NUE566 | 9514.1 | 7.752 | 2.2E−03 | 77.33 |
| | | | | | Control | | 4.371 | | |
| | | | | | NUE569 | 9381.2 | 5.147 | 2.8E−02 | 21.78 |
| | | | | | Control | | 4.226 | | |
| | | | | | NUE570 | 9311.4 | 4.965 | 5.6E−01 | 22.69 |
| | | | | | NUE570 | 9314.4 | 5.327 | 8.0E−02 | 31.63 |
| | | | | | NUE570 | 9314.1 | 5.093 | 3.3E−01 | 25.85 |
| | | | | | Control | | 4.047 | | |
| | | | | | NUE574 | 10364.2 | 4.318 | 1.9E−01 | 9.88 |
| | | | | | NUE574 | 10366.2 | 7.430 | 5.1E−02 | 89.06 |
| | | | | | NUE574 | 10366.1 | 5.260 | 5.6E−02 | 33.83 |
| | | | | | Control | | 3.930 | | |
| | | | | | NUE581 | 9723.6 | 4.16 | 7.4E | 6.5 |
| | | | | | NUE581 | 9724.9 | 4.93 | 1.9E | 26.3 |
| | | | | | Control | | 3.90 | | |
| | | | | | NUE583 | 9673.4 | 8.986 | 1.7E−02 | 128.64 |
| | | | | | NUE583 | 9673.2 | 6.359 | 5.0E−02 | 61.80 |
| | | | | | NUE583 | 9671.2 | 4.956 | 1.0E−01 | 26.11 |
| | | | | | Control | | 3.930 | | |
| | | | | | NUE586 | 9751.1 | 5.324 | 5.1E−01 | 14.00 |
| | | | | | NUE586 | 9751.7 | 8.938 | 2.6E−02 | 91.38 |
| | | | | | NUE586 | 9751.3 | 6.250 | 8.3E−02 | 33.83 |
| | | | | | NUE586 | 9752.2 | 5.566 | 3.7E−01 | 19.18 |
| | | | | | NUE586 | 9752.1 | 10.320 | 9.6E−04 | 120.99 |
| | | | | | Control | | 4.670 | | |
| | | | | | NUE586 | 9751.1 | 7.261 | 2.8E−01 | 28.49 |
| | | | | | NUE586 | 9751.6 | 7.902 | 4.2E−02 | 39.83 |
| | | | | | NUE586 | 9751.7 | 6.250 | 6.0E−01 | 10.60 |
| | | | | | NUE586 | 9751.3 | 7.274 | 9.2E−02 | 28.71 |
| | | | | | NUE586 | 9752.4 | 8.572 | 6.8E−03 | 51.70 |
| | | | | | NUE586 | 9752.1 | 9.922 | 5.6E−02 | 75.58 |
| | | | | | Control | | 5.651 | | |
| | | | | | NUE587 | 9643.2 | 7.007 | 7.6E−02 | 50.03 |
| | | | | | Control | | 4.670 | | |
| | | | | | NUE592 | 9741.7 | 4.20 | 7.0E | 7.7 |
| | | | | | NUE592 | 9747.5 | 5.31 | 7.3E | 36.0 |
| | | | | | Control | | 3.90 | | |
| | | | | | NUE593 | 10391.2 | 5.167 | 2.6E−01 | 20.60 |
| | | | | | NUE593 | 10394.2 | 6.009 | 9.4E−02 | 40.25 |
| | | | | | Control | | 4.284 | | |

Table 26: Analyses of root performance (root length and coverage) of transgenic plants overexpressing the exogenous polynucleotides of some embodiments of the invention (using the cloned or synthetic genes listed in Table 23 above) under the regulation of a constitutive promoter (35S) when grown under limiting nitrogen conditions [low nitrogen or nitrogen deficient conditions (0.75 mM N)] as compared to control plants.
"Ave." = Average;
"Incr." = increment.

The genes presented in Tables 27 and 28, hereinbelow, have improved plant growth rate when grown under limiting nitrogen growth conditions, compared to control plants. Plants showing fast growth rate confirm a better plant establishment in soil under nitrogen deficient conditions. Faster growth was observed when growth rate of leaf area as well as root length and coverage was measured.

Table 27 and 28 depict analyses of plant growth rate of the leaf area, root coverage and root length when grown under limiting nitrogen conditions [low nitrogen or nitrogen deficient conditions (0.75 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the second experiment confirmed the significant increment in growth rate. Event with p-value<0.1 was considered statistically significant.

TABLE 27

Transgenic plants exogenously expressing the polynucleotides of some embodiments of the invention exhibit improved plant growth rate (relative growth rate of leaf area and root coverage) under nitrogen deficient conditions

| | | RGR Of Leaf Area | | | | | RGR Of Roots Coverage | | |
|---|---|---|---|---|---|---|---|---|---|
| Gene Name | Event # | Average | p-value | % Incr. | Gene Name | Event # | Average | p-value | % Incr. |
| CT11 | 4892.3 | 0.043 | 3.1E−01 | 14.75 | CT11 | 4894.3 | 1.07 | 2.6E−01 | 18.78 |
| CT11 | 4893.2 | 0.054 | 7.0E−02 | 43.87 | CT11 | 4892.2 | 1.02 | 4.7E−01 | 12.68 |
| Control | | 0.038 | | | CT11 | 4892.1 | 1.17 | 4.9E−02 | 29.43 |
| CT11 | 4894.3 | 0.071 | 3.2E−02 | 37.85 | Control | | 0.90 | | |
| CT11 | 4892.3 | 0.077 | 6.5E−03 | 47.95 | CT22 | 5023.1 | 0.49 | 6.6E−02 | 51.49 |
| CT11 | 4892.2 | 0.066 | 8.1E−02 | 27.89 | Control | | 0.32 | | |
| Control | | 0.052 | | | CT27 | 5033.7 | 0.51 | 5.1E−01 | 59.31 |
| CT27 | 5031.4 | 0.059 | 2.1E−03 | 56.19 | CT27 | 5031.4 | 0.66 | 4.4E−01 | 106.25 |
| CT27 | 5035.2 | 0.050 | 3.7E−02 | 31.33 | CT27 | 5035.2 | 0.48 | 3.3E−01 | 50.35 |
| Control | | 0.038 | | | CT27 | 5033.6 | 0.46 | 1.9E−01 | 41.98 |
| CT27 | 5035.2 | 0.052 | 1.4E−02 | 47.58 | CT27 | 5033.4 | 0.81 | 5.0E−02 | 152.27 |
| Control | | 0.035 | | | CT27 | 5033.8 | 0.36 | 4.5E−02 | 12.91 |
| CT27 | 5033.4 | 0.047 | 1.9E−01 | 28.65 | Control | | 0.32 | | |
| CT27 | 5033.8 | 0.062 | 1.7E−04 | 66.84 | CT6 | 4943.1 | 0.93 | 4.7E−02 | 60.75 |
| Control | | 0.037 | | | CT6 | 4941.4 | 0.88 | 3.3E−02 | 52.53 |
| CT6 | 4943.1 | 0.058 | 1.9E−02 | 54.43 | Control | | 0.58 | | |
| CT6 | 4941.4 | 0.058 | 1.2E−02 | 52.74 | CT75 | 4873.3 | 0.75 | 1.1E−01 | 30.24 |
| Control | | 0.038 | | | Control | | 0.58 | | |
| CT76 | 5044.6 | 0.059 | 3.8E−01 | 13.49 | CT76 | 5041.5 | 1.29 | 5.2E−02 | 43.20 |
| CT76 | 5041.5 | 0.075 | 2.9E−02 | 44.40 | CT76 | 5043.5 | 1.24 | 5.2E−02 | 37.15 |
| CT76 | 5043.5 | 0.082 | 2.8E−04 | 58.85 | CT76 | 5041.6 | 1.01 | 4.7E−01 | 11.99 |
| CT76 | 5041.9 | 0.084 | 4.2E−03 | 62.25 | Control | | 0.90 | | |
| CT76 | 5041.6 | 0.086 | 5.5E−04 | 65.56 | CT76 | 5044.6 | 0.59 | 3.6E−02 | 49.62 |
| Control | | 0.052 | | | CT76 | 5043.5 | 0.67 | 1.9E−02 | 71.45 |
| CT76 | 5044.6 | 0.044 | 2.9E−01 | 18.54 | CT76 | 5041.6 | 0.46 | 4.1E−01 | 17.98 |
| CT76 | 5041.5 | 0.050 | 5.8E−02 | 36.83 | CT76 | 5041.9 | 0.64 | 8.3E−03 | 64.17 |
| CT76 | 5043.5 | 0.075 | 1.6E−07 | 103.60 | Control | | 0.39 | | |
| CT76 | 5041.6 | 0.053 | 9.2E−03 | 43.71 | NUE206 | 6731.2 | 0.88 | 6.1E−03 | 107.33 |
| CT76 | 5041.9 | 0.055 | 7.7E−03 | 48.95 | NUE206 | 6732.7 | 0.54 | 2.5E−01 | 28.14 |
| Control | | 0.037 | | | Control | | 0.42 | | |
| CT81 | 4992.1 | 0.074 | 1.9E−03 | 43.33 | NUE206 | 6731.2 | 0.73 | 3.0E−04 | 103.93 |
| CT81 | 4993.5 | 0.061 | 2.8E−01 | 17.47 | NUE206 | 6732.9 | 0.46 | 1.5E−01 | 29.09 |
| CT81 | 4992.2 | 0.072 | 2.3E−02 | 38.79 | NUE206 | 6732.5 | 0.51 | 1.5E−01 | 42.93 |
| Control | | 0.052 | | | Control | | 0.36 | | |
| NUE206 | 6731.2 | 0.035 | 2.0E−02 | 39.25 | NUE208 | 8354.8 | 0.58 | 3.9E−01 | 18.43 |
| NUE206 | 6732.7 | 0.032 | 6.4E−02 | 28.96 | NUE208 | 8351.3 | 0.71 | 3.7E−02 | 44.72 |
| Control | | 0.025 | | | Control | | 0.49 | | |
| NUE208 | 8351.3 | 0.046 | 1.0E−02 | 54.30 | NUE208 | 8355.3 | 0.72 | 9.1E−03 | 100.13 |
| NUE208 | 8355.3 | 0.038 | 9.5E−02 | 28.29 | Control | | 0.36 | | |
| Control | | 0.030 | | | NUE209 | 8192.13 | 0.63 | 1.3E−01 | 28.43 |
| NUE208 | 8355.3 | 0.073 | 2.0E−02 | 55.84 | NUE209 | 8192.14 | 0.65 | 1.1E−01 | 32.34 |
| Control | | 0.047 | | | Control | | 0.49 | | |
| NUE209 | 8192.13 | 0.043 | 3.2E−02 | 44.12 | NUE209 | 8192.14 | 0.65 | 4.0E−03 | 79.86 |
| NUE209 | 8192.14 | 0.047 | 6.9E−03 | 60.54 | Control | | 0.36 | | |
| Control | | 0.030 | | | NUE212 | 8332.2 | 0.64 | 2.2E−02 | 70.92 |
| NUE209 | 8192.13 | 0.047 | 2.2E−02 | 38.99 | NUE212 | 8334.1 | 0.61 | 1.5E−01 | 63.17 |
| NUE209 | 8191.5 | 0.055 | 4.8E−04 | 64.77 | Control | | 0.37 | | |
| NUE209 | 8192.14 | 0.041 | 1.2E−01 | 22.52 | NUE212 | 8335.2 | 0.75 | 1.1E−02 | 52.25 |
| Control | | 0.033 | | | NUE212 | 8331.4 | 0.76 | 2.4E−02 | 54.17 |
| NUE209 | 8192.14 | 0.071 | 2.5E−03 | 52.94 | Control | | 0.49 | | |
| NUE209 | 8191.3 | 0.057 | 2.2E−01 | 22.44 | NUE212 | 8332.2 | 1.08 | 2.7E−02 | 58.34 |
| Control | | 0.047 | | | NUE212 | 8331.4 | 0.87 | 1.6E−01 | 27.37 |
| NUE212 | 8335.2 | 0.041 | 1.9E−02 | 40.11 | Control | | 0.68 | | |
| NUE212 | 8331.4 | 0.046 | 8.8E−03 | 54.77 | NUE223 | 9611.5 | 1.06 | 8.9E−04 | 67.16 |
| Control | | 0.030 | | | NUE223 | 9612.3 | 0.77 | 2.3E−01 | 21.00 |
| NUE212 | 8332.1 | 0.062 | 4.8E−03 | 50.03 | Control | | 0.63 | | |
| Control | | 0.041 | | | NUE228 | 10092.2 | 0.70 | 2.0E−02 | 41.76 |
| NUE224 | 9001.3 | 0.064 | 5.9E−04 | 41.00 | NUE228 | 10093.3 | 0.61 | 1.5E−01 | 23.30 |
| Control | | 0.045 | | | NUE228 | 10093.1 | 0.66 | 5.5E−02 | 33.53 |
| NUE230 | 9154.2 | 0.054 | 8.1E−02 | 19.70 | Control | | 0.49 | | |
| NUE230 | 9151.2 | 0.052 | 1.5E−01 | 14.88 | NUE233 | 10174.3 | 0.52 | 2.2E−01 | 27.38 |
| Control | | 0.045 | | | NUE233 | 10174.1 | 0.86 | 1.1E−05 | 111.13 |
| NUE230 | 9153.3 | 0.046 | 3.5E−02 | 23.46 | NUE233 | 10173.7 | 0.59 | 4.2E−02 | 45.30 |
| Control | | 0.038 | | | Control | | 0.41 | | |
| NUE233 | 10174.3 | 0.047 | 2.8E−03 | 52.81 | NUE233 | 10174.1 | 0.56 | 8.1E−02 | 22.89 |
| NUE233 | 10174.1 | 0.075 | 5.3E−09 | 141.80 | NUE233 | 10173.7 | 0.72 | 2.7E−03 | 57.48 |
| NUE233 | 10173.7 | 0.040 | 4.3E−02 | 28.55 | Control | | 0.46 | | |
| Control | | 0.031 | | | NUE234 | 9162.1 | 0.51 | 5.1E−02 | 39.40 |
| NUE237 | 9651.1 | 0.051 | 4.5E−01 | 12.77 | Control | | 0.37 | | |
| NUE237 | 9654.4 | 0.059 | 2.5E−02 | 31.14 | NUE235 | 9693.4 | 0.68 | 2.5E−03 | 44.45 |
| NUE237 | 9654.1 | 0.056 | 2.6E−02 | 24.39 | NUE235 | 9691.1 | 0.56 | 2.0E−01 | 18.18 |
| Control | | 0.045 | | | NUE235 | 9694.4 | 0.55 | 2.3E−01 | 15.87 |

TABLE 27-continued

Transgenic plants exogenously expressing the polynucleotides of some embodiments of the invention exhibit improved plant growth rate (relative growth rate of leaf area and root coverage) under nitrogen deficient conditions

| | | RGR Of Leaf Area | | | | | RGR Of Roots Coverage | | |
|---|---|---|---|---|---|---|---|---|---|
| Gene Name | Event # | Average | p-value | % Incr. | Gene Name | Event # | Average | p-value | % Incr. |
| NUE239 | 9191.1 | 0.063 | 1.3E−02 | 58.77 | NUE235 | 9694.3 | 0.76 | 1.1E−03 | 60.48 |
| Control | | 0.040 | | | Control | | 0.47 | | |
| NUE239 | 9192.3 | 0.061 | 5.3E−02 | 25.48 | NUE237 | 9654.4 | 0.93 | 7.8E−02 | 39.79 |
| Control | | 0.048 | | | NUE237 | 9654.1 | 0.84 | 2.4E−01 | 26.90 |
| NUE240 | 9172.2 | 0.067 | 1.5E−03 | 68.99 | Control | | 0.66 | | |
| NUE240 | 9174.3 | 0.052 | 1.4E−01 | 29.40 | NUE239 | 9191.1 | 0.75 | 6.5E−02 | 36.48 |
| Control | | 0.040 | | | Control | | 0.55 | | |
| NUE240 | 9172.1 | 0.068 | 4.1E−03 | 41.05 | NUE239 | 9192.3 | 1.08 | 7.2E−05 | 71.00 |
| Control | | 0.048 | | | NUE239 | 9191.2 | 0.73 | 3.5E−01 | 14.79 |
| NUE241 | 9633.4 | 0.053 | 4.5E−04 | 58.65 | Control | | 0.63 | | |
| NUE241 | 9632.2 | 0.042 | 7.6E−02 | 26.55 | NUE240 | 9172.2 | 0.73 | 5.1E−02 | 33.21 |
| NUE241 | 9632.4 | 0.045 | 6.8E−02 | 35.24 | NUE240 | 9174.3 | 0.68 | 1.4E−01 | 23.94 |
| Control | | 0.033 | | | Control | | 0.55 | | |
| NUE241 | 9632.3 | 0.056 | 2.2E−02 | 43.54 | NUE240 | 9172.1 | 0.93 | 8.4E−03 | 46.95 |
| Control | | 0.039 | | | Control | | 0.63 | | |
| NUE242 | 9212.1 | 0.053 | 4.2E−03 | 49.38 | NUE241 | 9633.4 | 1.05 | 5.1E−09 | 121.17 |
| NUE242 | 9213.4 | 0.041 | 2.2E−01 | 15.83 | NUE241 | 9632.3 | 0.56 | 3.0E−01 | 17.76 |
| Control | | 0.036 | | | NUE241 | 9632.2 | 0.70 | 4.2E−03 | 47.48 |
| NUE245 | 10641.7 | 0.064 | 3.3E−02 | 39.30 | NUE241 | 9632.4 | 0.68 | 2.6E−02 | 42.78 |
| Control | | 0.046 | | | Control | | 0.47 | | |
| NUE246 | 9033.8 | 0.047 | 5.0E−01 | 13.54 | NUE241 | 9632.3 | 0.73 | 8.7E−02 | 37.63 |
| NUE246 | 9033.4 | 0.053 | 1.8E−01 | 27.65 | NUE241 | 9632.4 | 0.68 | 1.8E−01 | 28.48 |
| NUE246 | 9034.1 | 0.067 | 1.3E−02 | 63.07 | Control | | 0.53 | | |
| Control | | 0.041 | | | NUE242 | 9214.1 | 0.82 | 5.3E−01 | 34.65 |
| NUE248 | 8981.5 | 0.059 | 1.8E−02 | 42.38 | NUE242 | 9213.4 | 0.98 | 4.4E−04 | 61.42 |
| Control | | 0.041 | | | Control | | 0.61 | | |
| NUE250 | 9132.1 | 0.051 | 2.9E−01 | 13.50 | NUE242 | 9212.1 | 0.69 | 2.3E−03 | 76.75 |
| NUE250 | 9132.2 | 0.051 | 4.2E−01 | 12.43 | NUE242 | 9213.4 | 0.55 | 4.3E−02 | 40.32 |
| NUE250 | 9134.1 | 0.055 | 5.3E−02 | 21.91 | Control | | 0.39 | | |
| Control | | 0.045 | | | NUE245 | 10641.7 | 0.67 | 5.7E−03 | 46.73 |
| NUE251 | 10181.3 | 0.052 | 3.2E−05 | 67.47 | NUE245 | 10641.8 | 0.57 | 4.6E−02 | 24.96 |
| NUE251 | 10183.2 | 0.044 | 1.1E−02 | 41.23 | NUE245 | 10643.4 | 0.50 | 4.1E−01 | 10.90 |
| NUE251 | 10183.1 | 0.043 | 1.1E−02 | 38.27 | Control | | 0.46 | | |
| Control | | 0.031 | | | NUE246 | 9033.8 | 0.72 | 2.4E−01 | 22.81 |
| NUE251 | 10183.2 | 0.084 | 2.2E−05 | 83.75 | NUE246 | 9033.4 | 0.69 | 3.8E−01 | 17.06 |
| NUE251 | 10182.1 | 0.057 | 8.1E−02 | 23.66 | NUE246 | 9034.1 | 0.78 | 1.5E−01 | 32.69 |
| NUE251 | 10181.1 | 0.048 | 7.3E−01 | 4.28 | NUE246 | 9031.1 | 0.90 | 1.2E−02 | 52.58 |
| Control | | 0.046 | | | Control | | 0.59 | | |
| NUE256 | 10063.4 | 0.045 | 4.9E−01 | 10.33 | NUE248 | 8981.5 | 0.70 | 7.3E−02 | 30.02 |
| NUE256 | 10064.1 | 0.057 | 1.5E−02 | 37.35 | Control | | 0.53 | | |
| Control | | 0.041 | | | NUE250 | 9134.1 | 0.68 | 3.3E−01 | 12.73 |
| NUE256 | 10063.4 | 0.061 | 8.1E−04 | 96.42 | NUE250 | 9132.2 | 0.89 | 3.6E−02 | 46.62 |
| NUE256 | 10064.1 | 0.063 | 1.3E−05 | 104.87 | Control | | 0.61 | | |
| NUE256 | 10061.2 | 0.065 | 1.0E−07 | 110.14 | NUE251 | 10183.2 | 0.81 | 8.3E−05 | 77.68 |
| NUE256 | 10062.4 | 0.062 | 2.3E−05 | 99.98 | NUE251 | 10181.1 | 0.56 | 1.8E−01 | 24.08 |
| NUE256 | 10063.2 | 0.054 | 1.7E−04 | 74.87 | Control | | 0.46 | | |
| Control | | 0.031 | | | NUE254 | 8972.4 | 0.74 | 6.0E−02 | 38.45 |
| NUE256 | 10061.2 | 0.071 | 6.0E−04 | 55.03 | Control | | 0.53 | | |
| NUE256 | 10061.4 | 0.068 | 4.1E−03 | 47.93 | NUE256 | 10063.4 | 0.88 | 2.3E−04 | 115.25 |
| NUE256 | 10063.2 | 0.051 | 3.9E−01 | 11.43 | NUE256 | 10064.1 | 0.89 | 1.6E−04 | 117.15 |
| Control | | 0.046 | | | NUE256 | 10061.2 | 0.74 | 5.9E−04 | 81.36 |
| NUE511 | 9271.2 | 0.056 | 2.6E−02 | 50.68 | NUE256 | 10062.4 | 0.77 | 4.0E−03 | 87.01 |
| Control | | 0.040 | | | NUE256 | 10063.2 | 0.78 | 7.9E−04 | 90.93 |
| NUE512 | 9282.3 | 0.072 | 3.6E−04 | 68.22 | Control | | 0.41 | | |
| NUE512 | 9284.4 | 0.059 | 8.0E−03 | 38.67 | NUE256 | 10061.3 | 0.55 | 7.7E−02 | 20.48 |
| Control | | 0.043 | | | NUE256 | 10061.2 | 0.61 | 1.1E−02 | 34.76 |
| NUE514 | 9404.1 | 0.047 | 3.4E−02 | 30.81 | NUE256 | 10061.4 | 0.67 | 6.4E−03 | 46.55 |
| NUE514 | 9402.2 | 0.041 | 3.3E−01 | 14.01 | NUE256 | 10063.2 | 0.63 | 6.6E−03 | 39.24 |
| NUE514 | 9403.2 | 0.042 | 1.7E−01 | 17.39 | Control | | 0.46 | | |
| Control | | 0.036 | | | NUE268 | 8996.5 | 0.95 | 7.5E−03 | 46.67 |
| NUE516 | 9291.1 | 0.051 | 3.6E−01 | 12.83 | Control | | 0.65 | | |
| NUE516 | 9291.4 | 0.058 | 5.2E−02 | 28.67 | NUE512 | 9284.3 | 0.59 | 1.2E−01 | 24.74 |
| Control | | 0.045 | | | NUE512 | 9282.3 | 0.72 | 1.5E−02 | 51.97 |
| NUE519 | 9371.2 | 0.065 | 7.6E−02 | 34.99 | NUE512 | 9284.4 | 0.94 | 7.5E−06 | 98.41 |
| NUE519 | 9371.1 | 0.059 | 1.7E−01 | 22.69 | Control | | 0.47 | | |
| Control | | 0.048 | | | NUE513 | 9681.6 | 0.77 | 1.4E−01 | 21.72 |
| NUE521 | 9362.2 | 0.050 | 7.7E−03 | 41.00 | Control | | 0.63 | | |
| NUE521 | 9361.2 | 0.041 | 3.1E−01 | 15.27 | NUE514 | 9404.1 | 0.72 | 2.6E−01 | 17.95 |
| NUE521 | 9363.4 | 0.056 | 1.4E−04 | 56.51 | NUE514 | 9404.5 | 0.79 | 2.9E−02 | 30.17 |
| Control | | 0.036 | | | Control | | 0.61 | | |
| NUE521 | 9362.2 | 0.057 | 3.4E−01 | 16.01 | NUE514 | 9403.2 | 0.67 | 3.9E−05 | 71.81 |
| NUE521 | 9363.4 | 0.065 | 6.3E−02 | 31.54 | NUE514 | 9402.5 | 0.52 | 5.8E−02 | 34.24 |

TABLE 27-continued

Transgenic plants exogenously expressing the polynucleotides of some embodiments of the invention exhibit improved plant growth rate (relative growth rate of leaf area and root coverage) under nitrogen deficient conditions

| | | RGR Of Leaf Area | | | | | RGR Of Roots Coverage | | |
|---|---|---|---|---|---|---|---|---|---|
| Gene Name | Event # | Average | p-value | % Incr. | Gene Name | Event # | Average | p-value | % Incr. |
| Control | | 0.049 | | | Control | | 0.39 | | |
| NUE523 | 9412.5 | 0.048 | 4.9E−02 | 33.67 | NUE519 | 9371.2 | 0.97 | 5.6E−02 | 52.96 |
| NUE523 | 9414.2 | 0.043 | 9.2E−02 | 20.21 | NUE519 | 9371.1 | 0.96 | 2.5E−02 | 51.45 |
| Control | | 0.036 | | | Control | | 0.63 | | |
| NUE523 | 9412.5 | 0.058 | 7.6E−02 | 41.83 | NUE520 | 9771.4 | 0.59 | 2.1E−01 | 20.79 |
| NUE523 | 9414.2 | 0.049 | 2.2E−01 | 19.88 | NUE520 | 9771.7 | 0.72 | 9.4E−03 | 47.07 |
| NUE523 | 9412.1 | 0.062 | 5.2E−03 | 49.67 | NUE520 | 9771.2 | 0.78 | 4.4E−03 | 59.79 |
| Control | | 0.041 | | | NUE520 | 9771.3 | 0.89 | 5.5E−04 | 81.39 |
| NUE525 | 9531.2 | 0.043 | 8.9E−02 | 27.96 | Control | | 0.49 | | |
| NUE525 | 9534.1 | 0.042 | 1.4E−01 | 27.19 | NUE520 | 9771.4 | 0.76 | 1.5E−03 | 85.18 |
| NUE525 | 9531.3 | 0.046 | 3.9E−02 | 36.82 | NUE520 | 9771.2 | 0.83 | 3.7E−04 | 102.18 |
| NUE525 | 9533.1 | 0.048 | 1.6E−02 | 42.76 | NUE520 | 9771.3 | 0.66 | 5.4E−03 | 60.90 |
| NUE525 | 9531.1 | 0.045 | 3.5E−02 | 36.14 | NUE520 | 9773.1 | 0.57 | 1.1E−01 | 39.32 |
| Control | | 0.033 | | | Control | | 0.41 | | |
| NUE531 | 10083.1 | 0.070 | 5.6E−02 | 24.91 | NUE521 | 9362.2 | 0.55 | 5.4E−02 | 39.89 |
| NUE531 | 10082.2 | 0.067 | 1.1E−01 | 20.04 | NUE521 | 9361.3 | 0.46 | 2.1E−01 | 18.65 |
| NUE531 | 10081.4 | 0.070 | 1.2E−01 | 24.78 | NUE521 | 9363.2 | 0.63 | 1.4E−03 | 61.36 |
| NUE531 | 10081.5 | 0.073 | 8.2E−02 | 30.25 | Control | | 0.39 | | |
| Control | | 0.056 | | | NUE523 | 9412.5 | 0.58 | 5.0E−02 | 49.67 |
| NUE531 | 10081.4 | 0.051 | 4.0E−01 | 11.96 | NUE523 | 9414.2 | 0.63 | 9.9E−06 | 61.62 |
| NUE531 | 10081.5 | 0.090 | 1.3E−05 | 95.63 | Control | | 0.39 | | |
| Control | | 0.046 | | | NUE523 | 9413.3 | 0.80 | 2.6E−01 | 24.87 |
| NUE532 | 9222.4 | 0.050 | 1.6E−01 | 40.00 | NUE523 | 9414.2 | 1.03 | 3.8E−03 | 60.15 |
| Control | | 0.036 | | | Control | | 0.64 | | |
| NUE535 | 9082.2 | 0.040 | 1.7E−01 | 29.19 | NUE523 | 9412.5 | 1.03 | 5.0E−02 | 44.09 |
| NUE535 | 9084.2 | 0.037 | 2.0E−01 | 17.89 | NUE523 | 9414.2 | 1.05 | 7.8E−03 | 47.15 |
| NUE535 | 9081.1 | 0.045 | 4.7E−02 | 45.68 | Control | | 0.71 | | |
| NUE535 | 9083.1 | 0.059 | 9.9E−06 | 91.43 | NUE525 | 9531.2 | 0.71 | 1.1E−03 | 50.16 |
| NUE535 | 9084.4 | 0.046 | 6.1E−03 | 49.99 | NUE525 | 9534.1 | 0.76 | 3.0E−03 | 59.45 |
| Control | | 0.031 | | | NUE525 | 9531.3 | 0.55 | 3.9E−01 | 15.44 |
| NUE537 | 9391.2 | 0.067 | 8.9E−04 | 57.56 | NUE525 | 9533.1 | 0.75 | 1.1E−03 | 57.42 |
| NUE537 | 9393.3 | 0.078 | 3.4E−06 | 83.37 | NUE525 | 9531.1 | 0.88 | 9.0E−04 | 85.07 |
| Control | | 0.043 | | | Control | | 0.47 | | |
| NUE539 | 10103.5 | 0.060 | 7.5E−02 | 45.45 | NUE527 | 9201.2 | 0.91 | 6.0E−02 | 39.82 |
| Control | | 0.041 | | | Control | | 0.65 | | |
| NUE539 | 10101.5 | 0.052 | 6.3E−04 | 68.95 | NUE528 | 9073.1 | 0.91 | 8.8E−02 | 33.70 |
| NUE539 | 10103.5 | 0.052 | 2.7E−05 | 67.92 | Control | | 0.68 | | |
| NUE539 | 10101.2 | 0.058 | 4.6E−06 | 85.91 | NUE531 | 10081.4 | 0.65 | 1.2E−01 | 33.32 |
| NUE539 | 10101.7 | 0.067 | 1.3E−06 | 115.49 | NUE531 | 10081.5 | 0.95 | 6.1E−03 | 93.18 |
| Control | | 0.031 | | | Control | | 0.49 | | |
| NUE542 | 9333.2 | 0.058 | 1.7E−02 | 27.22 | NUE531 | 10083.3 | 0.56 | 5.7E−02 | 22.09 |
| Control | | 0.045 | | | NUE531 | 10081.4 | 0.76 | 2.5E−04 | 67.03 |
| NUE543 | 10051.2 | 0.043 | 4.9E−01 | 11.08 | NUE531 | 10083.2 | 0.65 | 7.4E−03 | 42.46 |
| NUE543 | 10051.6 | 0.052 | 2.6E−02 | 32.97 | NUE531 | 10081.5 | 0.88 | 5.5E−05 | 94.20 |
| Control | | 0.039 | | | Control | | 0.46 | | |
| NUE548 | 9095.2 | 0.058 | 1.9E−02 | 45.78 | NUE535 | 9084.2 | 0.87 | 1.1E−01 | 34.81 |
| NUE548 | 9092.2 | 0.054 | 1.1E−01 | 34.83 | Control | | 0.65 | | |
| Control | | 0.040 | | | NUE536 | 9233.3 | 0.85 | 2.7E−02 | 45.06 |
| NUE548 | 9095.2 | 0.067 | 2.0E−01 | 16.93 | Control | | 0.59 | | |
| NUE548 | 9095.4 | 0.082 | 6.7E−03 | 43.33 | NUE537 | 9393.2 | 0.50 | 9.3E−02 | 28.21 |
| NUE548 | 9091.1 | 0.070 | 7.8E−02 | 21.75 | NUE537 | 9393.3 | 0.49 | 8.0E−02 | 25.71 |
| Control | | 0.057 | | | Control | | 0.39 | | |
| NUE554 | 9115.2 | 0.067 | 8.8E−02 | 26.21 | NUE537 | 9393.3 | 0.92 | 5.4E−04 | 95.13 |
| Control | | 0.053 | | | Control | | 0.47 | | |
| NUE560 | 9424.3 | 0.069 | 4.8E−02 | 39.85 | NUE539 | 10101.5 | 0.62 | 3.4E−02 | 50.84 |
| Control | | 0.049 | | | NUE539 | 10103.5 | 0.66 | 6.2E−03 | 61.79 |
| NUE564 | 9242.2 | 0.066 | 8.5E−03 | 54.86 | NUE539 | 10101.7 | 0.80 | 2.0E−04 | 96.01 |
| Control | | 0.043 | | | Control | | 0.41 | | |
| NUE566 | 9512.1 | 0.052 | 2.2E−02 | 56.47 | NUE544 | 9764.2 | 1.00 | 2.7E−02 | 46.55 |
| Control | | 0.033 | | | NUE544 | 9763.3 | 0.80 | 2.7E−01 | 17.81 |
| NUE567 | 9263.3 | 0.053 | 1.8E−01 | 25.10 | Control | | 0.68 | | |
| Control | | 0.043 | | | NUE545 | 9482.4 | 0.61 | 7.1E−02 | 28.80 |
| NUE568 | 9471.3 | 0.051 | 2.9E−01 | 14.08 | Control | | 0.47 | | |
| NUE568 | 9472.2 | 0.062 | 5.2E−03 | 40.02 | NUE548 | 9095.2 | 0.72 | 1.2E−01 | 30.12 |
| Control | | 0.045 | | | Control | | 0.55 | | |
| NUE570 | 9314.1 | 0.064 | 6.7E−02 | 32.94 | NUE548 | 9095.2 | 0.96 | 1.5E−02 | 57.39 |
| Control | | 0.048 | | | NUE548 | 9095.4 | 0.97 | 4.3E−03 | 59.52 |
| NUE573 | 9491.4 | 0.058 | 6.1E−02 | 30.87 | NUE548 | 9091.1 | 0.74 | 1.1E−01 | 22.28 |
| NUE573 | 9494.3 | 0.055 | 1.4E−01 | 23.73 | Control | | 0.61 | | |
| Control | | 0.045 | | | NUE550 | 9141.3 | 0.83 | 1.4E−01 | 28.42 |
| NUE574 | 10364.2 | 0.062 | 1.0E−02 | 34.44 | Control | | 0.65 | | |
| NUE574 | 10362.2 | 0.048 | 6.7E−01 | 5.59 | NUE554 | 9115.2 | 0.93 | 1.7E−02 | 43.12 |

TABLE 27-continued

Transgenic plants exogenously expressing the polynucleotides of some embodiments of the invention exhibit improved plant growth rate (relative growth rate of leaf area and root coverage) under nitrogen deficient conditions

| Gene Name | Event # | RGR Of Leaf Area Average | p-value | % Incr. | Gene Name | Event # | RGR Of Roots Coverage Average | p-value | % Incr. |
|---|---|---|---|---|---|---|---|---|---|
| NUE574 | 10366.2 | 0.079 | 6.5E−05 | 72.54 | Control | | 0.65 | | |
| Control | | 0.046 | | | NUE563 | 9452.3 | 1.02 | 3.8E−03 | 114.90 |
| NUE576 | 9791.3 | 0.046 | 2.5E−01 | 17.12 | NUE563 | 9451.2 | 0.65 | 3.0E−02 | 36.75 |
| NUE576 | 9792.4 | 0.050 | 9.0E−02 | 27.76 | Control | | 0.47 | | |
| NUE576 | 9794.1 | 0.048 | 9.8E−02 | 24.04 | NUE564 | 9242.3 | 0.58 | 2.0E−01 | 21.75 |
| NUE576 | 9793.3 | 0.048 | 1.4E−01 | 22.67 | NUE564 | 9242.2 | 0.71 | 3.1E−02 | 49.74 |
| Control | | 0.039 | | | NUE564 | 9243.4 | 0.65 | 9.3E−02 | 37.10 |
| NUE582 | 9562.4 | 0.056 | 4.1E−02 | 24.61 | Control | | 0.47 | | |
| Control | | 0.045 | | | NUE566 | 9513.1 | 0.58 | 1.3E−01 | 23.35 |
| NUE583 | 9673.1 | 0.056 | 3.2E−02 | 43.43 | NUE566 | 9512.2 | 0.56 | 1.7E−01 | 17.73 |
| Control | | 0.039 | | | NUE566 | 9512.1 | 0.79 | 5.1E−03 | 67.15 |
| NUE583 | 9673.4 | 0.092 | 3.5E−05 | 100.45 | NUE566 | 9514.1 | 0.86 | 2.8E−05 | 80.42 |
| NUE583 | 9673.2 | 0.063 | 2.5E−02 | 38.28 | Control | | 0.47 | | |
| Control | | 0.046 | | | NUE567 | 9263.3 | 0.66 | 7.7E−02 | 39.99 |
| NUE586 | 9751.6 | 0.047 | 4.2E−01 | 12.92 | Control | | 0.47 | | |
| NUE586 | 9751.7 | 0.049 | 3.1E−01 | 19.09 | NUE567 | 9263.3 | 0.97 | 5.0E−02 | 42.53 |
| NUE586 | 9752.4 | 0.057 | 2.6E−02 | 36.93 | Control | | 0.68 | | |
| NUE586 | 9752.1 | 0.058 | 1.0E−01 | 39.90 | NUE569 | 9381.2 | 0.60 | 8.8E−02 | 20.49 |
| Control | | 0.041 | | | NUE569 | 9381.5 | 0.59 | 2.1E−01 | 19.31 |
| | | | | | Control | | 0.50 | | |
| | | | | | NUE570 | 9311.4 | 0.60 | 2.9E−01 | 27.17 |
| | | | | | NUE570 | 9314.4 | 0.64 | 4.5E−02 | 35.92 |
| | | | | | NUE570 | 9314.1 | 0.61 | 1.6E−01 | 29.32 |
| | | | | | Control | | 0.47 | | |
| | | | | | NUE570 | 9314.4 | 0.63 | 2.6E−01 | 26.50 |
| | | | | | NUE570 | 9314.1 | 0.81 | 1.1E−02 | 64.12 |
| | | | | | Control | | 0.50 | | |
| | | | | | NUE571 | 9304.2 | 0.84 | 1.4E−01 | 30.16 |
| | | | | | Control | | 0.64 | | |
| | | | | | NUE574 | 10364.2 | 0.51 | 2.5E−01 | 12.29 |
| | | | | | NUE574 | 10366.2 | 0.91 | 7.6E−05 | 99.71 |
| | | | | | NUE574 | 10366.1 | 0.63 | 6.2-E−03 | 38.15 |
| | | | | | Control | | 0.46 | | |
| | | | | | NUE583 | 9673.4 | 1.08 | 7.4E−07 | 136.31 |
| | | | | | NUE583 | 9673.2 | 0.76 | 3.4E−04 | 67.32 |
| | | | | | NUE583 | 9671.2 | 0.58 | 3.4E−02 | 27.94 |
| | | | | | Control | | 0.46 | | |
| | | | | | NUE586 | 9751.7 | 1.08 | 4.4E−04 | 90.56 |
| | | | | | NUE586 | 9751.3 | 0.73 | 1.3E−01 | 28.69 |
| | | | | | NUE586 | 9752.1 | 1.23 | 1.1E−06 | 117.25 |
| | | | | | Control | | 0.57 | | |
| | | | | | NUE586 | 9751.1 | 0.86 | 1.9E−01 | 26.09 |
| | | | | | NUE586 | 9751.6 | 0.93 | 5.1E−02 | 35.91 |
| | | | | | NUE586 | 9751.3 | 0.89 | 9.6E−02 | 30.27 |
| | | | | | NUE586 | 9752.4 | 1.02 | 9.5E−03 | 49.17 |
| | | | | | NUE586 | 9752.1 | 1.16 | 6.5E−03 | 69.78 |
| | | | | | Control | | 0.68 | | |
| | | | | | NUE587 | 9643.2 | 0.85 | 2.3E−02 | 50.29 |
| | | | | | Control | | 0.57 | | |
| | | | | | NUE593 | 10394.2 | 0.72 | 1.5E−02 | 46.89 |
| | | | | | Control | | 0.49 | | |

Table 27: Analyses of plant growth rate (relative growth rate of leaf area and root coverage) of transgenic plants overexpressing the exogenous polynucleotides of some embodiments of the invention (using the cloned or synthetic genes listed in Table 23 above) under the regulation of a constitutive promoter (35S) when grown under limiting nitrogen conditions [low nitrogen or nitrogen deficient conditions (0.75 mM N)] as compared to control plants.

"Incr." = increment;

"RGR" = relative growth rate.

TABLE 28

Transgenic plants exogenously expressing the polynucleotides of some embodiments of the invention exhibit improved plant growth rate (relative growth rate of root length) under nitrogen deficient conditions

| Gene Name | Event # | RGR Of Roots Length Average | p-value | % incr. |
|---|---|---|---|---|
| CT1 | 4841.1 | 0.325 | 4.6E−01 | 14.92 |
| CT1 | 4844.5 | 0.386 | 3.9E−02 | 36.53 |
| CT1 | 4841.2 | 0.399 | 5.1E−02 | 41.25 |
| Control | | 0.282 | | |
| CT11 | 4892.1 | 0.612 | 9.8E−02 | 15.48 |
| Control | | 0.530 | | |
| CT22 | 5023.1 | 0.373 | 9.6E−02 | 32.01 |
| Control | | 0.282 | | |
| CT27 | 5033.4 | 0.394 | 5.2E−02 | 29.10 |
| CT27 | 5033.8 | 0.350 | 2.6E−01 | 14.96 |
| Control | | 0.305 | | |
| CT6 | 4945.8 | 0.460 | 2.1E−01 | 17.91 |
| CT6 | 4943.1 | 0.548 | 2.0E−02 | 40.56 |
| Control | | 0.390 | | |
| CT75 | 4873.4 | 0.473 | 1.5E−01 | 21.17 |
| CT75 | 4873.3 | 0.532 | 1.3E−02 | 36.39 |
| Control | | 0.390 | | |
| CT76 | 5044.6 | 0.408 | 1.1E−02 | 33.88 |
| CT76 | 5043.5 | 0.389 | 7.9E−02 | 27.59 |
| CT76 | 5041.9 | 0.381 | 6.4E−02 | 25.11 |
| Control | | 0.305 | | |
| NUE206 | 6731.2 | 0.496 | 5.5E−03 | 49.81 |
| NUE206 | 6732.7 | 0.395 | 1.8E−01 | 19.18 |
| Control | | 0.331 | | |
| NUE206 | 6731.2 | 0.501 | 1.2E−05 | 64.61 |
| NUE206 | 6732.9 | 0.417 | 8.6E−03 | 37.13 |
| Control | | 0.304 | | |
| NUE208 | 8351.3 | 0.477 | 7.4E−02 | 22.59 |
| Control | | 0.389 | | |
| NUE208 | 8355.3 | 0.500 | 7.9E−04 | 64.40 |
| Control | | 0.304 | | |
| NUE209 | 8192.13 | 0.506 | 1.6E−02 | 30.23 |
| NUE209 | 8192.14 | 0.475 | 9.5E−02 | 22.29 |
| Control | | 0.389 | | |
| NUE209 | 8191.2 | 0.421 | 5.1E−02 | 36.60 |
| NUE209 | 8192.13 | 0.394 | 7.1E−02 | 27.85 |
| NUE209 | 8191.5 | 0.410 | 3.0E−02 | 32.93 |
| Control | | 0.308 | | |
| NUE209 | 8192.14 | 0.452 | 5.1E−03 | 48.66 |
| Control | | 0.304 | | |
| NUE210 | 8202.2 | 0.462 | 9.4E−02 | 18.92 |
| Control | | 0.389 | | |
| NUE210 | 6755.3 | 0.421 | 3.2E−02 | 36.49 |
| Control | | 0.308 | | |
| NUE212 | 8332.2 | 0.455 | 1.7E−02 | 47.71 |
| NUE212 | 8334.1 | 0.426 | 1.6E−01 | 38.40 |
| Control | | 0.308 | | |
| NUE212 | 8331.4 | 0.504 | 2.3E−02 | 29.68 |
| Control | | 0.389 | | |
| NUE212 | 8331.1 | 0.584 | 6.4E−02 | 24.96 |
| NUE212 | 8332.2 | 0.597 | 8.7E−02 | 27.76 |
| NUE212 | 8331.4 | 0.567 | 1.3E−01 | 21.20 |
| Control | | 0.468 | | |
| NUE223 | 9611.5 | 0.537 | 4.1E−03 | 35.20 |
| NUE223 | 9612.3 | 0.466 | 2.5E−01 | 17.18 |
| Control | | 0.397 | | |
| NUE228 | 10092.2 | 0.426 | 5.6E−02 | 29.90 |
| NUE228 | 10093.3 | 0.422 | 8.2E−02 | 28.77 |
| NUE228 | 10093.1 | 0.408 | 1.1E−01 | 24.40 |
| Control | | 0.328 | | |
| NUE233 | 10174.3 | 0.391 | 3.9E−01 | 14.35 |
| NUE233 | 10174.1 | 0.471 | 4.7E−02 | 37.60 |
| NUE233 | 10173.5 | 0.461 | 5.6E−02 | 34.78 |
| NUE233 | 10172.5 | 0.412 | 2.3E−01 | 20.55 |
| NUE233 | 10173.7 | 0.407 | 2.8E−01 | 19.07 |
| Control | | 0.342 | | |
| NUE233 | 10174.1 | 0.404 | 1.2E−03 | 29.24 |
| NUE233 | 10173.5 | 0.362 | 2.5E−01 | 15.71 |
| NUE233 | 10172.5 | 0.362 | 6.0E−02 | 15.79 |
| NUE233 | 10173.7 | 0.436 | 3.6E−03 | 39.35 |
| Control | | 0.313 | | |
| NUE234 | 9162.1 | 0.426 | 5.9E−02 | 25.45 |
| Control | | 0.340 | | |
| NUE235 | 9693.4 | 0.451 | 1.4E−02 | 25.62 |
| NUE235 | 9694.3 | 0.517 | 4.3E−04 | 43.98 |
| Control | | 0.359 | | |
| NUE239 | 9191.1 | 0.435 | 3.5E−01 | 10.73 |
| NUE239 | 9194.3 | 0.482 | 4.7E−02 | 22.75 |
| Control | | 0.393 | | |
| NUE239 | 9192.3 | 0.565 | 2.7E−04 | 42.18 |
| NUE239 | 9192.1 | 0.447 | 2.6E−01 | 12.34 |
| NUE239 | 9191.2 | 0.449 | 2.2E−01 | 13.06 |
| Control | | 0.397 | | |
| NUE240 | 9172.2 | 0.490 | 1.2E−02 | 24.73 |
| Control | | 0.393 | | |
| NUE240 | 9172.1 | 0.507 | 1.4E−02 | 27.47 |
| Control | | 0.397 | | |
| NUE241 | 9633.4 | 0.554 | 8.4E−07 | 54.27 |
| NUE241 | 9632.3 | 0.407 | 2.8E−01 | 13.32 |
| NUE241 | 9632.2 | 0.466 | 1.7E−03 | 29.87 |
| NUE241 | 9632.4 | 0.432 | 1.5E−01 | 20.52 |
| Control | | 0.359 | | |
| NUE242 | 9212.1 | 0.429 | 2.2E−01 | 13.68 |
| NUE242 | 9213.4 | 0.544 | 4.7E−05 | 44.09 |
| Control | | 0.377 | | |
| NUE242 | 9212.1 | 0.462 | 1.1E−03 | 54.42 |
| NUE242 | 9211.2 | 0.403 | 7.9E−02 | 34.60 |
| NUE242 | 9213.4 | 0.347 | 2.6E−01 | 16.09 |
| Control | | 0.299 | | |
| NUE245 | 10643.1 | 0.351 | 2.1E−01 | 12.20 |
| NUE245 | 10641.7 | 0.414 | 3.8E−03 | 32.32 |
| NUE245 | 10641.8 | 0.434 | 2.5E−04 | 38.90 |
| NUE245 | 10643.4 | 0.377 | 2.2E−02 | 20.56 |
| Control | | 0.313 | | |
| NUE246 | 9033.4 | 0.504 | 1.2E−01 | 21.54 |
| NUE246 | 9034.1 | 0.510 | 1.4E−01 | 22.94 |
| NUE246 | 9031.1 | 0.524 | 5.4E−02 | 26.35 |
| Control | | 0.414 | | |
| NUE250 | 9134.1 | 0.433 | 1.4E−01 | 14.91 |
| NUE250 | 9132.2 | 0.482 | 2.4E−02 | 27.68 |
| Control | | 0.377 | | |
| NUE251 | 10183.1 | 0.460 | 6.6E−02 | 34.46 |
| Control | | 0.342 | | |
| NUE251 | 10181.3 | 0.337 | 3.8E−01 | 7.88 |
| NUE251 | 10183.2 | 0.485 | 1.4E−04 | 55.27 |
| NUE251 | 10182.1 | 0.391 | 3.4E−02 | 25.13 |
| NUE251 | 10183.1 | 0.323 | 6.8E−01 | 3.24 |
| NUE251 | 10181.1 | 0.361 | 2.5E−01 | 15.54 |
| Control | | 0.313 | | |
| NUE252 | 9011.3 | 0.468 | 6.8E−03 | 24.03 |
| NUE252 | 9012.2 | 0.438 | 1.2E−01 | 16.22 |
| NUE252 | 9013.2 | 0.458 | 8.4E−02 | 21.40 |
| Control | | 0.377 | | |
| NUE254 | 8972.4 | 0.508 | 2.7E−03 | 27.22 |
| Control | | 0.399 | | |
| NUE256 | 10063.4 | 0.507 | 1.5E−02 | 48.06 |
| NUE256 | 10064.1 | 0.525 | 4.0E−03 | 53.43 |
| NUE256 | 10061.2 | 0.431 | 1.4E−01 | 26.08 |
| NUE256 | 10063.2 | 0.518 | 6.8E−03 | 51.45 |
| Control | | 0.342 | | |
| NUE256 | 10061.3 | 0.383 | 6.3E−02 | 22.55 |
| NUE256 | 10061.2 | 0.368 | 6.1E−02 | 17.75 |
| NUE256 | 10061.4 | 0.432 | 3.7E−04 | 38.10 |
| NUE256 | 10063.2 | 0.434 | 3.8E−05 | 38.83 |
| Control | | 0.313 | | |
| NUE512 | 9282.3 | 0.479 | 5.0E−02 | 22.43 |
| NUE512 | 9284.4 | 0.525 | 3.4E−03 | 34.40 |
| Control | | 0.391 | | |
| NUE513 | 9681.4 | 0.489 | 1.7E−01 | 18.01 |
| NUE513 | 9683.5 | 0.518 | 8.4E−02 | 24.96 |
| Control | | 0.414 | | |
| NUE513 | 9681.6 | 0.475 | 6.5E−02 | 19.62 |

TABLE 28-continued

Transgenic plants exogenously expressing the polynucleotides of some embodiments of the invention exhibit improved plant growth rate (relative growth rate of root length) under nitrogen deficient conditions

| Gene Name | Event # | RGR Of Roots Length Average | p-value | % incr. |
|---|---|---|---|---|
| Control | | 0.397 | | |
| NUE513 | 9683.5 | 0.515 | 8.4E−02 | 16.54 |
| Control | | 0.442 | | |
| NUE514 | 9404.1 | 0.471 | 2.5E−02 | 24.98 |
| NUE514 | 9402.2 | 0.445 | 9.9E−02 | 17.92 |
| NUE514 | 9404.5 | 0.493 | 4.6E−03 | 30.81 |
| NUE514 | 9403.2 | 0.443 | 4.8E−02 | 17.37 |
| NUE514 | 9402.5 | 0.503 | 3.8E−03 | 33.24 |
| Control | | 0.377 | | |
| NUE514 | 9404.1 | 0.371 | 3.0E−02 | 23.82 |
| NUE514 | 9403.2 | 0.471 | 4.9E−05 | 57.43 |
| NUE514 | 9402.5 | 0.442 | 9.5E−04 | 47.79 |
| Control | | 0.299 | | |
| NUE519 | 9371.2 | 0.513 | 1.3E−01 | 29.00 |
| NUE519 | 9371.1 | 0.555 | 1.8E−02 | 39.76 |
| Control | | 0.397 | | |
| NUE520 | 9771.4 | 0.486 | 2.5E−03 | 48.07 |
| NUE520 | 9771.7 | 0.471 | 1.1E−02 | 43.62 |
| NUE520 | 9771.2 | 0.463 | 9.8E−03 | 41.14 |
| NUE520 | 9771.3 | 0.463 | 2.4E−02 | 41.09 |
| Control | | 0.328 | | |
| NUE520 | 9771.4 | 0.476 | 3.4E−02 | 39.14 |
| NUE520 | 9771.2 | 0.478 | 3.0E−02 | 39.79 |
| Control | | 0.342 | | |
| NUE521 | 9362.2 | 0.414 | 1.2E−02 | 38.49 |
| NUE521 | 9361.3 | 0.383 | 8.8E−03 | 27.99 |
| NUE521 | 9363.4 | 0.456 | 1.0E−04 | 52.49 |
| Control | | 0.299 | | |
| NUE523 | 9412.5 | 0.410 | 2.6E−02 | 36.99 |
| NUE523 | 9414.2 | 0.495 | 1.1E−06 | 65.32 |
| NUE523 | 9412.1 | 0.364 | 7.6E−02 | 21.51 |
| NUE523 | 9413.4 | 0.372 | 3.3E−02 | 24.28 |
| Control | | 0.299 | | |
| NUE523 | 9412.5 | 0.525 | 1.7E−01 | 18.63 |
| NUE523 | 9414.2 | 0.552 | 6.9E−03 | 24.85 |
| Control | | 0.442 | | |
| NUE525 | 9531.2 | 0.465 | 3.5E−03 | 29.55 |
| NUE525 | 9534.1 | 0.506 | 5.7E−04 | 40.93 |
| NUE525 | 9531.1 | 0.494 | 4.1E−03 | 37.67 |
| Control | | 0.359 | | |
| NUE531 | 10082.2 | 0.413 | 1.1E−01 | 25.96 |
| NUE531 | 10081.5 | 0.451 | 5.6E−02 | 37.34 |
| Control | | 0.328 | | |
| NUE531 | 10083.3 | 0.387 | 8.0E−03 | 23.90 |
| NUE531 | 10082.2 | 0.359 | 2.2E−01 | 14.68 |
| NUE531 | 10081.4 | 0.366 | 5.7E−02 | 17.00 |
| NUE531 | 10083.2 | 0.445 | 5.0E−04 | 42.20 |
| NUE531 | 10081.5 | 0.478 | 2.9E−05 | 52.87 |
| Control | | 0.313 | | |
| NUE536 | 9233.3 | 0.511 | 8.2E−02 | 23.25 |
| Control | | 0.414 | | |
| NUE537 | 9393.2 | 0.409 | 2.5E−03 | 36.75 |
| NUE537 | 9393.3 | 0.415 | 1.8E−03 | 38.64 |
| Control | | 0.299 | | |
| NUE537 | 9393.3 | 0.496 | 1.4E−02 | 26.83 |
| Control | | 0.391 | | |
| NUE539 | 10101.5 | 0.454 | 9.5E−02 | 32.65 |
| NUE539 | 10103.5 | 0.436 | 1.2E−01 | 27.43 |
| NUE539 | 10101.7 | 0.527 | 4.4E−03 | 53.99 |
| Control | | 0.342 | | |
| NUE539 | 10101.7 | 0.420 | 2.4E−03 | 34.28 |
| Control | | 0.313 | | |
| NUE544 | 9764.2 | 0.581 | 9.7E−02 | 24.20 |
| Control | | 0.468 | | |
| NUE548 | 9095.2 | 0.495 | 3.1E−02 | 31.12 |
| NUE548 | 9095.4 | 0.541 | 1.3E−03 | 43.44 |
| NUE548 | 9091.1 | 0.436 | 8.2E−02 | 15.49 |
| Control | | 0.377 | | |
| NUE550 | 9141.3 | 0.469 | 9.2E−02 | 27.80 |
| Control | | 0.367 | | |
| NUE563 | 9452.3 | 0.513 | 4.5E−03 | 42.86 |
| Control | | 0.359 | | |
| NUE566 | 9512.1 | 0.448 | 7.9E−02 | 24.77 |
| NUE566 | 9514.1 | 0.530 | 1.3E−05 | 47.65 |
| Control | | 0.359 | | |
| NUE570 | 9314.4 | 0.477 | 6.1E−02 | 22.12 |
| NUE570 | 9314.1 | 0.436 | 3.3E−01 | 11.56 |
| Control | | 0.391 | | |
| NUE570 | 9314.1 | 0.522 | 5.4E−02 | 26.80 |
| Control | | 0.411 | | |
| NUE574 | 10363.4 | 0.384 | 9.0E−02 | 22.79 |
| NUE574 | 10364.2 | 0.369 | 3.4E−02 | 18.18 |
| NUE574 | 10362.2 | 0.372 | 4.0E−02 | 19.10 |
| NUE574 | 10366.2 | 0.505 | 1.3E−05 | 61.62 |
| NUE574 | 10366.1 | 0.403 | 1.8E−03 | 28.75 |
| Control | | 0.313 | | |
| NUE583 | 9673.1 | 0.337 | 3.3E−01 | 7.83 |
| NUE583 | 9673.4 | 0.511 | 4.9E−04 | 63.57 |
| NUE583 | 9673.2 | 0.445 | 1.3E−04 | 42.20 |
| NUE583 | 9671.2 | 0.373 | 5.7E−02 | 19.44 |
| NUE583 | 9671.1 | 0.356 | 1.3E−01 | 13.96 |
| Control | | 0.313 | | |
| NUE586 | 9751.1 | 0.466 | 3.8E−01 | 12.01 |
| NUE586 | 9751.7 | 0.561 | 1.4E−02 | 34.87 |
| NUE586 | 9752.1 | 0.616 | 6.6E−04 | 48.10 |
| Control | | 0.416 | | |
| NUE586 | 9751.6 | 0.578 | 9.9E−02 | 23.61 |
| NUE586 | 9751.3 | 0.544 | 2.5E−01 | 16.32 |
| NUE586 | 9752.4 | 0.585 | 6.0E−02 | 25.16 |
| NUE586 | 9752.1 | 0.611 | 3.8E−02 | 30.58 |
| Control | | 0.468 | | |
| NUE593 | 10394.2 | 0.446 | 2.9E−02 | 35.91 |
| Control | | 0.328 | | |

Table 28: Analyses of plant growth rate (relative growth rate of root length) of transgenic plants overexpressing the exogenous polynucleotides of some embodiments of the invention (using the cloned or synthetic genes listed in Table 23 above) under the regulation of a constitutive promoter (35S) when grown under limiting nitrogen conditions [low nitrogen or nitrogen deficient conditions (0.75 mM N)] as compared to control plants.
"Incr." = increment;
"RGR" = relative growth rate.

The genes presented in Tables 29 and 30, hereinbelow, have improved plant NUE since they produced larger plant biomass when grown under standard nitrogen growth conditions, compared to control plants, indicating the high ability of the plant to better metabolize the nitrogen present in the medium.

Tables 29 and 30 depict analyses of plant biomass (plant fresh and dry weight and leaf area) when grown under standard nitrogen conditions [normal or regular growth conditions (15 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 29

Transgenic plants exogenously expressing the polynucleotides of some embodiments of the invention exhibit improved plant biomass (fresh and dry weight) under standard nitrogen conditions

| | | Plant Fresh Weight [mg] | | | | | Plant Dry Weight [mg] | | |
|---|---|---|---|---|---|---|---|---|---|
| Gene Name | Event # | Average | p-value | % incr. | Gene Name | Event # | Average | p-value | % incr. |
| CT1 | 4841.1 | 224.68 | 5.7E−03 | 44.54 | CT11 | 4894.3 | 10.93 | 1.0E−01 | 57.88 |
| CT1 | 4844.3 | 220.28 | 1.3E−01 | 41.71 | CT11 | 4892.2 | 11.00 | 2.3E−02 | 58.84 |
| Control | | 155.44 | | | CT11 | 4892.3 | 9.35 | 1.6E−01 | 35.02 |
| CT11 | 4892.2 | 327.13 | 1.2E−02 | 41.78 | CT11 | 4893.2 | 7.20 | 7.0E−02 | 3.97 |
| CT11 | 4892.3 | 321.38 | 4.4E−02 | 39.29 | CT11 | 4892.1 | 12.40 | 1.0E−01 | 79.06 |
| Control | | 230.73 | | | Control | | 6.93 | | |
| CT11 | 4893.2 | 293.83 | 1.8E−02 | 70.30 | CT11 | 4894.2 | 6.70 | 5.8E−01 | 8.06 |
| Control | | 172.54 | | | CT11 | 4893.2 | 12.73 | 5.8E−03 | 105.24 |
| CT22 | 5023.1 | 249.48 | 1.3E−02 | 60.50 | Control | | 6.20 | | |
| Control | | 155.44 | | | CT27 | 5033.6 | 7.40 | 1.9E−01 | 79.39 |
| CT27 | 5033.6 | 234.13 | 1.1E−01 | 148.18 | CT27 | 5033.8 | 7.50 | 9.2E−02 | 81.82 |
| CT27 | 5033.8 | 192.50 | 8.4E−03 | 104.05 | CT27 | 5033.5 | 5.55 | 1.9E−01 | 34.55 |
| CT27 | 5033.5 | 143.73 | 3.1E−01 | 52.35 | Control | | 4.13 | | |
| Control | | 94.34 | | | CT27 | 5033.7 | 8.23 | 1.5E−01 | 32.66 |
| CT27 | 5033.7 | 224.58 | 1.2E−01 | 30.16 | CT27 | 5035.2 | 13.10 | 2.1E−04 | 111.29 |
| CT27 | 5035.2 | 343.65 | 2.2E−01 | 99.17 | CT27 | 5031.4 | 9.28 | 8.2E−03 | 49.60 |
| CT27 | 5031.4 | 255.88 | 3.0E−03 | 48.30 | CT27 | 5033.6 | 8.15 | 2.7E−01 | 31.45 |
| Control | | 172.54 | | | CT27 | 5033.4 | 7.95 | 4.7E−02 | 28.23 |
| CT76 | 5041.7 | 292.55 | 5.6E−02 | 26.80 | CT27 | 5033.8 | 8.90 | 2.5E−02 | 43.55 |
| CT76 | 5043.5 | 415.05 | 1.4E−03 | 79.89 | CT27 | 5033.5 | 7.63 | 2.1E−01 | 22.98 |
| Control | | 230.73 | | | Control | | 6.20 | | |
| CT76 | 5044.6 | 239.08 | 2.1E−03 | 153.43 | CT6 | 4943.1 | 7.83 | 3.2E−01 | 26.21 |
| CT76 | 5041.5 | 209.10 | 1.6E−03 | 121.65 | CT6 | 4945.9 | 7.63 | 1.8E−01 | 22.98 |
| CT76 | 5043.5 | 272.60 | 2.7E−02 | 188.96 | CT6 | 4941.4 | 9.28 | 2.9E−02 | 49.60 |
| CT76 | 5041.6 | 124.75 | 3.9E−02 | 32.24 | Control | | 6.20 | | |
| CT76 | 5041.9 | 245.20 | 7.1E−02 | 159.92 | CT75 | 4874.4 | 9.35 | 1.2E−02 | 50.81 |
| Control | | 94.34 | | | Control | | 6.20 | | |
| CT81 | 4992.1 | 381.73 | 3.3E−04 | 65.45 | CT76 | 5044.6 | 9.40 | 1.6E−01 | 35.74 |
| CT81 | 4992.2 | 305.85 | 2.8E−01 | 32.56 | CT76 | 5043.5 | 17.23 | 7.8E−06 | 148.74 |
| Control | | 230.73 | | | CT76 | 5041.6 | 10.03 | 9.7E−02 | 44.89 |
| NUE209 | 8192.14 | 217.23 | 3.8E−02 | 86.30 | Control | | 6.93 | | |
| Control | | 116.60 | | | CT76 | 5044.6 | 7.43 | 5.8E−02 | 80.00 |
| NUE210 | 8202.1 | 279.53 | 1.1E−01 | 139.73 | CT76 | 5041.5 | 9.70 | 1.0E−04 | 135.15 |
| NUE210 | 8201.3 | 250.90 | 4.8E−02 | 115.18 | CT76 | 5041.7 | 5.03 | 4.5E−01 | 21.82 |
| Control | | 116.60 | | | CT76 | 5043.5 | 10.88 | 1.3E−02 | 163.64 |
| NUE211 | 8263.5 | 162.35 | 5.0E−02 | 31.43 | CT76 | 5041.9 | 8.95 | 1.1E−02 | 116.97 |
| Control | | 123.53 | | | Control | | 4.13 | | |
| NUE212 | 8332.1 | 253.75 | 1.0E−01 | 105.42 | CT81 | 4992.1 | 11.20 | 4.1E−02 | 61.73 |
| NUE212 | 8335.2 | 169.28 | 4.9E−02 | 37.03 | CT81 | 4993.5 | 8.60 | 3.6E−01 | 24.19 |
| Control | | 123.53 | | | CT81 | 4992.2 | 8.63 | 3.4E−01 | 24.55 |
| NUE212 | 8335.2 | 221.83 | 2.0E−02 | 90.24 | CT81 | 4995.5 | 7.90 | 3.8E−01 | 14.08 |
| NUE212 | 8331.4 | 163.88 | 2.7E−01 | 40.54 | Control | | 6.93 | | |
| Control | | 116.60 | | | NUE206 | 6732.9 | 13.68 | 7.9E−03 | 43.38 |
| NUE212 | 8332.1 | 116.43 | 1.8E−01 | 29.34 | NUE206 | 6731.2 | 14.13 | 4.3E−01 | 48.19 |
| NUE212 | 8334.1 | 128.33 | 8.1E−02 | 42.56 | NUE206 | 6732.5 | 12.98 | 1.8E−02 | 36.04 |
| NUE212 | 8331.4 | 143.63 | 3.0E−02 | 59.56 | NUE206 | 6732.2 | 10.98 | 3.6E−01 | 15.07 |
| Control | | 90.01 | | | Control | | 9.54 | | |
| NUE221 | 9802.8 | 149.35 | 3.9E−03 | 58.7 | NUE208 | 8354.8 | 8.20 | 2.7E−02 | 78.75 |
| NUE221 | 9806.1 | 209.18 | 1.7E−08 | 122.3 | NUE208 | 8355.3 | 5.78 | 3.3E−01 | 25.89 |
| Control | | 94.09 | | | Control | | 4.59 | | |
| NUE222 | 8851.3 | 240.70 | 6.1E−02 | 106.43 | NUE208 | 8354.8 | 6.15 | 3.1E−02 | 14.42 |
| NUE222 | 8852.4 | 138.15 | 3.1E−01 | 18.48 | Control | | 5.38 | | |
| Control | | 116.60 | | | NUE208 | 8354.8 | 16.45 | 1.9E−03 | 72.48 |
| NUE224 | 9002.4 | 279.08 | 6.1E−02 | 32.66 | NUE208 | 8354.5 | 15.58 | 2.4E−03 | 63.30 |
| Control | | 210.36 | | | NUE208 | 8355.3 | 12.40 | 9.6E−02 | 30.01 |
| NUE224 | 9002.4 | 159.13 | 2.6E−01 | 14.58 | Control | | 9.54 | | |
| NUE224 | 9002.2 | 268.95 | 3.8E−03 | 93.66 | NUE209 | 8192.1 | 7.73 | 1.5E−01 | 68.39 |
| NUE224 | 9001.3 | 181.65 | 3.2E−02 | 30.80 | NUE209 | 8191.7 | 7.13 | 7.1E−02 | 55.31 |
| Control | | 138.88 | | | Control | | 4.59 | | |
| NUE225 | 9732.8 | 117.00 | 2.2E−01 | 24.4 | NUE209 | 8191.5 | 10.83 | 6.2E−01 | 162.42 |
| Control | | 94.09 | | | NUE209 | 8191.3 | 15.40 | 6.3E−03 | |
| NUE227 | 9853.1 | 197.68 | 9.4E−02 | 55.51 | Control | | 9.54 | | |
| Control | | 127.11 | | | NUE210 | 8202.1 | 10.95 | 1.0E−02 | 138.69 |
| NUE229 | 8862.2 | 75.00 | 1.2E−02 | 26.32 | NUE210 | 8201.3 | 8.98 | 5.5E−02 | 95.64 |
| NUE229 | 8862.5 | 74.03 | 1.3E−01 | 24.67 | Control | | 4.59 | | |
| NUE229 | 8864.2 | 84.93 | 3.9E−02 | 43.03 | NUE210 | 8202.1 | 4.28 | 2.4E−02 | 41.91 |
| Control | | 59.38 | | | NUE210 | 8751.4 | 4.33 | 1.1E−01 | 43.57 |
| NUE230 | 9154.2 | 171.38 | 4.4E−01 | 23.40 | NUE210 | 6755.3 | 3.85 | 2.4E−01 | 27.80 |
| NUE230 | 9151.2 | 203.78 | 3.1E−02 | 46.73 | NUE210 | 8201.2 | 3.93 | 2.1E−01 | 30.29 |
| Control | | 138.88 | | | Control | | 3.01 | | |
| NUE231 | 10633.3 | 199.70 | 1.6E−07 | 112.2 | NUE211 | 8265.1 | 7.38 | 8.8E−02 | 60.76 |

TABLE 29-continued

Transgenic plants exogenously expressing the polynucleotides of some embodiments of the invention exhibit improved plant biomass (fresh and dry weight) under standard nitrogen conditions

| | | Plant Fresh Weight [mg] | | | | | Plant Dry Weight [mg] | | |
|---|---|---|---|---|---|---|---|---|---|
| Gene Name | Event # | Average | p-value | % incr. | Gene Name | Event # | Average | p-value | % incr. |
| Control | | 94.09 | | | Control | | 4.59 | | |
| NUE233 | 10174.3 | 139.08 | 9.0E−02 | 44.46 | NUE212 | 8335.2 | 9.53 | 7.3E−02 | 107.63 |
| NUE233 | 10174.1 | 190.05 | 5.5E−04 | 97.40 | Control | | 4.59 | | |
| NUE233 | 10173.7 | 143.98 | 3.5E−03 | 49.55 | NUE212 | 8334.1 | 4.20 | 7.4E−02 | 39.42 |
| Control | | 96.28 | | | NUE212 | 8331.4 | 5.08 | 5.7E−02 | 68.46 |
| NUE235 | 9694.2 | 171.15 | 1.0E−01 | 23.24 | Control | | 3.01 | | |
| NUE235 | 9691.1 | 172.20 | 7.8E−02 | 24.00 | NUE221 | 9802.8 | 7.50 | 2.5E−03 | 56.3 |
| NUE235 | 9693.3 | 194.48 | 5.4E−02 | 40.04 | NUE221 | 9806.1 | 9.08 | 3.5E−06 | 89.1 |
| Control | | 138.88 | | | Control | | 4.80 | | |
| NUE237 | 9651.1 | 293.05 | 3.8E−02 | 111.02 | NUE222 | 8851.3 | 11.60 | 4.2E−02 | 152.86 |
| NUE237 | 9652.3 | 167.10 | 1.1E−01 | 20.32 | Control | | 4.59 | | |
| NUE237 | 9654.4 | 195.80 | 1.4E−01 | 40.99 | NUE224 | 9002.2 | 10.13 | 5.4E−02 | 83.67 |
| Control | | 138.88 | | | NUE224 | 9001.3 | 7.03 | 1.1E−01 | 27.44 |
| NUE237 | 9651.1 | 191.70 | 1.8E−02 | 26.32 | Control | | 5.51 | | |
| Control | | 151.76 | | | NUE227 | 9851.2 | 5.88 | 1.4E−01 | 24.34 |
| NUE239 | 9192.1 | 245.53 | 3.6E−02 | 56.82 | NUE227 | 9853.1 | 8.88 | 4.0E−02 | 87.83 |
| Control | | 156.56 | | | Control | | 4.73 | | |
| NUE240 | 9172.1 | 212.68 | 7.3E−02 | 35.84 | NUE228 | 10092 | 7.90 | 2.0E−01 | 45.29 |
| NUE240 | 9174.3 | 255.50 | 2.6E−01 | | NUE228 | 10093 | 7.98 | 8.6E−02 | 46.67 |
| Control | | 156.56 | | | NUE228 | 10093 | 6.68 | 5.3E−03 | 22.76 |
| NUE241 | 9631.3 | 166.03 | 6.6E−02 | 30.61 | Control | | 5.44 | | |
| NUE241 | 9632.5 | 185.58 | 1.4E−02 | 45.99 | NUE229 | 8862.2 | 3.90 | 4.1E−02 | 30.54 |
| NUE241 | 9632.4 | 219.43 | 8.4E−03 | 72.62 | NUE229 | 8862.5 | 3.80 | 2.7E−01 | 27.20 |
| Control | | 127.11 | | | NUE229 | 8864.2 | 4.45 | 2.9E−02 | 48.95 |
| NUE242 | 9212.1 | 140.78 | 3.9E−02 | 59.41 | Control | | 2.99 | | |
| NUE242 | 9214.1 | 129.18 | 1.5E−01 | 46.27 | NUE230 | 9154.2 | 7.38 | 1.0E−01 | 33.79 |
| NUE242 | 9213.2 | 101.43 | 3.7E−01 | 14.85 | NUE230 | 9151.2 | 7.48 | 5.8E−02 | 35.60 |
| NUE242 | 9213.4 | 146.30 | 3.0E−02 | 65.66 | Control | | 5.51 | | |
| Control | | 88.31 | | | NUE231 | 10632.2 | 5.53 | 4.1E−01 | 15.1 |
| NUE244 | 9061.1 | 164.20 | 8.9E−04 | 45.23 | NUE231 | 10633.3 | 11.43 | 2.0E−11 | 138.0 |
| NUE244 | 9061.5 | 143.40 | 4.8E−01 | 26.83 | Control | | 4.80 | | |
| Control | | 113.06 | | | NUE233 | 10174 | 6.13 | 1.2E−02 | 58.58 |
| NUE246 | 9033.6 | 273.05 | 8.9E−03 | 43.57 | NUE233 | 10174 | 8.63 | 2.1E−04 | 123.30 |
| NUE246 | 9033.4 | 241.48 | 4.8E−01 | 26.97 | NUE233 | 10174 | 5.10 | 8.2E−02 | 32.04 |
| NUE246 | 9034.1 | 224.08 | 2.5E−01 | 17.82 | Control | | 3.86 | | |
| NUE246 | 9031.1 | 232.65 | 3.3E−01 | 22.33 | NUE234 | 9163.5 | 4.28 | 8.7E−02 | 43.10 |
| Control | | 190.19 | | | NUE234 | 9162.1 | 4.60 | 1.3E−01 | 53.97 |
| NUE246 | 9034.1 | 160.45 | 1.8E−02 | 41.91 | Control | | 2.99 | | |
| Control | | 113.06 | | | NUE235 | 9694.2 | 7.35 | 2.2E−01 | 33.33 |
| NUE246 | 9033.4 | 185.78 | 4.3E−01 | 16.45 | NUE235 | 9691.1 | 7.90 | 1.4E−01 | 43.31 |
| NUE246 | 9033.8 | 205.95 | 1.8E−01 | 29.09 | NUE235 | 9693.3 | 6.98 | 6.2E−02 | 26.53 |
| NUE246 | 9034.1 | 228.95 | 2.4E−03 | 43.51 | Control | | 5.51 | | |
| Control | | 159.54 | | | NUE237 | 9651.1 | 10.20 | 2.9E−02 | 85.03 |
| NUE248 | 8982.4 | 275.80 | 2.2E−02 | 45.01 | NUE237 | 9652.3 | 6.68 | 6.3E−02 | 21.09 |
| NUE248 | 8981.5 | 343.28 | 1.1E−02 | 80.49 | NUE237 | 9654.4 | 8.25 | 1.1E−02 | 49.66 |
| NUE248 | 8984.1 | 294.45 | 1.5E−01 | 54.82 | Control | | 5.51 | | |
| NUE248 | 8981.2 | 245.25 | 1.1E−01 | 28.95 | NUE237 | 9651.1 | 6.98 | 4.0E−02 | 26.53 |
| Control | | 190.19 | | | Control | | 5.51 | | |
| NUE248 | 8982.4 | 118.75 | 1.6E−01 | 37.56 | NUE239 | 9191.2 | 8.80 | 7.6E−02 | 19.32 |
| NUE248 | 8984.1 | 124.38 | 2.5E−02 | 44.08 | Control | | 7.38 | | |
| NUE248 | 8981.5 | 140.05 | 4.8E−02 | 62.24 | NUE241 | 9631.3 | 6.43 | 8.5E−02 | 35.98 |
| NUE248 | 8983.1 | 114.05 | 3.2E−01 | 32.12 | NUE241 | 9632.5 | 8.33 | 2.8E−04 | 76.19 |
| Control | | 86.33 | | | NUE241 | 9632.3 | 6.55 | 1.6E−02 | 38.62 |
| NUE249 | 9122.5 | 145.73 | 4.6E−02 | 68.82 | NUE241 | 9632.4 | 8.03 | 1.0E−04 | 70.02 |
| NUE249 | 9121.4 | 112.83 | 3.6E−01 | 30.71 | Control | | 4.73 | | |
| NUE249 | 9123.3 | 107.98 | 2.1E−01 | 25.08 | NUE244 | 9061.1 | 5.65 | 6.3E−02 | 34.52 |
| Control | | 86.33 | | | NUE244 | 9061.5 | 5.88 | 6.7E−02 | 39.88 |
| NUE250 | 9133.2 | 182.70 | 4.3E−02 | 31.56 | Control | | 4.20 | | |
| NUE250 | 9134.1 | 216.85 | 2.5E−02 | 56.15 | NUE246 | 9033.6 | 8.98 | 2.9E−02 | 28.90 |
| Control | | 138.88 | | | NUE246 | 9033.4 | 8.28 | 3.1E−01 | 18.85 |
| NUE251 | 10181.3 | 143.00 | 4.0E−02 | 48.53 | Control | | 6.96 | | |
| NUE251 | 10183.2 | 146.38 | 2.4E−02 | 52.04 | NUE246 | 9034.1 | 5.60 | 7.3E−02 | 33.33 |
| NUE251 | 10183.1 | 128.05 | 3.6E−01 | 33.00 | Control | | 4.20 | | |
| Control | | 96.28 | | | NUE246 | 9033.4 | 6.28 | 1.7E−01 | 18.40 |
| NUE254 | 8972.2 | 173.28 | 8.8E−02 | 100.72 | NUE246 | 9033.8 | 8.63 | 5.2E−04 | 62.74 |
| NUE254 | 8974.1 | 130.38 | 4.1E−02 | 51.03 | NUE246 | 9034.1 | 8.35 | 2.5E−04 | 57.55 |
| Control | | 86.33 | | | Control | | 5.30 | | |
| NUE256 | 10063.4 | 132.65 | 1.4E−02 | 37.78 | NUE248 | 8982.4 | 9.88 | 2.2E−02 | 41.83 |
| NUE256 | 10064.1 | 212.63 | 1.5E−04 | 120.85 | NUE248 | 8981.5 | 11.78 | 1.3E−01 | 69.12 |
| NUE256 | 10061.2 | 151.98 | 1.2E−01 | 57.86 | NUE248 | 8984.1 | 10.25 | 1.4E−01 | 47.22 |
| NUE256 | 10062.4 | 152.75 | 1.5E−01 | 58.66 | NUE248 | 8981.2 | 7.55 | 6.5E−01 | 8.44 |

TABLE 29-continued

Transgenic plants exogenously expressing the polynucleotides of some embodiments of the invention exhibit improved plant biomass (fresh and dry weight) under standard nitrogen conditions

| | Plant Fresh Weight [mg] | | | | | Plant Dry Weight [mg] | | | |
|---|---|---|---|---|---|---|---|---|---|
| Gene Name | Event # | Average | p-value | % incr. | Gene Name | Event # | Average | p-value | % incr. |
| NUE256 | 10063.2 | 162.50 | 2.1E−01 | 68.79 | Control | | 6.96 | | |
| Control | | 96.28 | | | NUE248 | 8984.1 | 7.15 | 1.2E−01 | 43.00 |
| NUE267 | 8962.1 | 185.23 | 1.6E−02 | 63.83 | NUE248 | 8981.5 | 8.65 | 1.9E−02 | 73.00 |
| Control | | 113.06 | | | Control | | 5.00 | | |
| NUE268 | 8994.5 | 228.80 | 8.7E−02 | 64.46 | NUE250 | 9134.3 | 8.48 | 1.3E−02 | 49.67 |
| NUE268 | 8992.1 | 204.08 | 2.2E−01 | 46.69 | Control | | 5.66 | | |
| NUE268 | 8996.5 | 146.34 | 7.6E−02 | 5.19 | NUE250 | 9132.1 | 11.18 | 1.5E−01 | 102.72 |
| Control | | 139.13 | | | NUE250 | 9133.2 | 7.88 | 2.6E−02 | 42.86 |
| NUE269 | 9101.1 | 95.83 | 1.4E−02 | 79.28 | NUE250 | 9132.2 | 8.55 | 3.2E−02 | 55.10 |
| NUE269 | 9102.2 | 89.05 | 7.7E−05 | 66.60 | NUE250 | 9134.1 | 8.88 | 4.5E−02 | 61.00 |
| NUE269 | 9102.3 | 117.90 | 6.5E−02 | 120.58 | Control | | 5.51 | | |
| NUE269 | 9103.1 | 83.60 | 7.0E−02 | 56.41 | NUE250 | 9134.1 | 3.53 | 1.8E−01 | 17.99 |
| NUE269 | 9103.3 | 82.45 | 1.6E−02 | 54.26 | NUE250 | 9131.2 | 4.38 | 7.2E−02 | 46.44 |
| Control | | 53.45 | | | Control | | 2.99 | | |
| NUE512 | 9284.2 | 94.55 | 9.0E−02 | 20.60 | NUE251 | 10181 | 5.98 | 4.9E−02 | 54.69 |
| NUE512 | 9284.3 | 92.98 | 4.2E−01 | 18.59 | NUE251 | 10183 | 6.63 | 3.6E−03 | 71.52 |
| NUE512 | 9283.1 | 91.30 | 8.6E−02 | 16.45 | Control | | 3.86 | | |
| NUE512 | 9282.3 | 92.85 | 5.7E−02 | 18.43 | NUE254 | 8972.2 | 6.43 | 2.1E−02 | 52.98 |
| NUE512 | 9281.3 | 105.50 | 2.1E−01 | 34.57 | Control | | 4.20 | | |
| Control | | 78.40 | | | NUE254 | 8972.2 | 9.28 | 3.3E−02 | 85.50 |
| NUE514 | 9404.1 | 158.73 | 3.8E−02 | 79.73 | Control | | 5.00 | | |
| Control | | 88.31 | | | NUE256 | 10063 | 6.10 | 1.7E−03 | 57.93 |
| NUE515 | 9712.5 | 104.98 | 5.6E−01 | 11.6 | NUE256 | 10064 | 9.55 | 2.9E−07 | 147.25 |
| NUE515 | 9713.6 | 185.55 | 4.0E−06 | 97.2 | NUE256 | 10061 | 6.30 | 5.2E−02 | 63.11 |
| Control | | 94.09 | | | NUE256 | 10062 | 7.65 | 1.1E−01 | 98.06 |
| NUE516 | 9291.1 | 230.00 | 8.3E−02 | 65.62 | NUE256 | 10063 | 6.33 | 4.9E−03 | 63.75 |
| NUE516 | 9291.4 | 227.13 | 5.7E−02 | 63.55 | Control | | 3.86 | | |
| Control | | 138.88 | | | NUE267 | 8962.1 | 6.43 | 5.0E−03 | 52.98 |
| NUE520 | 9771.4 | 137.73 | 5.8E−02 | 43.05 | Control | | 4.20 | | |
| NUE520 | 9771.7 | 160.25 | 3.5E−03 | 66.45 | NUE268 | 8994.5 | 7.18 | 8.4E−02 | 59.44 |
| NUE520 | 9771.2 | 158.98 | 1.3E−02 | 65.13 | NUE268 | 8996.3 | 6.85 | 1.9E−02 | 52.22 |
| NUE520 | 9771.3 | 148.40 | 6.5E−02 | 54.14 | NUE268 | 8996.5 | 7.00 | 2.8E−03 | 55.56 |
| Control | | 96.28 | | | Control | | 4.50 | | |
| NUE521 | 9361.2 | 167.53 | 7.3E−05 | 89.70 | NUE512 | 9284.2 | 4.20 | 1.6E−02 | 46.72 |
| NUE521 | 9363.4 | 180.95 | 7.6E−03 | 104.90 | NUE512 | 9284.3 | 3.58 | 1.7E−01 | 24.89 |
| Control | | 88.31 | | | NUE512 | 9283.1 | 4.35 | 1.8E−02 | 51.97 |
| NUE523 | 9412.1 | 271.35 | 1.0E−01 | 42.67 | NUE512 | 9282.3 | 4.18 | 2.6E−02 | 45.85 |
| Control | | 190.19 | | | NUE512 | 9281.3 | 4.93 | 1.9E−02 | 72.05 |
| NUE523 | 9413.3 | 184.25 | 7.3E−02 | 28.51 | Control | | 2.86 | | |
| NUE523 | 9413.4 | 180.55 | 2.2E−01 | 25.93 | NUE512 | 9284.2 | 6.00 | 2.3E−03 | 53.35 |
| Control | | 143.37 | | | Control | | 3.91 | | |
| NUE527 | 9202.6 | 152.18 | 6.1E−01 | 9.38 | NUE514 | 9404.1 | 7.90 | 6.3E−02 | 61.64 |
| NUE527 | 9203.2 | 249.95 | 7.5E−02 | 79.66 | Control | | 4.89 | | |
| NUE527 | 9201.2 | 273.53 | 4.2E−04 | 96.60 | NUE515 | 9713.6 | 8.38 | 1.0E−04 | 74.5 |
| Control | | 139.13 | | | Control | | 4.80 | | |
| NUE527 | 9204.2 | 101.70 | 1.3E−02 | 90.27 | NUE519 | 9371.1 | 12.15 | 1.4E−01 | 64.75 |
| NUE527 | 9202.6 | 82.40 | 3.4E−02 | 54.16 | NUE519 | 9371.2 | 14.15 | 3.5E−01 | 91.86 |
| NUE527 | 9201.1 | 120.30 | 3.6E−03 | 125.07 | NUE519 | 9373.1 | 9.20 | 2.4E−01 | 24.75 |
| NUE527 | 9203.2 | 84.63 | 2.6E−03 | 58.33 | Control | | 7.38 | | |
| NUE527 | 9204.1 | 68.55 | 1.2E−01 | 28.25 | NUE520 | 9771.4 | 5.73 | 1.5E−01 | 48.22 |
| Control | | 53.45 | | | NUE520 | 9771.7 | 6.60 | 5.4E−02 | 70.87 |
| NUE532 | 9222.4 | 210.65 | 3.5E−01 | 51.41 | NUE520 | 9771.2 | 8.05 | 7.6E−03 | 108.41 |
| NUE532 | 9222.1 | 168.45 | 8.4E−02 | 21.08 | NUE520 | 9771.3 | 5.73 | 2.9E−02 | 48.22 |
| NUE532 | 9223.5 | 210.15 | 7.6E−02 | 51.05 | Control | | 3.86 | | |
| Control | | 139.13 | | | NUE523 | 9412.1 | 9.03 | 6.0E−02 | 29.62 |
| NUE535 | 9081.1 | 117.15 | 3.0E−01 | 21.68 | Control | | 6.96 | | |
| NUE535 | 9083.1 | 235.35 | 7.7E−02 | 144.46 | NUE527 | 9201.2 | 8.78 | 7.7E−02 | 95.00 |
| NUE535 | 9084.4 | 128.88 | 5.4E−02 | 33.86 | Control | | 4.50 | | |
| NUE535 | 9082.1 | 114.83 | 3.1E−01 | 19.27 | NUE531 | 10083 | 7.05 | 1.2E−01 | 29.66 |
| Control | | 96.28 | | | NUE531 | 10082 | 8.90 | 7.5E−02 | 63.68 |
| NUE535 | 9082.2 | 85.55 | 5.9E−03 | 60.06 | NUE531 | 10081 | 8.60 | 2.4E−01 | 58.16 |
| NUE535 | 9086.2 | 120.63 | 1.3E−02 | 125.68 | NUE531 | 10082 | 9.43 | 1.6E−02 | 73.33 |
| NUE535 | 9086.3 | 86.67 | 1.2E−01 | 62.15 | Control | | 5.44 | | |
| NUE535 | 9081.1 | 90.65 | 4.3E−03 | 69.60 | NUE531 | 10081 | 8.48 | 4.2E−02 | 32.13 |
| NUE535 | 9084.4 | 69.83 | 2.2E−02 | 30.64 | NUE531 | 10082 | 8.95 | 1.2E−01 | 39.53 |
| Control | | 53.45 | | | Control | | 6.41 | | |
| NUE537 | 9393.3 | 207.43 | 6.7E−02 | 30.28 | NUE532 | 9222.4 | 8.28 | 1.4E−01 | 83.89 |
| Control | | 159.21 | | | NUE532 | 9222.1 | 6.53 | 8.4E−02 | 45.00 |
| NUE538 | 9782.1 | 203.68 | 4.0E−02 | 60.23 | NUE532 | 9223.3 | 6.08 | 7.5E−02 | 35.00 |
| Control | | 127.11 | | | NUE532 | 9223.5 | 6.70 | 1.8E−01 | 48.89 |
| NUE539 | 10101.5 | 146.60 | 3.7E−03 | 52.27 | Control | | 4.50 | | |

TABLE 29-continued

Transgenic plants exogenously expressing the polynucleotides of some embodiments of the invention exhibit improved plant biomass (fresh and dry weight) under standard nitrogen conditions

| | | Plant Fresh Weight [mg] | | | | | Plant Dry Weight [mg] | | |
|---|---|---|---|---|---|---|---|---|---|
| Gene Name | Event # | Average | p-value | % incr. | Gene Name | Event # | Average | p-value | % incr. |
| NUE539 | 10103.5 | 126.33 | 7.8E−02 | 31.21 | NUE535 | 9083.1 | 10.90 | 5.6E−02 | 182.20 |
| NUE539 | 10101.2 | 190.80 | 5.0E−03 | 98.18 | Control | | 3.86 | | |
| NUE539 | 10101.7 | 173.78 | 2.0E−04 | 80.50 | NUE537 | 9391.1 | 6.48 | 9.9E−02 | 65.50 |
| Control | | 96.28 | | | NUE537 | 9393.3 | 5.53 | 2.9E−01 | 41.21 |
| NUE542 | 9332.1 | 196.48 | 3.3E−02 | 41.48 | Control | | 3.91 | | |
| Control | | 138.88 | | | NUE538 | 9782.1 | 8.30 | 2.8E−05 | 75.66 |
| NUE544 | 9763.3 | 169.78 | 8.8E−02 | 26.31 | Control | | 4.73 | | |
| Control | | 134.41 | | | NUE539 | 10102 | 6.83 | 1.4E−03 | 76.70 |
| NUE549 | 9343.6 | 200.95 | 9.7E−02 | 32.41 | NUE539 | 10101 | 9.15 | 2.0E−02 | 136.89 |
| NUE549 | 9343.7 | 205.95 | 2.8E−01 | 35.71 | NUE539 | 10102 | 7.80 | 1.6E−02 | 101.94 |
| Control | | 151.76 | | | Control | | 3.86 | | |
| NUE550 | 9144.4 | 128.13 | 5.6E−03 | 139.71 | NUE543 | 10052 | 5.90 | 7.1E−02 | 24.87 |
| NUE550 | 9141.3 | 116.60 | 5.0E−07 | 118.15 | Control | | 4.73 | | |
| NUE550 | 9143.1 | 124.23 | 1.9E−02 | 132.41 | NUE544 | 9764.2 | 8.25 | 1.1E−01 | 53.49 |
| NUE550 | 9143.4 | 98.70 | 5.2E−02 | 84.66 | NUE544 | 9763.3 | 8.25 | 2.7E−02 | 53.49 |
| Control | | 53.45 | | | Control | | 5.38 | | |
| NUE550 | 9143.1 | 197.68 | 2.6E−01 | 42.08 | NUE548 | 9095.2 | 7.50 | 7.6E−02 | 32.45 |
| NUE550 | 9143.4 | 174.85 | 1.4E−01 | 25.68 | NUE548 | 9095.4 | 8.18 | 1.7E−01 | 44.37 |
| NUE550 | 9142.2 | 240.83 | 7.2E−05 | 73.10 | NUE548 | 9091.1 | 7.68 | 2.1E−01 | 35.54 |
| Control | | 139.13 | | | Control | | 5.66 | | |
| NUE553 | 9181.5 | 76.85 | 1.9E−03 | 43.78 | NUE548 | 9095.2 | 10.17 | 2.7E−02 | 71.23 |
| NUE553 | 9185.2 | 74.85 | 2.4E−01 | 40.04 | NUE548 | 9092.2 | 8.15 | 8.9E−02 | 37.26 |
| NUE553 | 9184.3 | 61.65 | 5.6E−01 | 15.34 | Control | | 5.94 | | |
| NUE553 | 9182.2 | 72.28 | 1.3E−01 | 35.22 | NUE549 | 9343.7 | 7.25 | 6.9E−02 | 31.52 |
| Control | | 53.45 | | | Control | | 5.51 | | |
| NUE554 | 9111.4 | 135.30 | 6.7E−02 | 153.13 | NUE550 | 9141.3 | 5.80 | 3.0E−01 | 28.89 |
| Control | | 53.45 | | | NUE550 | 9143.4 | 5.73 | 8.3E−03 | 27.22 |
| NUE563 | 9453.2 | 270.58 | 1.2E−01 | 53.26 | NUE550 | 9142.2 | 8.08 | 1.6E−02 | 79.44 |
| NUE563 | 9452.3 | 207.35 | 4.2E−01 | 17.45 | Control | | 4.50 | | |
| NUE563 | 9451.2 | 273.50 | 4.7E−02 | 54.91 | NUE554 | 9115.2 | 6.40 | 4.5E−02 | 42.22 |
| Control | | 176.55 | | | Control | | 4.50 | | |
| NUE564 | 9242.3 | 113.35 | 4.7E−02 | 44.58 | NUE560 | 9424.3 | 8.85 | 1.7E−03 | 65.64 |
| NUE564 | 9242.4 | 90.95 | 8.5E−02 | 16.01 | NUE560 | 9422.1 | 6.88 | 4.7E−02 | 28.68 |
| NUE564 | 9244.1 | 94.08 | 1.3E−02 | 19.99 | Control | | 5.34 | | |
| Control | | 78.40 | | | NUE562 | 9252.8 | 8.43 | 3.0E−02 | 57.69 |
| NUE566 | 9512.4 | 257.28 | 1.4E−02 | 45.72 | Control | | 5.34 | | |
| Control | | 176.55 | | | NUE567 | 9261.3 | 4.10 | 6.3E−02 | 43.23 |
| NUE567 | 9263.2 | 130.00 | 7.3E−03 | 65.82 | Control | | 2.86 | | |
| NUE567 | 9261.3 | 93.50 | 8.4E−02 | 19.26 | NUE568 | 9471.3 | 7.63 | 1.8E−02 | 38.32 |
| NUE567 | 9261.4 | 112.75 | 2.2E−02 | 43.81 | Control | | 5.51 | | |
| NUE567 | 9263.3 | 84.55 | 5.9E−01 | 7.84 | NUE569 | 9381.2 | 4.40 | 1.7E−02 | 53.71 |
| Control | | 78.40 | | | NUE569 | 9381.5 | 4.90 | 9.0E−02 | 71.18 |
| NUE568 | 9471.3 | 230.43 | 4.1E−02 | 51.83 | NUE569 | 9381.3 | 4.73 | 2.4E−03 | 65.07 |
| NUE568 | 9461.2 | 186.87 | 2.5E−01 | 23.13 | Control | | 2.86 | | |
| NUE568 | 9474.4 | 187.77 | 2.0E−01 | 23.72 | NUE570 | 9311.4 | 3.63 | 1.4E−01 | 26.64 |
| NUE568 | 9472.2 | 195.70 | 3.0E−01 | 28.95 | NUE570 | 9313.3 | 4.33 | 4.3E−02 | 51.09 |
| NUE568 | 9462.3 | 172.65 | 5.1E−01 | 13.76 | NUE570 | 9314.4 | 4.78 | 8.5E−03 | 66.81 |
| Control | | 151.76 | | | NUE570 | 9314.1 | 4.33 | 3.0E−02 | 51.09 |
| NUE569 | 9384.4 | 90.90 | 2.1E−01 | 15.94 | NUE570 | 9312.3 | 5.23 | 4.2E−04 | 82.53 |
| NUE569 | 9381.2 | 124.28 | 7.9E−03 | 58.51 | Control | | 2.86 | | |
| NUE569 | 9381.5 | 130.40 | 4.3E−02 | 66.33 | NUE571 | 9304.2 | 8.98 | 5.6E−02 | 67.98 |
| NUE569 | 9381.3 | 99.18 | 1.7E−01 | 26.50 | NUE571 | 9303.2 | 8.63 | 2.3E−03 | 61.43 |
| NUE569 | 9384.2 | 99.08 | 9.4E−02 | 26.37 | NUE571 | 9301.4 | 7.13 | 6.3E−02 | 33.36 |
| Control | | 78.40 | | | Control | | 5.34 | | |
| NUE570 | 9313.3 | 110.70 | 1.2E−01 | 41.20 | NUE571 | 9304.3 | 6.50 | 2.4E−04 | 127.07 |
| NUE570 | 9314.4 | 119.08 | 1.2E−02 | 51.88 | NUE571 | 9304.2 | 6.05 | 2.8E−02 | 111.35 |
| NUE570 | 9314.1 | 109.93 | 8.7E−03 | 40.21 | NUE571 | 9303.2 | 4.98 | 4.2E−03 | 73.80 |
| NUE570 | 9312.3 | 149.30 | 8.0E−03 | 90.43 | NUE571 | 9301.4 | 4.13 | 4.1E−02 | 44.10 |
| Control | | 78.40 | | | NUE571 | 9302.3 | 4.03 | 3.4E−02 | 40.61 |
| NUE571 | 9304.2 | 212.53 | 1.1E−01 | 48.23 | Control | | 2.86 | | |
| NUE571 | 9303.2 | 240.93 | 3.8E−02 | 68.04 | NUE572 | 9321.3 | 4.95 | 9.0E−02 | 72.93 |
| NUE571 | 9302.1 | 177.58 | 4.0E−01 | 23.86 | NUE572 | 9324.3 | 4.55 | 2.4E−02 | 58.95 |
| NUE571 | 9301.4 | 209.80 | 1.0E−01 | 46.33 | NUE572 | 9321.1 | 4.80 | 4.7E−03 | 67.69 |
| NUE571 | 9302.3 | 199.13 | 2.6E−01 | 38.89 | NUE572 | 9322.2 | 4.35 | 1.5E−02 | 51.97 |
| Control | | 143.37 | | | Control | | 2.86 | | |
| NUE571 | 9304.3 | 124.43 | 1.2E−02 | 58.71 | NUE573 | 9491.4 | 7.28 | 1.8E−03 | 31.97 |
| NUE571 | 9304.2 | 123.90 | 4.5E−02 | 58.04 | Control | | 5.51 | | |
| NUE571 | 9303.2 | 106.00 | 1.7E−02 | 35.20 | NUE576 | 9793.3 | 8.03 | 7.1E−04 | 69.84 |
| Control | | 78.40 | | | Control | | 4.73 | | |
| NUE572 | 9322.1 | 124.90 | 3.5E−02 | 59.31 | NUE581 | 9723.6 | 6.28 | 9.3E−02 | 30.7 |
| NUE572 | 9324.3 | 115.85 | 2.7E−03 | 47.77 | NUE581 | 9724.9 | 8.15 | 2.0E−04 | 69.8 |

TABLE 29-continued

Transgenic plants exogenously expressing the polynucleotides of some embodiments of the invention exhibit improved plant biomass (fresh and dry weight) under standard nitrogen conditions

| | | Plant Fresh Weight [mg] | | | | | Plant Dry Weight [mg] | | |
|---|---|---|---|---|---|---|---|---|---|
| Gene Name | Event # | Average | p-value | % incr. | Gene Name | Event # | Average | p-value | % incr. |
| NUE572 | 9321.1 | 101.00 | 3.1E−02 | 28.83 | Control | | 4.80 | | |
| NUE572 | 9322.2 | 98.05 | 1.1E−02 | 25.06 | NUE582 | 9561.1 | 6.90 | 2.6E−01 | 25.17 |
| Control | | 78.40 | | | NUE582 | 9562.4 | 7.88 | 3.3E−02 | 42.86 |
| NUE573 | 9491.1 | 226.63 | 4.7E−02 | 49.33 | NUE582 | 9561.2 | 8.95 | 3.0E−02 | 62.36 |
| Control | | 151.76 | | | Control | | 5.51 | | |
| NUE581 | 9723.6 | 125.85 | 9.7E−02 | 33.8 | NUE583 | 9673.4 | 11.28 | 6.2E−02 | 75.78 |
| NUE581 | 9724.5 | 99.23 | 7.8E−01 | 5.5 | NUE583 | 9673.2 | 7.70 | 4.3E−01 | 20.04 |
| NUE581 | 9724.9 | 165.35 | 2.0E−04 | 75.7 | Control | | 6.41 | | |
| Control | | 94.09 | | | NUE585 | 9661.1 | 6.95 | 7.5E−02 | 31.13 |
| NUE582 | 9564.2 | 189.45 | 1.4E−01 | 36.42 | Control | | 5.30 | | |
| NUE582 | 9561.1 | 186.30 | 1.5E−01 | 34.15 | NUE587 | 9643.2 | 10.20 | 3.2E−02 | 85.03 |
| NUE582 | 9562.4 | 209.48 | 7.3E−02 | 50.84 | NUE587 | 9641.3 | 8.23 | 1.8E−01 | 49.21 |
| NUE582 | 9561.2 | 244.25 | 9.8E−02 | 75.88 | Control | | 5.51 | | |
| Control | | 138.88 | | | NUE592 | 9744.5 | 9.80 | 1.0E−07 | 104.2 |
| NUE583 | 9673.4 | 222.13 | 4.7E−02 | 54.28 | NUE592 | 9747.5 | 8.23 | 2.0E−04 | 71.4 |
| Control | | 143.97 | | | Control | | 4.80 | | |
| NUE585 | 9661.5 | 198.18 | 6.9E−02 | 4.22 | | | | | |
| NUE585 | 9661.1 | 194.93 | 2.6E−01 | 22.18 | | | | | |
| Control | | 159.54 | | | | | | | |
| NUE587 | 9643.2 | 242.53 | 4.2E−02 | 53.46 | | | | | |
| NUE587 | 9643.1 | 221.50 | 1.9E−01 | 40.16 | | | | | |
| NUE587 | 9642.5 | 169.73 | 7.0E−01 | 7.40 | | | | | |
| NUE587 | 9642.2 | 192.08 | 4.1E−01 | 21.54 | | | | | |
| NUE587 | 9641.3 | 268.95 | 3.5E−04 | 70.18 | | | | | |
| Control | | 158.04 | | | | | | | |
| NUE592 | 9741.7 | 115.18 | 2.6E−01 | 22.4 | | | | | |
| NUE592 | 9744.5 | 197.68 | 2.6E−07 | 110.1 | | | | | |
| NUE592 | 9747.4 | 118.53 | 1.9E−01 | 26.0 | | | | | |
| NUE592 | 9747.5 | 169.38 | 1.0E−04 | 80.0 | | | | | |
| Control | | 94.09 | | | | | | | |

Table 29: Analyses of plant biomass (plant fresh and dry weight) of transgenic plants overexpressing the exogenous polynucleotides of some embodiments of the invention (using the cloned or synthetic genes listed in Table 23 above) under the regulation of a constitutive promoter (35S) when grown under standard nitrogen conditions [normal or regular growth conditions (15 mM N)] as compared to control plants.
"Incr." = increment;
"RGR" = relative growth rate.

TABLE 30

Transgenic plants exogenously expressing the polynucleotides of some embodiments of the invention exhibit improved plant biomass (leaf area) under standard nitrogen conditions

| | | Leaf Area cm$^2$ | | |
|---|---|---|---|---|
| Gene Name | Event # | Average | p-value | % increment |
| CT11 | 4892.2 | 0.873 | 6.4E−03 | 72.49 |
| CT11 | 4892.3 | 0.809 | 1.6E−03 | 59.89 |
| CT11 | 4892.1 | 0.848 | 8.2E−02 | 67.56 |
| Control | | 0.506 | | |
| CT11 | 4894.2 | 0.474 | 8.2E−02 | 21.28 |
| CT11 | 4893.2 | 0.763 | 2.7E−02 | 94.95 |
| Control | | 0.391 | | |
| CT27 | 5033.8 | 0.645 | 3.8E−02 | 81.02 |
| CT27 | 5033.5 | 0.482 | 8.8E−02 | 35.52 |
| Control | | 0.356 | | |
| CT27 | 5033.7 | 0.495 | 6.9E−02 | 26.56 |
| CT27 | 5035.2 | 0.751 | 1.2E−02 | 92.06 |
| CT27 | 5031.4 | 0.582 | 1.3E−05 | 48.90 |
| CT27 | 5033.6 | 0.602 | 1.6E−02 | 53.79 |
| CT27 | 5033.4 | 0.575 | 1.3E−02 | 47.12 |
| CT27 | 5033.8 | 0.528 | 6.0E−03 | 34.95 |
| CT27 | 5033.5 | 0.446 | 5.8E−02 | 14.08 |
| Control | | 0.391 | | |
| CT6 | 4941.4 | 0.551 | 1.5E−04 | 40.90 |
| Control | | 0.391 | | |
| CT75 | 4872.5 | 0.506 | 1.0E−01 | 29.29 |
| CT75 | 4874.4 | 0.529 | 3.1E−02 | 35.35 |
| Control | | 0.391 | | |
| CT76 | 5044.6 | 0.702 | 8.6E−03 | 38.82 |
| CT76 | 5041.5 | 0.674 | 2.0E−01 | 33.22 |
| CT76 | 5041.7 | 0.596 | 1.4E−01 | 17.83 |
| CT76 | 5043.5 | 1.093 | 2.1E−05 | 116.09 |
| CT76 | 5041.6 | 0.779 | 4.9E−02 | 53.91 |
| CT76 | 5041.9 | 0.749 | 4.0E−03 | 48.14 |
| Control | | 0.506 | | |
| CT76 | 5044.6 | 0.663 | 1.6E−02 | 86.32 |
| CT76 | 5041.5 | 0.904 | 2.4E−03 | 153.77 |
| CT76 | 5043.5 | 0.850 | 1.8E−03 | 138.87 |
| CT76 | 5041.6 | 0.528 | 2.3E−02 | 48.40 |
| CT76 | 5041.9 | 0.696 | 6.3E−03 | 95.60 |
| Control | | 0.356 | | |
| CT81 | 4992.1 | 0.804 | 7.1E−02 | 58.98 |
| CT81 | 4992.2 | 0.778 | 3.4E−03 | 53.73 |
| Control | | 0.506 | | |
| NUE206 | 6732.5 | 0.707 | 3.6E−02 | 21.77 |
| Control | | 0.580 | | |
| NUE208 | 8354.8 | 0.765 | 1.1E−02 | 31.82 |
| NUE208 | 8354.5 | 0.727 | 1.3E−01 | 25.27 |
| NUE208 | 8355.3 | 0.763 | 5.7E−02 | 31.55 |

TABLE 30-continued

Transgenic plants exogenously expressing the polynucleotides of some embodiments of the invention exhibit improved plant biomass (leaf area) under standard nitrogen conditions

| Gene Name | Event # | Leaf Area cm$^2$ Average | p-value | % increment |
|---|---|---|---|---|
| Control | | 0.580 | | |
| NUE209 | 8192.14 | 0.458 | 2.2E−01 | 43.17 |
| NUE209 | 8191.5 | 0.430 | 7.0E−02 | 34.44 |
| Control | | 0.320 | | |
| NUE210 | 8201.3 | 0.485 | 1.1E−02 | 51.70 |
| Control | | 0.320 | | |
| NUE210 | 8202.1 | 0.414 | 1.3E−02 | 30.69 |
| NUE210 | 6755.3 | 0.474 | 5.8E−02 | 49.68 |
| Control | | 0.316 | | |
| NUE210 | 8201.2 | 0.275 | 1.5E−02 | 35.08 |
| Control | | 0.204 | | |
| NUE211 | 8265.1 | 0.253 | 7.2E−02 | 24.01 |
| NUE211 | 8263.5 | 0.370 | 4.7E−04 | 81.74 |
| Control | | 0.204 | | |
| NUE212 | 8335.1 | 0.332 | 6.3E−02 | 62.71 |
| NUE212 | 8334.1 | 0.277 | 5.9E−03 | 36.04 |
| NUE212 | 8331.4 | 0.268 | 1.1E−01 | 31.45 |
| Control | | 0.204 | | |
| NUE212 | 8335.2 | 0.490 | 1.2E−02 | 53.10 |
| Control | | 0.320 | | |
| NUE212 | 8332.1 | 0.390 | 7.7E−03 | 23.33 |
| NUE212 | 8334.1 | 0.420 | 2.1E−03 | 32.80 |
| NUE212 | 8331.4 | 0.430 | 2.3E−03 | 35.83 |
| Control | | 0.316 | | |
| NUE221 | 9801.10 | 0.47 | 5.6E−01 | 8.7 |
| NUE221 | 9802.8 | 0.59 | 1.0E−02 | 38.4 |
| NUE221 | 9806.1 | 0.72 | 1.0E−05 | 68.8 |
| Control | | 0.43 | | |
| NUE224 | 9002.2 | 0.525 | 1.3E−02 | 19.12 |
| NUE224 | 9001.3 | 0.542 | 9.6E−02 | 22.97 |
| Control | | 0.441 | | |
| NUE227 | 9851.2 | 0.531 | 1.9E−01 | 22.50 |
| NUE227 | 9853.1 | 0.628 | 2.1E−02 | 44.84 |
| NUE227 | 9852.3 | 0.550 | 6.8E−02 | 26.84 |
| Control | | 0.433 | | |
| NUE228 | 10092.2 | 0.691 | 2.5E−01 | 22.23 |
| NUE228 | 10093.3 | 0.759 | 3.6E−02 | 34.30 |
| NUE228 | 10093.1 | 0.646 | 1.7E−01 | 14.35 |
| Control | | 0.565 | | |
| NUE229 | 8864.2 | 0.430 | 2.4E−02 | 21.48 |
| Control | | 0.354 | | |
| NUE230 | 9154.2 | 0.559 | 1.3E−01 | 26.94 |
| NUE230 | 9151.2 | 0.519 | 8.3E−02 | 17.74 |
| Control | | 0.441 | | |
| NUE231 | 10631.3 | 0.46 | 5.9E−01 | 8.0 |
| NUE231 | 10632.2 | 0.50 | 2.7E−01 | 16.3 |
| NUE231 | 10633.3 | 0.74 | 3.9E−06 | 72.3 |
| Control | | 0.43 | | |
| NUE233 | 10174.3 | 0.512 | 7.7E−04 | 87.53 |
| NUE233 | 10174.1 | 0.735 | 5.1E−06 | 169.13 |
| NUE233 | 10173.7 | 0.398 | 2.9E−02 | 45.70 |
| Control | | 0.273 | | |
| NUE233 | 10174.1 | 0.820 | 1.2E−04 | 35.44 |
| Control | | 0.606 | | |
| NUE235 | 9694.2 | 0.516 | 1.0E−01 | 17.08 |
| NUE235 | 9694.3 | 0.578 | 2.6E−02 | 31.06 |
| Control | | 0.441 | | |
| NUE237 | 9651.1 | 0.710 | 3.7E−03 | 61.05 |
| NUE237 | 9654.4 | 0.566 | 1.9E−02 | 28.50 |
| NUE237 | 9654.1 | 0.634 | 1.4E−01 | 43.87 |
| Control | | 0.441 | | |
| NUE241 | 9631.3 | 0.670 | 6.8E−04 | 54.67 |
| NUE241 | 9632.5 | 0.626 | 1.2E−01 | 44.49 |
| NUE241 | 9632.4 | 0.601 | 1.1E−03 | 38.64 |
| Control | | 0.433 | | |
| NUE242 | 9214.1 | 0.726 | 5.0E−02 | 18.36 |
| Control | | 0.613 | | |
| NUE242 | 9212.1 | 0.542 | 4.1E−02 | 42.31 |
| NUE242 | 9213.4 | 0.518 | 1.3E−02 | 35.92 |
| Control | | 0.381 | | |
| NUE244 | 9061.5 | 0.473 | 4.8E−03 | 33.52 |
| Control | | 0.354 | | |
| NUE246 | 9033.8 | 0.740 | 3.2E−03 | 51.11 |
| NUE246 | 9034.1 | 0.582 | 6.5E−02 | 18.92 |
| NUE246 | 9031.1 | 0.572 | 6.9E−02 | 16.87 |
| Control | | 0.490 | | |
| NUE248 | 8981.5 | 0.803 | 7.2E−02 | 55.67 |
| Control | | 0.516 | | |
| NUE250 | 9132.1 | 0.744 | 8.5E−02 | 68.79 |
| NUE250 | 9133.2 | 0.528 | 2.0E−02 | 19.79 |
| NUE250 | 9132.2 | 0.517 | 1.8E−01 | 17.26 |
| NUE250 | 9134.1 | 0.525 | 1.8E−01 | 19.17 |
| Control | | 0.441 | | |
| NUE250 | 9134.1 | 0.444 | 4.1E−03 | 25.38 |
| Control | | 0.354 | | |
| NUE251 | 10181.3 | 0.599 | 1.1E−02 | 119.32 |
| NUE251 | 10183.2 | 0.467 | 2.4E−02 | 71.22 |
| NUE251 | 10183.1 | 0.408 | 2.7E−02 | 49.61 |
| NUE251 | 10181.1 | 0.397 | 7.3E−03 | 45.35 |
| Control | | 0.273 | | |
| NUE251 | 10181.3 | 0.600 | 6.2E−02 | 22.85 |
| Control | | 0.488 | | |
| NUE251 | 10183.2 | 0.713 | 2.9E−02 | 17.75 |
| Control | | 0.606 | | |
| NUE256 | 10063.4 | 0.479 | 4.6E−03 | 75.40 |
| NUE256 | 10064.1 | 0.707 | 1.5E−04 | 159.05 |
| NUE256 | 10061.2 | 0.601 | 9.0E−06 | 120.20 |
| NUE256 | 10062.4 | 0.588 | 1.2E−03 | 115.54 |
| NUE256 | 10063.2 | 0.507 | 3.2E−03 | 85.58 |
| Control | | 0.273 | | |
| NUE268 | 8996.5 | 0.730 | 6.1E−02 | 39.46 |
| Control | | 0.523 | | |
| NUE269 | 9103.3 | 0.448 | 8.1E−02 | 23.13 |
| Control | | 0.364 | | |
| NUE512 | 9284.2 | 0.531 | 4.8E−02 | 45.85 |
| NUE512 | 9282.3 | 0.748 | 1.2E−04 | 105.28 |
| NUE512 | 9284.4 | 0.442 | 5.3E−02 | 21.37 |
| Control | | 0.364 | | |
| NUE514 | 9404.1 | 0.796 | 1.2E−04 | 108.76 |
| NUE514 | 9402.2 | 0.449 | 2.1E−01 | 17.88 |
| NUE514 | 9403.2 | 0.452 | 2.3E−01 | 18.65 |
| Control | | 0.381 | | |
| NUE515 | 9712.6 | 0.49 | 3.5E−01 | 14.0 |
| NUE515 | 9713.6 | 0.66 | 5.0E−04 | 53.4 |
| Control | | 0.43 | | |
| NUE516 | 9291.1 | 0.516 | 2.0E−01 | 16.98 |
| NUE516 | 9291.4 | 0.639 | 6.0E−04 | 45.10 |
| Control | | 0.441 | | |
| NUE520 | 9771.4 | 0.465 | 1.6E−02 | 70.36 |
| NUE520 | 9771.7 | 0.482 | 1.4E−02 | 76.62 |
| NUE520 | 9771.2 | 0.415 | 2.7E−03 | 51.98 |
| NUE520 | 9771.3 | 0.360 | 1.5E−02 | 32.02 |
| Control | | 0.273 | | |
| NUE521 | 9363.4 | 0.716 | 4.6E−03 | 75.12 |
| Control | | 0.409 | | |
| NUE521 | 9361.2 | 0.525 | 4.8E−02 | 37.71 |
| NUE521 | 9363.4 | 0.582 | 2.5E−02 | 52.79 |
| Control | | 0.381 | | |
| NUE523 | 9412.1 | 0.752 | 2.0E−02 | 45.74 |
| Control | | 0.516 | | |
| NUE523 | 9412.5 | 0.526 | 5.2E−02 | 38.12 |
| NUE523 | 9414.2 | 0.487 | 3.3E−02 | 27.79 |
| Control | | 0.381 | | |
| NUE531 | 10083.1 | 0.809 | 7.9E−03 | 43.12 |
| NUE531 | 10082.2 | 0.705 | 3.0E−01 | 24.67 |
| NUE531 | 10081.4 | 0.900 | 1.5E−02 | 59.14 |
| NUE531 | 10081.5 | 0.866 | 3.8E−02 | 53.10 |
| Control | | 0.565 | | |
| NUE531 | 10081.4 | 0.789 | 7.0E−02 | 30.24 |
| NUE531 | 10081.5 | 0.816 | 2.0E−02 | 34.70 |
| Control | | 0.606 | | |
| NUE535 | 9084.2 | 0.430 | 1.9E−02 | 57.65 |
| NUE535 | 9083.1 | 0.822 | 4.7E−03 | 201.24 |
| NUE535 | 9084.4 | 0.436 | 1.4E−03 | 59.81 |

TABLE 30-continued

Transgenic plants exogenously expressing the polynucleotides of some embodiments of the invention exhibit improved plant biomass (leaf area) under standard nitrogen conditions

| Gene Name | Event # | Leaf Area cm$^2$ Average | p-value | % increment |
|---|---|---|---|---|
| NUE535 | 9082.1 | 0.381 | 1.6E−01 | 39.64 |
| Control |  | 0.273 |  |  |
| NUE537 | 9391.1 | 0.526 | 8.2E−02 | 44.39 |
| NUE537 | 9393.2 | 0.459 | 7.1E−02 | 26.03 |
| NUE537 | 9394.4 | 0.471 | 3.3E−02 | 29.36 |
| NUE537 | 9391.2 | 0.575 | 1.1E−02 | 57.79 |
| NUE537 | 9393.3 | 0.733 | 5.0E−03 | 101.21 |
| Control |  | 0.364 |  |  |
| NUE539 | 10101.5 | 0.510 | 3.6E−02 | 86.79 |
| NUE539 | 10103.5 | 0.432 | 1.6E−02 | 58.38 |
| NUE539 | 10101.2 | 0.638 | 3.5E−04 | 133.70 |
| NUE539 | 10101.7 | 0.641 | 6.5E−03 | 134.76 |
| Control |  | 0.273 |  |  |
| NUE542 | 9333.2 | 0.535 | 4.4E−04 | 46.83 |
| NUE542 | 9331.3 | 0.455 | 7.7E−02 | 24.84 |
| NUE542 | 9332.1 | 0.411 | 2.9E−01 | 12.88 |
| Control |  | 0.364 |  |  |
| NUE543 | 10052.3 | 0.556 | 2.0E−01 | 28.45 |
| NUE543 | 10051.6 | 0.530 | 2.6E−02 | 22.32 |
| Control |  | 0.433 |  |  |
| NUE543 | 10051.2 | 0.759 | 7.7E−02 | 34.20 |
| NUE543 | 10051.6 | 0.682 | 1.0E−01 | 20.71 |
| Control |  | 0.565 |  |  |
| NUE544 | 9763.3 | 0.596 | 1.8E−03 | 36.70 |
| Control |  | 0.436 |  |  |
| NUE548 | 9091.1 | 0.783 | 1.2E−02 | 27.78 |
| Control |  | 0.613 |  |  |
| NUE550 | 9144.3 | 0.436 | 4.0E−02 | 19.74 |
| Control |  | 0.364 |  |  |
| NUE550 | 9143.1 | 0.558 | 1.4E−02 | 35.96 |
| Control |  | 0.410 |  |  |
| NUE550 | 9141.3 | 0.622 | 2.0E−01 | 18.74 |
| NUE550 | 9142.2 | 0.664 | 5.7E−03 | 26.77 |
| Control |  | 0.523 |  |  |
| NUE551 | 9351.1 | 0.566 | 7.6E−02 | 15.59 |
| Control |  | 0.490 |  |  |
| NUE560 | 9424.3 | 0.537 | 8.5E−02 | 31.22 |
| NUE560 | 9422.1 | 0.581 | 2.0E−04 | 41.90 |
| Control |  | 0.409 |  |  |
| NUE564 | 9244.1 | 0.520 | 7.9E−02 | 22.64 |
| Control |  | 0.424 |  |  |
| NUE564 | 9242.3 | 0.415 | 5.6E−02 | 13.97 |
| NUE564 | 9243.2 | 0.469 | 7.6E−02 | 28.83 |
| NUE564 | 9242.2 | 0.585 | 4.5E−04 | 60.72 |
| Control |  | 0.364 |  |  |
| NUE567 | 9263.2 | 0.510 | 2.5E−02 | 40.15 |
| NUE567 | 9261.3 | 0.415 | 3.4E−01 | 13.94 |
| NUE567 | 9261.2 | 0.400 | 6.0E−01 | 9.89 |
| NUE567 | 9263.3 | 0.453 | 3.9E−01 | 24.33 |
| Control |  | 0.364 |  |  |
| NUE568 | 9471.3 | 0.613 | 4.5E−04 | 60.34 |
| NUE568 | 9472.2 | 0.689 | 3.5E−03 | 80.16 |
| Control |  | 0.382 |  |  |
| NUE569 | 9381.2 | 0.576 | 1.6E−02 | 35.83 |
| NUE569 | 9381.3 | 0.507 | 1.7E−01 | 19.49 |
| Control |  | 0.424 |  |  |
| NUE571 | 9304.2 | 0.752 | 4.6E−03 | 83.90 |
| NUE571 | 9301.1 | 0.623 | 1.4E−01 | 52.23 |
| NUE571 | 9303.2 | 0.545 | 6.6E−02 | 33.32 |
| NUE571 | 9302.1 | 0.574 | 1.3E−04 | 40.39 |
| NUE571 | 9302.3 | 0.524 | 9.1E−02 | 28.11 |
| Control |  | 0.409 |  |  |
| NUE571 | 9301.4 | 0.492 | 6.1E−02 | 16.00 |
| Control |  | 0.424 |  |  |
| NUE573 | 9491.1 | 0.511 | 1.5E−02 | 33.50 |
| NUE573 | 9491.4 | 0.539 | 2.3E−01 | 40.86 |
| Control |  | 0.382 |  |  |
| NUE576 | 9794.1 | 0.503 | 1.2E−01 | 16.10 |
| NUE576 | 9793.3 | 0.641 | 9.9E−03 | 48.00 |
| Control |  | 0.433 |  |  |
| NUE578 | 9524.3 | 0.551 | 3.2E−04 | 43.94 |
| NUE578 | 9524.1 | 0.477 | 2.2E−01 | 24.73 |

TABLE 30-continued

Transgenic plants exogenously expressing the polynucleotides of some embodiments of the invention exhibit improved plant biomass (leaf area) under standard nitrogen conditions

| Gene Name | Event # | Leaf Area cm$^2$ Average | p-value | % increment |
|---|---|---|---|---|
| Control |  | 0.382 |  |  |
| NUE579 | 9701.3 | 0.481 | 8.3E−02 | 18.67 |
| Control |  | 0.406 |  |  |
| NUE580 | 9554.4 | 0.483 | 2.0E−02 | 26.39 |
| Control |  | 0.382 |  |  |
| NUE581 | 9723.6 | 0.53 | 1.3E−01 | 22.7 |
| NUE581 | 9724.9 | 0.74 | 2.9E−06 | 73.4 |
| Control |  | 0.43 |  |  |
| NUE582 | 9562.4 | 0.567 | 2.6E−02 | 28.69 |
| NUE582 | 9561.2 | 0.649 | 3.4E−02 | 47.37 |
| Control |  | 0.441 |  |  |
| NUE583 | 9673.4 | 1.065 | 4.9E−03 | 75.90 |
| NUE583 | 9673.2 | 0.773 | 8.5E−02 | 27.63 |
| Control |  | 0.606 |  |  |
| NUE586 | 9751.6 | 0.551 | 3.4E−02 | 26.32 |
| NUE586 | 9751.7 | 0.628 | 2.7E−02 | 44.06 |
| NUE586 | 9752.4 | 0.479 | 8.0E−02 | 9.73 |
| NUE586 | 9752.1 | 0.609 | 2.0E−02 | 39.56 |
| Control |  | 0.436 |  |  |
| NUE587 | 9643.2 | 0.780 | 4.2E−03 | 92.27 |
| NUE587 | 9641.3 | 0.503 | 1.9E−01 | 23.98 |
| Control |  | 0.406 |  |  |
| NUE592 | 9744.5 | 0.89 | 1.0E−10 | 106.7 |
| NUE592 | 9747.5 | 0.59 | 1.0E−02 | 38.7 |
| Control |  | 0.43 |  |  |

Table 30: Analyses of plant biomass (leaf area) of transgenic plants overexpressing the exogenous polynucleotides of some embodiments of the invention (using the cloned or synthetic genes listed in Table 23 above) under the regulation of a constitutive promoter (35S) when grown under standard nitrogen conditions [normal or regular growth conditions (15 mM N)] as compared to control plants.

"Incr." = increment;

"RGR" = relative growth rate.

The genes presented in Table 31 hereinbelow, have improved plant NUE since they produced larger root biomass when grown under standard nitrogen growth conditions, compared to control plants. Plants producing larger root biomass have better possibilities to absorb larger amount of nitrogen from soil.

Table 31 depicts analyses of root performance (root length and coverage) when grown under standard nitrogen conditions [normal or regular growth conditions (15 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 31

Transgenic plants exogenously expressing the polynucleotides of some embodiments of the invention exhibit improved root performance (root length and coverage) under standard nitrogen conditions

| Gene Name | Event # | Roots Length [cm] | | | Roots Coverage [cm$^2$] | | |
|---|---|---|---|---|---|---|---|
| | | Average | p-value | % incr. | Average | p-value | % incr. |
| CT27 | 5033.6 | 3.341 | 1.8E−01 | 18.64 | 2.879 | 1.5E−01 | 31.17 |
| CT27 | 5033.4 | 3.362 | 1.6E−02 | 19.36 | 2.461 | 5.3E−01 | 12.11 |
| Control | | 2.817 | | | 2.195 | | |
| CT75 | 4873.4 | 4.223 | 8.1E−02 | 13.74 | 3.136 | 8.5E−01 | 2.38 |
| CT75 | 4873.3 | 5.290 | 9.1E−03 | 42.48 | 4.560 | 7.9E−02 | 48.88 |
| Control | | 3.713 | | | 3.063 | | |
| CT76 | 5043.5 | 4.908 | 7.0E−02 | 23.17 | 7.927 | 1.5E−02 | 101.19 |
| CT76 | 5041.6 | 4.286 | 4.2E−01 | 7.57 | 5.216 | 3.7E−01 | 32.41 |
| CT76 | 5041.9 | 4.051 | 7.2E−01 | 1.67 | 4.809 | 3.9E−02 | 22.05 |
| Control | | 3.984 | | | 3.940 | | |
| CT76 | 5041.5 | 4.273 | 5.4E−04 | 51.72 | 5.377 | 2.8E−03 | 144.94 |
| CT76 | 5043.5 | 2.837 | 9.1E−01 | 0.73 | 3.200 | 5.7E−03 | 45.76 |
| Control | | 2.817 | | | 2.195 | | |
| NUE206 | 6731.2 | 3.619 | 6.8E−02 | 28.05 | 3.376 | 3.5E−02 | 60.66 |
| NUE206 | 6732.7 | 3.311 | 6.7E−02 | 17.14 | 2.577 | 1.3E−01 | 22.63 |
| NUE206 | 6732.5 | 3.516 | 3.1E−02 | 24.42 | 2.894 | 1.3E−01 | 37.69 |
| NUE206 | 6732.1 | 3.347 | 2.0E−02 | 18.43 | 2.575 | 1.2E−01 | 22.53 |
| Control | | 2.826 | | | 2.102 | | |
| NUE206 | 6731.2 | 4.088 | 4.8E−02 | 36.80 | 5.469 | 3.2E−02 | 109.44 |
| NUE206 | 6732.5 | 4.106 | 1.2E−03 | 37.41 | 5.064 | 5.2E−03 | 93.92 |
| NUE206 | 6732.15 | 3.669 | 9.1E−02 | 22.78 | 4.031 | 2.4E−02 | 54.36 |
| Control | | 2.988 | | | 2.611 | | |
| NUE208 | 8351.3 | 3.930 | 2.9E−03 | 39.05 | 3.339 | 8.4E−03 | 58.86 |
| NUE208 | 8354.4 | 3.385 | 1.8E−01 | 19.76 | 2.828 | 1.3E−02 | 34.57 |
| Control | | 2.826 | | | 2.102 | | |
| NUE208 | 8355.3 | 3.393 | 6.0E−01 | 8.41 | 3.528 | 8.5E−02 | 48.07 |
| Control | | 3.130 | | | 2.382 | | |
| NUE208 | 8355.3 | 3.600 | 6.6E−02 | 20.47 | 3.969 | 8.6E−02 | 51.99 |
| Control | | 2.988 | | | 2.611 | | |
| NUE212 | 8332.2 | 4.896 | 6.1E−02 | 14.16 | 5.444 | 2.0E−02 | 27.45 |
| Control | | 4.289 | | | 4.272 | | |
| NUE221 | 9802.8 | | | | 3.72 | 4.9E−01 | 12.1 |
| Control | | | | | 3.32 | | |
| NUE223 | 9613.1 | 4.376 | 9.8E−02 | 18.05 | 5.480 | 4.0E−02 | 36.61 |
| NUE223 | 9612.3 | 4.426 | 8.7E−02 | 19.41 | 5.228 | 4.5E−02 | 30.32 |
| Control | | 3.707 | | | 4.012 | | |
| NUE230 | 9152.4 | 4.034 | 9.1E−03 | 17.77 | 3.441 | 1.1E−01 | 40.34 |
| Control | | 3.425 | | | 2.452 | | |
| NUE231 | 10631.3 | | | | 4.45 | 5.3E−02 | 34.2 |
| NUE231 | 10632.2 | 4.31 | 7.8E−03 | 14.7 | 4.64 | 2.3E−02 | 40.0 |
| NUE231 | 10633.3 | 4.84 | 7.0E−04 | 28.9 | 6.30 | 1.2E−06 | 90.1 |
| Control | | 3.76 | | | 3.32 | | |
| NUE233 | 10174.3 | 3.326 | 1.2E−01 | 16.40 | 2.879 | 3.3E−02 | 45.78 |
| NUE233 | 10174.1 | 4.581 | 3.9E−04 | 60.32 | 5.392 | 3.2E−04 | 173.01 |
| NUE233 | 10173.5 | 4.414 | 4.8E−04 | 54.47 | 2.865 | 1.1E−02 | 45.06 |
| NUE233 | 10172.5 | 3.581 | 3.5E−02 | 25.30 | 2.957 | 4.8E−03 | 49.73 |
| NUE233 | 10173.7 | 3.100 | 4.5E−01 | 8.48 | 2.613 | 1.9E−01 | 32.30 |
| Control | | 2.858 | | | 1.975 | | |
| NUE233 | 10174.1 | 4.375 | 1.3E−02 | 30.08 | 3.884 | 1.6E−01 | 18.86 |
| NUE233 | 10173.5 | 4.755 | 7.1E−04 | 41.36 | 4.746 | 2.3E−02 | 45.25 |
| Control | | 3.363 | | | 3.268 | | |
| NUE233 | 10174.1 | 4.357 | 5.8E−04 | 21.63 | 4.698 | 6.0E−03 | 39.12 |
| Control | | 3.582 | | | 3.377 | | |
| NUE237 | 9654.4 | 3.928 | 8.6E−01 | −1.32 | 4.729 | 1.0E−02 | 21.38 |
| NUE237 | 9654.1 | 4.951 | 4.0E−02 | 24.37 | 6.035 | 7.3E−02 | 54.90 |
| Control | | 3.981 | | | 3.896 | | |
| NUE237 | 9654.1 | 3.831 | 1.8E−01 | 11.85 | 4.235 | 2.3E−02 | 49.30 |
| Control | | 3.425 | | | 2.837 | | |
| NUE239 | 9191.2 | 4.379 | 2.1E−02 | 27.86 | 5.300 | 3.4E−02 | 86.84 |
| Control | | 3.707 | | | 4.012 | | |
| NUE241 | 9631.3 | 4.010 | 4.1E−01 | 5.60 | 3.785 | 1.4E−01 | 23.13 |
| NUE241 | 9632.5 | 5.084 | 4.2E−04 | 33.88 | 6.207 | 2.3E−03 | 101.95 |
| NUE241 | 9632.3 | 4.507 | 1.7E−01 | 18.69 | 4.237 | 2.3E−01 | 37.86 |
| Control | | 3.797 | | | 3.074 | | |
| NUE242 | 9213.4 | 4.696 | 5.9E−02 | 20.84 | 5.038 | 1.3E−01 | 28.12 |
| Control | | 3.886 | | | 3.933 | | |
| NUE246 | 9033.8 | 4.534 | 1.2E−01 | 14.09 | 5.522 | 6.1E−02 | 50.92 |
| Control | | 3.974 | | | 3.659 | | |
| NUE251 | 10181.3 | 3.824 | 2.7E−02 | 33.82 | 3.356 | 9.5E−03 | 69.93 |
| NUE251 | 10183.2 | 3.635 | 3.7E−02 | 27.20 | 3.158 | 3.6E−02 | 59.92 |
| NUE251 | 10183.1 | 3.726 | 6.2E−02 | 30.37 | 3.075 | 7.4E−02 | 55.70 |
| Control | | 2.858 | | | 1.975 | | |

TABLE 31-continued

Transgenic plants exogenously expressing the polynucleotides of some embodiments of the invention exhibit improved root performance (root length and coverage) under standard nitrogen conditions

| Gene Name | Event # | Roots Length [cm] | | | Roots Coverage [cm²] | | |
|---|---|---|---|---|---|---|---|
| | | Average | p-value | % incr. | Average | p-value | % incr. |
| NUE251 | 10181.3 | 4.406 | 1.5E−03 | 30.98 | 4.945 | 2.9E−02 | 51.35 |
| Control | | 3.363 | | | 3.268 | | |
| NUE256 | 10063.4 | 4.545 | 1.0E−02 | 59.03 | 4.513 | 1.7E−02 | 128.53 |
| NUE256 | 10064.1 | 3.444 | 8.2E−02 | 20.53 | 3.655 | 3.0E−04 | 85.07 |
| NUE256 | 10061.2 | 3.398 | 6.3E−02 | 18.90 | 3.772 | 7.5E−05 | 91.01 |
| NUE256 | 10063.2 | 3.464 | 2.0E−01 | 21.21 | 3.617 | 7.2E−02 | 83.13 |
| Control | | 2.858 | | | 1.975 | | |
| NUE256 | 10061.3 | 4.011 | 8.5E−02 | 11.96 | 3.500 | 7.6E−01 | 3.66 |
| Control | | 3.582 | | | 3.377 | | |
| NUE269 | 9104.1 | 4.116 | 9.0E−02 | 26.30 | 3.527 | 2.2E−01 | 28.77 |
| Control | | 3.259 | | | 2.739 | | |
| NUE512 | 9284.3 | 4.178 | 3.9E−01 | 14.99 | 3.222 | 6.3E−01 | 12.38 |
| NUE512 | 9282.3 | 3.683 | 8.6E−01 | 1.36 | 4.173 | 1.7E−02 | 45.56 |
| NUE512 | 9284.4 | 5.110 | 6.5E−04 | 40.66 | 3.987 | 3.4E−02 | 39.06 |
| Control | | 3.633 | | | 2.867 | | |
| NUE513 | 9681.6 | 4.639 | 2.5E−02 | 25.14 | 5.087 | 1.9E−01 | 26.81 |
| Control | | 3.707 | | | 4.012 | | |
| NUE513 | 9683.5 | 5.331 | 3.4E−02 | 20.24 | 4.960 | 9.1E−01 | 1.26 |
| Control | | 4.433 | | | 4.898 | | |
| NUE513 | 9683.5 | 5.216 | 1.6E−04 | 31.26 | 4.402 | 2.2E−01 | 20.31 |
| Control | | 3.974 | | | 3.659 | | |
| NUE514 | 9403.2 | 5.889 | 2.1E−04 | 54.38 | 6.448 | 1.4E−03 | 101.05 |
| Control | | 3.815 | | | 3.207 | | |
| NUE515 | 9712.6. | | | | 3.87 | 3.4E−01 | 16.6 |
| NUE515 | 9713.6. | | | | 4.19 | 1.3E−01 | 26.3 |
| Control | | | | | 3.32 | | |
| NUE520 | 9771.4 | 3.480 | 6.1E−02 | 21.77 | 3.356 | 7.8E−02 | 69.94 |
| NUE520 | 9771.2 | 3.487 | 5.7E−02 | 22.01 | 4.241 | 1.3E−02 | 114.72 |
| NUE520 | 9772.1 | 3.382 | 2.6E−01 | 18.35 | 3.936 | 4.7E−02 | 99.31 |
| NUE520 | 9771.3 | 3.284 | 2.0E−01 | 14.93 | 3.728 | 4.4E−03 | 88.78 |
| Control | | 2.858 | | | 1.975 | | |
| NUE523 | 9414.2 | 5.238 | 9.7E−02 | 18.15 | 4.912 | 9.9E−01 | 0.28 |
| Control | | 4.433 | | | 4.898 | | |
| NUE523 | 9412.5 | 4.589 | 2.1E−02 | 24.78 | 3.820 | 5.5E−01 | 11.95 |
| NUE523 | 9414.2 | 4.983 | 3.6E−02 | 35.48 | 4.310 | 1.6E−01 | 26.28 |
| Control | | 3.678 | | | 3.413 | | |
| NUE523 | 9412.5 | 3.997 | 5.3E−01 | 4.78 | 4.391 | 1.4E−02 | 36.91 |
| NUE523 | 9414.2 | 4.386 | 7.8E−02 | 14.98 | 4.588 | 1.8E−02 | 43.04 |
| Control | | 3.815 | | | 3.207 | | |
| NUE531 | 10083.3 | 4.413 | 5.7E−02 | 33.45 | 3.781 | 2.2E−01 | 24.13 |
| NUE531 | 10081.4 | 3.857 | 3.6E−02 | 16.65 | 4.484 | 3.8E−02 | 47.23 |
| NUE531 | 10081.5 | 4.377 | 3.6E−02 | 32.38 | 4.698 | 9.9E−02 | 54.25 |
| Control | | 3.306 | | | 3.046 | | |
| NUE531 | 10083.2 | 3.852 | 7.3E−02 | 14.51 | 3.992 | 6.0E−02 | 22.18 |
| Control | | 3.363 | | | 3.268 | | |
| NUE531 | 10083.3 | 4.256 | 9.0E−02 | 18.79 | 4.023 | 2.8E−01 | 19.16 |
| NUE531 | 10081.4 | 4.066 | 5.2E−02 | 13.49 | 4.864 | 3.7E−02 | 44.06 |
| NUE531 | 10081.5 | 4.240 | 1.7E−02 | 18.37 | 4.905 | 8.1E−02 | 45.26 |
| Control | | 3.582 | | | 3.377 | | |
| NUE535 | 9084.2 | 3.244 | 2.5E−01 | 13.51 | 3.005 | 9.7E−02 | 52.16 |
| NUE535 | 9083.1 | 3.300 | 2.3E−01 | 15.49 | 3.263 | 7.1E−02 | 65.20 |
| Control | | 2.858 | | | 1.975 | | |
| NUE537 | 9393.3 | 3.603 | 8.9E−01 | −0.83 | 4.005 | 4.8E−02 | 39.70 |
| Control | | 3.633 | | | 2.867 | | |
| NUE538 | 9782.1 | 3.805 | 9.8E−01 | 0.22 | 3.850 | 7.9E−02 | 25.26 |
| Control | | 3.797 | | | 3.074 | | |
| NUE538 | 9784.4 | 3.674 | 7.5E−02 | 16.79 | 2.729 | 4.6E−01 | 12.64 |
| NUE538 | 9783.4 | 4.332 | 6.1E−03 | 37.70 | 3.571 | 4.5E−02 | 47.38 |
| Control | | 3.146 | | | 2.423 | | |
| NUE539 | 10103.5 | 3.228 | 2.0E−01 | 12.96 | 2.727 | 1.5E−01 | 38.07 |
| NUE539 | 10101.7 | 3.736 | 1.6E−02 | 30.72 | 3.446 | 8.3E−03 | 74.48 |
| Control | | 2.858 | | | 1.975 | | |
| NUE543 | 10052.3 | 4.801 | 3.8E−03 | 26.44 | 4.373 | 4.7E−02 | 42.28 |
| Control | | 3.797 | | | 3.074 | | |
| NUE543 | 10051.1 | 4.064 | 2.9E−02 | 22.91 | 4.493 | 6.0E−02 | 47.51 |
| NUE543 | 10052.3 | 4.003 | 1.1E−01 | 21.06 | 3.953 | 2.1E−01 | 29.78 |
| Control | | 3.306 | | | 3.046 | | |
| NUE544 | 9764.1 | 3.603 | 9.6E−02 | 14.52 | 3.075 | 2.3E−02 | 26.92 |

TABLE 31-continued

Transgenic plants exogenously expressing the polynucleotides of some embodiments of the invention exhibit improved root performance (root length and coverage) under standard nitrogen conditions

| Gene Name | Event # | Roots Length [cm] | | | Roots Coverage [cm$^2$] | | |
|---|---|---|---|---|---|---|---|
| | | Average | p-value | % incr. | Average | p-value | % incr. |
| NUE544 | 9763.3 | 3.953 | 1.8E−02 | 25.66 | 3.096 | 3.0E−02 | 27.77 |
| Control | | 3.146 | | | 2.423 | | |
| NUE550 | 9141.3 | 4.453 | 4.6E−01 | 8.58 | 5.445 | 5.9E−02 | 35.65 |
| Control | | 4.101 | | | 4.014 | | |
| NUE551 | 9354.3 | 4.584 | 9.0E−02 | 23.66 | 5.375 | 1.3E−01 | 33.99 |
| Control | | 3.707 | | | 4.012 | | |
| NUE566 | 9512.2 | 5.004 | 3.0E−02 | 18.17 | 5.741 | 2.3E−01 | 27.49 |
| NUE566 | 9512.1 | 4.859 | 1.5E−01 | 14.75 | 5.807 | 3.0E−01 | 28.96 |
| Control | | 4.234 | | | 4.503 | | |
| NUE568 | 9471.3 | 3.796 | 2.4E−01 | 10.82 | 3.883 | 8.9E−02 | 36.89 |
| NUE568 | 9472.2 | 4.025 | 1.8E−01 | 17.50 | 4.944 | 9.7E−03 | 74.30 |
| NUE568 | 9462.3 | 4.519 | 4.8E−02 | 31.93 | 4.354 | 5.0E−02 | 53.47 |
| Control | | 3.425 | | | 2.837 | | |
| NUE570 | 9311.4 | 4.279 | 3.0E−01 | 17.77 | 4.349 | 5.4E−02 | 51.70 |
| NUE570 | 9314.4 | 3.692 | 8.1E−01 | 1.63 | 4.044 | 2.8E−02 | 41.05 |
| Control | | 3.633 | | | 2.867 | | |
| NUE571 | 9304.2 | 3.841 | 7.5E−01 | 4.43 | 4.423 | 3.7E−01 | 29.60 |
| NUE571 | 9301.1 | 4.444 | 6.6E−02 | 20.84 | 5.020 | 1.1E−01 | 47.11 |
| Control | | 3.678 | | | 3.413 | | |
| NUE573 | 9491.1 | 3.948 | 7.6E−02 | 15.26 | 3.887 | 4.8E−02 | 37.01 |
| Control | | 3.425 | | | 2.837 | | |
| NUE574 | 10363.4 | 4.080 | 5.6E−02 | 13.90 | 4.326 | 2.0E−01 | 28.12 |
| NUE574 | 10366.1 | 4.893 | 3.3E−02 | 36.58 | 5.262 | 4.3E−02 | 55.84 |
| Control | | 3.582 | | | 3.377 | | |
| NUE576 | 9792.4 | 4.284 | 1.5E−01 | 12.82 | 4.322 | 2.3E−02 | 40.63 |
| Control | | 3.797 | | | 3.074 | | |
| NUE579 | 9701.3 | 3.965 | 9.9E−02 | 26.03 | 3.899 | 4.7E−02 | 60.90 |
| NUE579 | 9703.3 | 3.542 | 1.0E−01 | 12.60 | 2.797 | 4.7E−01 | 15.43 |
| Control | | 3.146 | | | 2.423 | | |
| NUE580 | 9553.2 | 4.418 | 4.7E−03 | 28.99 | 3.784 | 7.3E−02 | 33.40 |
| NUE580 | 9551.4 | 4.239 | 5.1E−02 | 23.75 | 4.282 | 1.5E−01 | 50.96 |
| NUE580 | 9554.4 | 4.158 | 8.9E−02 | 21.41 | 3.902 | 7.1E−02 | 37.54 |
| Control | | 3.425 | | | 2.837 | | |
| NUE582 | 9562.4 | 4.115 | 5.1E−01 | 3.38 | 4.951 | 7.6E−02 | 27.06 |
| Control | | 3.981 | | | 3.896 | | |
| NUE583 | 9673.4 | 4.319 | 2.2E−03 | 20.56 | 5.635 | 4.1E−03 | 66.89 |
| NUE583 | 9673.2 | 3.739 | 5.9E−01 | 4.36 | 4.595 | 1.5E−01 | 36.10 |
| Control | | 3.582 | | | 3.377 | | |
| NUE586 | 9752.1 | 6.394 | 2.6E−05 | 49.10 | 7.681 | 6.9E−05 | 79.81 |
| Control | | 4.289 | | | 4.272 | | |
| NUE586 | 9751.1 | 3.847 | 9.6E−02 | 22.28 | 3.171 | 2.3E−01 | 30.87 |
| NUE586 | 9751.7 | 4.956 | 9.5E−03 | 57.53 | 4.510 | 8.1E−02 | 86.12 |
| NUE586 | 9752.2 | 4.538 | 2.3E−04 | 44.25 | 3.478 | 1.6E−03 | 43.54 |
| NUE586 | 9751.3 | 4.047 | 2.8E−01 | 28.62 | 3.090 | 3.3E−01 | 27.54 |
| NUE586 | 9752.1 | 4.629 | 3.9E−02 | 47.13 | 4.232 | 1.4E−01 | 74.66 |
| Control | | 3.146 | | | 2.423 | | |
| NUE587 | 9643.2 | 3.473 | 3.4E−01 | 10.38 | 3.653 | 4.2E−02 | 50.77 |
| Control | | 3.146 | | | 2.423 | | |
| NUE593 | 10394.2 | 4.033 | 4.5E−02 | 21.96 | 3.941 | 3.7E−02 | 29.39 |
| NUE593 | 10393.2 | 3.719 | 6.3E−02 | 12.48 | 3.544 | 1.8E−01 | 16.38 |
| Control | | 3.306 | | | 3.046 | | |

Table 31: Analyses of root performance (root length and coverage) of transgenic plants overexpressing the exogenous polynucleotides of some embodiments of the invention (using the cloned or synthetic genes listed in Table 23 above) under the regulation of a constitutive promoter (35S) when grown under standard nitrogen conditions [normal or regular growth conditions (15 mM N)] as compared to control plants.
"Incr." = increment;
"RGR" = relative growth rate.

The genes presented in Table 32, hereinbelow, have improved plant growth rate when grown under standard nitrogen growth conditions, compared to control plants. Faster growth was observed when growth rate of leaf area and root length and coverage was measured.

Table 32 depicts analyses of leaf area, root length and root coverage growth rate when grown under standard nitrogen conditions [normal or regular growth conditions (15 mM N)] in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 32

Transgenic plants exogenously expressing the polynucleotides of some embodiments of the invention exhibit improved growth rate under standard nitrogen conditions

| Gene Name | Event # | RGR Of Leaf Area Ave. | p-value | % incr. | RGR Of Roots Coverage Ave. | p-value | % incr. | RGR Of Roots Length Ave. | p-value | % incr. |
|---|---|---|---|---|---|---|---|---|---|---|
| CT11 | 4892.2 | 0.093 | 2.4E−04 | 76.02 | 0.584 | 7.8E−02 | 28.88 | 0.428 | 1.0E−01 | 17.45 |
| CT11 | 4892.3 | 0.082 | 1.3E−03 | 55.84 | 0.524 | 3.6E−01 | 15.68 | 0.397 | 4.0E−01 | 8.75 |
| CT11 | 4892.1 | 0.085 | 6.5E−03 | 61.71 | 0.490 | 6.8E−01 | 8.24 | 0.385 | 6.7E−01 | 5.43 |
| Control |  | 0.053 |  |  | 0.453 |  |  | 0.365 |  |  |
| CT11 | 4894.2 | 0.049 | 2.0E−02 | 30.32 |  |  |  |  |  |  |
| CT11 | 4893.2 | 0.078 | 3.6E−05 | 107.01 | 0.550 | 3.4E−02 | 52.79 | 0.395 | 2.0E−01 | 21.56 |
| Control |  | 0.037 |  |  | 0.360 |  |  | 0.325 |  |  |
| CT27 | 5033.6 | 0.040 | 1.6E−01 | 22.17 | 0.347 | 4.1E−02 | 40.85 | 0.325 | 1.9E−02 | 36.08 |
| CT27 | 5033.4 | 0.047 | 3.2E−02 | 40.54 | 0.287 | 3.5E−01 | 16.49 | 0.296 | 5.9E−02 | 24.30 |
| CT27 | 5033.8 | 0.063 | 5.9E−05 | 90.98 | 0.357 | 1.0E−01 | 44.71 | 0.251 | 7.5E−01 | 5.19 |
| CT27 | 5033.5 | 0.049 | 3.7E−03 | 48.72 |  |  |  | 0.248 | 7.8E−01 | 3.85 |
| Control |  | 0.033 |  |  | 0.247 |  |  | 0.238 |  |  |
| CT27 | 5033.7 | 0.049 | 1.8E−02 | 31.77 |  |  |  |  |  |  |
| CT27 | 5035.2 | 0.079 | 8.4E−07 | 111.02 | 0.402 | 5.8E−01 | 11.56 | 0.343 | 7.1E−01 | 5.73 |
| CT27 | 5031.4 | 0.053 | 1.5E−03 | 41.85 |  |  |  |  |  |  |
| CT27 | 5033.6 | 0.058 | 4.6E−04 | 53.91 | 0.513 | 3.1E−02 | 42.39 | 0.357 | 5.4E−01 | 10.03 |
| CT27 | 5033.4 | 0.060 | 2.2E−05 | 59.59 | 0.547 | 3.2E−02 | 51.81 | 0.416 | 9.9E−02 | 28.01 |
| CT27 | 5033.8 | 0.055 | 3.8E−04 | 47.37 |  |  |  |  |  |  |
| CT27 | 5033.5 | 0.047 | 4.0E−02 | 25.25 |  |  |  |  |  |  |
| Control |  | 0.037 |  |  | 0.360 |  |  | 0.325 |  |  |
| CT6 | 4943.1 | 0.048 | 6.3E−02 | 27.13 | 0.378 | 8.1E−01 | 4.79 |  |  |  |
| Control |  | 0.037 |  |  | 0.360 |  |  | 0.325 |  |  |
| CT75 | 4872.5 | 0.055 | 2.1E−03 | 47.90 |  |  |  |  |  |  |
| CT75 | 4874.4 | 0.053 | 3.2E−03 | 42.55 |  |  |  |  |  |  |
| CT75 | 4874.7 | 0.054 | 6.7E−03 | 44.21 | 0.368 | 9.2E−01 | 2.17 |  |  |  |
| CT75 | 4873.3 | 0.052 | 1.3E−02 | 39.84 | 0.518 | 4.3E−02 | 43.91 | 0.415 | 1.1E−01 | 27.69 |
| Control |  | 0.037 |  |  | 0.360 |  |  | 0.325 |  |  |
| CT76 | 5044.6 | 0.072 | 2.6E−02 | 36.36 |  |  |  |  |  |  |
| CT76 | 5041.5 | 0.068 |  | 29.56 | 0.685 | 2.8E−02 | 51.34 | 0.403 | 4.7E−01 | 10.41 |
| CT76 | 5041.7 | 0.058 |  | 9.50 |  |  |  |  |  |  |
| CT76 | 5043.5 | 0.114 | 1.4E−07 | 115.19 | 0.961 | 9.5E−06 | 112.17 | 0.506 | 2.2E−03 | 38.75 |
| CT76 | 5041.6 | 0.082 | 7.3E−03 | 55.95 | 0.626 | 9.8E−02 | 38.15 | 0.448 | 5.4E−02 | 22.83 |
| CT76 | 5041.9 | 0.079 | 3.8E−03 | 49.27 | 0.571 | 9.6E−02 | 25.96 | 0.378 | 7.0E−01 | 3.74 |
| Control |  | 0.053 |  |  | 0.453 |  |  | 0.365 |  |  |
| CT76 | 5044.6 | 0.064 | 2.7E−05 | 92.67 | 0.283 | 4.2E−01 | 14.80 | 0.292 | 1.2E−01 | 22.42 |
| CT76 | 5041.5 | 0.094 | 9.7E−12 | 182.48 | 0.635 | 9.1E−08 | 157.51 | 0.384 | 2.8E−05 | 61.08 |
| CT76 | 5041.7 | 0.042 | 3.4E−02 | 25.46 |  |  |  |  |  |  |
| CT76 | 5043.5 | 0.091 | 1.1E−11 | 174.29 | 0.394 | 2.7E−03 | 59.72 | 0.300 | 4.2E−02 | 25.74 |
| CT76 | 5041.6 | 0.052 | 7.3E−05 | 55.70 | 0.287 | 3.9E−01 | 16.43 | 0.271 | 3.6E−01 | 13.45 |
| CT76 | 5041.9 | 0.066 | 4.5E−07 | 100.31 | 0.408 | 1.2E−03 | 65.59 | 0.317 | 9.7E−03 | 33.04 |
| Control |  | 0.033 |  |  | 0.247 |  |  | 0.238 |  |  |
| NUE206 | 6731.2 |  |  |  | 0.396 | 1.6E−03 | 78.33 | 0.369 | 8.5E−03 | 44.35 |
| NUE206 | 6732.1 |  |  |  | 0.297 | 1.5E−01 | 33.53 | 0.333 | 4.9E−02 | 30.52 |
| Control |  | 0.036 |  |  | 0.222 |  |  | 0.256 |  |  |
| NUE206 | 6731.2 | 0.063 | 6.3E−01 | 7.32 | 0.650 | 3.1E−05 | 125.39 | 0.435 | 4.9E−05 | 65.80 |
| NUE206 | 6732.5 | 0.074 | 9.5E−02 | 26.57 | 0.579 | 4.4E−06 | 100.85 | 0.389 | 8.9E−05 | 48.32 |
| NUE206 | 6732.2 | 0.059 | 9.2E−01 | 1.58 | 0.464 | 1.9E−03 | 60.76 | 0.365 | 4.6E−03 | 39.21 |
| Control |  | 0.058 |  |  | 0.288 |  |  | 0.262 |  |  |
| NUE208 | 8351.3 | 0.033 |  |  | 0.389 | 1.4E−03 | 74.92 | 0.397 | 1.9E−04 | 55.33 |
| Control |  | 0.036 |  |  | 0.222 |  |  | 0.256 |  |  |
| NUE208 | 8354.8 | 0.041 |  | 24.69 | 0.422 | 3.7E−02 | 51.73 | 0.393 | 8.2E−02 | 35.05 |
| NUE208 | 8355.3 | 0.037 |  | 13.69 | 0.418 | 3.5E−02 | 50.07 | 0.331 | 4.7E−01 | 13.65 |
| Control |  | 0.033 |  |  | 0.278 |  |  | 0.291 |  |  |
| NUE208 | 8354.8 | 0.076 | 9.1E−02 | 30.54 |  |  |  |  |  |  |
| NUE208 | 8354.5 | 0.073 | 1.8E−01 | 24.95 | 0.305 | 7.4E−01 | 5.73 | 0.276 | 6.4E−01 | 5.23 |
| NUE208 | 8355.3 | 0.079 | 5.8E−02 | 34.69 | 0.460 | 7.5E−03 | 59.54 | 0.362 | 3.1E−03 | 37.83 |
| NUE208 | 8351.5 | 0.059 | 9.0E−01 | 1.94 | 0.312 | 6.2E−01 | 8.27 | 0.315 | 9.1E−02 | 19.92 |
| Control |  | 0.058 |  |  | 0.288 |  |  | 0.262 |  |  |
| NUE209 | 8192.1 | 0.045 | 1.4E−01 | 36.98 | 0.450 | 1.9E−02 | 61.65 | 0.368 | 1.4E−01 | 26.60 |
| NUE209 | 8191.5 | 0.044 | 7.8E−02 | 34.71 | 0.295 | 7.7E−01 | 6.00 |  |  |  |
| Control |  | 0.033 |  |  | 0.278 |  |  | 0.291 |  |  |
| NUE209 | 8191.2 | 0.041 | 4.5E−02 | 31.45 | 0.330 | 4.3E−01 | 12.88 | 0.335 | 4.4E−01 | 12.06 |
| NUE209 | 8192.1 | 0.035 | 3.6E−01 | 14.35 |  |  |  |  |  |  |
| NUE209 | 8192.1 | 0.044 | 2.3E−02 | 40.98 |  |  |  |  |  |  |
| NUE209 | 8191.5 | 0.040 | 5.9E−02 | 30.43 |  |  |  |  |  |  |
| NUE209 | 8192.1 | 0.034 | 5.7E−01 | 9.26 |  |  |  |  |  |  |
| Control |  | 0.031 |  |  | 0.292 |  |  | 0.299 |  |  |
| NUE209 | 8192.1 |  |  |  | 0.345 |  | 19.74 | 0.365 | 1.4E−03 | 39.07 |
| NUE209 | 8192.1 |  |  |  | 0.487 | 9.6E−03 | 68.94 | 0.377 | 2.8E−02 | 43.59 |
| NUE209 | 8191.3 | 0.083 | 4.7E−02 | 41.92 |  |  |  |  |  |  |
| Control |  | 0.058 |  |  | 0.288 |  |  | 0.262 |  |  |
| NUE210 | 8202.1 | 0.049 | 3.9E−02 | 48.76 |  |  |  |  |  |  |

TABLE 32-continued

Transgenic plants exogenously expressing the polynucleotides of some embodiments of the invention exhibit improved growth rate under standard nitrogen conditions

| Gene Name | Event # | RGR Of Leaf Area | | | RGR Of Roots Coverage | | | RGR Of Roots Length | | |
|---|---|---|---|---|---|---|---|---|---|---|
| | | Ave. | p-value | % incr. | Ave. | p-value | % incr. | Ave. | p-value | % incr. |
| NUE210 | 8201.3 | 0.049 | 9.7E−03 | 50.64 | | | | | | |
| Control | | 0.033 | | | 0.278 | | | 0.291 | | |
| NUE210 | 8202.1 | 0.042 | 3.6E−02 | 34.98 | 0.403 | 4.8E−02 | 37.90 | 0.345 | 3.7E−01 | 15.40 |
| NUE210 | 6755.3 | 0.048 | 4.6E−03 | 55.18 | 0.423 | 1.9E−02 | 44.72 | 0.441 | 1.1E−02 | 47.78 |
| Control | | 0.031 | | | 0.292 | | | 0.299 | | |
| NUE211 | 8263.5 | 0.038 | 7.6E−05 | 89.32 | 0.191 | 8.9E−02 | 58.43 | 0.215 | 5.7E−02 | 53.44 |
| Control | | 0.020 | | | 0.121 | | | 0.140 | | |
| NUE212 | 8335.1 | 0.036 | 2.7E−03 | 82.84 | 0.216 | 5.8E−02 | 79.29 | 0.235 | 4.4E−02 | 68.20 |
| NUE212 | 8334.1 | 0.029 | 6.2E−03 | 46.65 | 0.131 | 7.9E−01 | 8.85 | 0.159 | 6.3E−01 | 13.62 |
| NUE212 | 8331.4 | 0.026 | 9.1E−02 | 31.28 | | | | 0.153 | 7.1E−01 | 9.70 |
| Control | | 0.020 | | | 0.121 | | | 0.140 | | |
| NUE212 | 8335.2 | 0.049 | 1.5E−02 | 48.76 | 0.314 | 5.6E−01 | 12.68 | | | |
| Control | | 0.033 | | | 0.278 | | | 0.291 | | |
| NUE212 | 8332.2 | 0.046 | 8.1E−01 | 3.53 | 0.656 | 4.5E−02 | 27.59 | 0.507 | 1.2E−01 | 19.17 |
| Control | | 0.044 | | | 0.514 | | | 0.426 | | |
| NUE212 | 8332.1 | 0.039 | 5.5E−02 | 26.08 | | | | | | |
| NUE212 | 8334.1 | 0.044 | 5.7E−03 | 41.96 | 0.316 | 6.2E−01 | 8.13 | 0.361 | 2.1E−01 | 20.73 |
| NUE212 | 8331.4 | 0.041 | 3.2E−02 | 31.53 | | | | 0.307 | 8.8E−01 | 2.62 |
| Control | | 0.031 | | | 0.292 | | | 0.299 | | |
| NUE222 | 8851.3 | 0.046 | 6.7E−02 | 41.29 | 0.365 | 2.2E−01 | 31.13 | 0.291 | 1.0E+00 | −0.102 |
| Control | | 0.033 | | | 0.278 | | | 0.291 | | |
| NUE223 | 9613.1 | | | | 0.659 | 3.7E−02 | 36.07 | 0.449 | 9.4E−02 | 19.43 |
| Control | | 0.068 | | | 0.484 | | | 0.376 | | |
| NUE224 | 9002.2 | 0.052 | 5.5E−02 | 23.49 | | | | | | |
| NUE224 | 9001.3 | 0.055 | 2.7E−02 | 30.04 | | | | | | |
| Control | | 0.042 | | | 0.445 | | | 0.370 | | |
| NUE224 | 9001.3 | 0.046 | 3.2E−02 | 28.75 | | | | | | |
| Control | | 0.036 | | | 0.279 | | | 0.316 | | |
| NUE227 | 9851.2 | 0.058 | 2.8E−02 | 35.17 | | | | | | |
| NUE227 | 9853.1 | 0.064 | 3.6E−03 | 49.89 | | | | | | |
| Control | | 0.043 | | | 0.349 | | | 0.360 | | |
| NUE228 | 10093 | 0.078 | 2.9E−02 | 39.70 | 0.355 | | 3.25 | 0.328 | | 16.65 |
| NUE228 | 10093 | 0.067 | 2.1E−01 | 20.98 | | | | 0.301 | | 7.24 |
| Control | | 0.056 | | | 0.344 | | | 0.281 | | |
| NUE229 | 8864.2 | 0.045 | 3.9E−02 | 26.44 | | | | | | |
| Control | | 0.036 | | | 0.279 | | | 0.316 | | |
| NUE230 | 9154.2 | 0.057 | 2.1E−02 | 35.25 | 0.461 | | 3.61 | | | |
| NUE230 | 9151.2 | 0.055 | 1.7E−02 | 29.70 | | | | | | |
| Control | | 0.042 | | | 0.445 | | | 0.370 | | |
| NUE230 | 9152.4 | 0.047 | 1.7E−01 | 29.87 | 0.378 | 7.6E−02 | 35.74 | 0.328 | 7.2E−01 | 3.71 |
| Control | | 0.036 | | | 0.279 | | | 0.316 | | |
| NUE233 | 10174 | 0.051 | 4.1E−06 | 93.04 | 0.340 | 1.4E−02 | 54.67 | 0.311 | 1.7E−01 | 31.25 |
| NUE233 | 10174 | 0.069 | 5.1E−11 | 160.30 | 0.624 | 8.1E−09 | 183.57 | 0.399 | 7.2E−03 | 68.42 |
| NUE233 | 10174 | 0.030 | 3.6E−01 | 13.97 | 0.314 | 4.1E−02 | 42.81 | 0.344 | 5.6E−02 | 45.20 |
| NUE233 | 10173 | 0.032 | 1.9E−01 | 19.26 | 0.342 | 9.3E−03 | 55.25 | 0.324 | 1.1E−01 | 36.68 |
| NUE233 | 10174 | 0.039 | 1.1E−02 | 45.92 | 0.299 | 1.2E−01 | 35.80 | 0.262 | 6.4E−01 | 10.75 |
| Control | | 0.026 | | | 0.220 | | | 0.237 | | |
| NUE233 | 10174 | 0.053 | 7.8E−01 | 4.51 | 0.451 | 3.0E−01 | 17.53 | 0.381 | 5.1E−02 | 32.89 |
| NUE233 | 10174 | | | | 0.538 | 2.8E−02 | 40.15 | 0.407 | 1.2E−02 | 41.78 |
| Control | | 0.051 | | | 0.384 | | | 0.287 | | |
| NUE234 | 9163.5 | 0.044 | 9.7E−02 | 22.24 | | | | | | |
| NUE234 | 9162.1 | 0.048 | 2.8E−02 | 32.38 | 0.381 | 7.4E−02 | 36.73 | 0.330 | 7.6E−01 | 4.39 |
| Control | | 0.036 | | | 0.279 | | | 0.316 | | |
| NUE235 | 9694.2 | 0.054 | 3.7E−02 | 27.26 | 0.475 | 6.0E−01 | 6.64 | | | |
| NUE235 | 9691.1 | 0.055 | 6.9E−02 | 31.10 | 0.454 | 8.9E−01 | 1.90 | 0.382 | 7.4E−01 | 3.28 |
| NUE235 | 9693.3 | 0.054 | 5.5E−02 | 28.28 | | | | | | |
| NUE235 | 9694.3 | 0.062 | 1.0E−03 | 46.88 | 0.583 | 1.9E−02 | 30.90 | 0.470 | 1.2E−02 | 27.17 |
| Control | | 0.042 | | | 0.445 | | | 0.370 | | |
| NUE237 | 9651.1 | 0.073 | 7.6E−06 | 74.28 | 0.508 | 2.1E−01 | 14.12 | | | |
| NUE237 | 9654.4 | 0.057 | 5.2E−03 | 36.61 | 0.553 | 2.5E−02 | 24.26 | 0.384 | 7.1E−01 | 3.83 |
| NUE237 | 9654.1 | 0.065 | 8.0E−03 | 53.61 | 0.680 | 5.8E−03 | 52.84 | 0.445 | 9.4E−02 | 20.30 |
| Control | | 0.042 | | | 0.445 | | | 0.370 | | |
| NUE237 | 9651.1 | 0.047 | 4.6E−02 | 31.99 | 0.331 | 9.7E−01 | 0.99 | | | |
| NUE237 | 9654.1 | 0.056 | 6.7E−03 | 58.85 | 0.493 | 9.9E−02 | 50.53 | 0.363 | 5.2E−01 | 13.15 |
| Control | | 0.036 | | | 0.327 | | | 0.321 | | |
| NUE241 | 9631.3 | 0.066 | 4.8E−04 | 52.60 | 0.452 | 5.0E−02 | 29.57 | 0.395 | 3.6E−01 | 9.92 |
| NUE241 | 9632.5 | 0.066 | 9.6E−03 | 52.36 | 0.733 | 8.9E−08 | 110.05 | 0.490 | 2.0E−03 | 36.33 |
| NUE241 | 9632.3 | 0.060 | 4.8E−02 | 39.27 | 0.494 | 5.1E−02 | 41.65 | 0.377 | 7.3E−01 | 4.72 |
| NUE241 | 9632.4 | 0.060 | 5.7E−03 | 38.59 | 0.428 | 1.8E−01 | 22.84 | | | |
| Control | | 0.043 | | | 0.349 | | | 0.360 | | |
| NUE242 | 9214.1 | 0.074 | 7.4E−02 | 25.97 | 0.460 | 8.2E−01 | 4.07 | 0.380 | 3.8E−01 | 13.95 |
| NUE242 | 9213.4 | 0.068 | 2.6E−01 | 16.65 | 0.588 | 8.2E−02 | 32.97 | 0.428 | 7.7E−02 | 28.57 |

TABLE 32-continued

Transgenic plants exogenously expressing the polynucleotides of some embodiments of the invention exhibit improved growth rate under standard nitrogen conditions

| Gene Name | Event # | RGR Of Leaf Area | | | RGR Of Roots Coverage | | | RGR Of Roots Length | | |
|---|---|---|---|---|---|---|---|---|---|---|
| | | Ave. | p-value | % incr. | Ave. | p-value | % incr. | Ave. | p-value | % incr. |
| Control | | 0.059 | | | 0.442 | | | 0.333 | | |
| NUE242 | 9212.1 | 0.050 | 4.6E−02 | 43.13 | 0.374 | 8.2E−01 | 2.93 | | | |
| NUE242 | 9214.1 | 0.052 | 4.5E−02 | 47.68 | | | | | | |
| NUE242 | 9213.4 | 0.050 | 3.3E−02 | 41.82 | 0.504 | 1.6E−02 | 38.74 | 0.409 | 1.8E−01 | 20.10 |
| Control | | 0.035 | | | 0.363 | | | 0.341 | | |
| NUE244 | 9061.5 | 0.049 | 2.2E−03 | 35.40 | 0.347 | 1.9E−01 | 24.39 | 0.324 | 8.4E−01 | 2.40 |
| Control | | 0.036 | | | 0.279 | | | 0.316 | | |
| NUE245 | 10642 | 0.080 | 7.9E−02 | 33.89 | 0.622 | 2.6E−02 | 60.99 | 0.397 | 2.9E−02 | 26.31 |
| Control | | 0.060 | | | 0.387 | | | 0.315 | | |
| NUE246 | 9033.8 | | | | 0.462 | 7.1E−02 | 30.62 | 0.400 | 2.0E−01 | 18.15 |
| Control | | 0.049 | | | 0.354 | | | 0.339 | | |
| NUE246 | 9033.6 | 0.053 | 5.9E−01 | 8.27 | | | | | | |
| NUE246 | 9033.4 | 0.053 | 5.4E−01 | 8.70 | 0.546 | 1.5E−01 | 30.07 | 0.410 | 2.1E−01 | 14.19 |
| NUE246 | 9033.8 | 0.075 | 3.8E−03 | 52.67 | 0.658 | 9.3E−03 | 56.72 | 0.436 | 4.3E−02 | 21.22 |
| NUE246 | 9034.1 | 0.060 | 1.3E−01 | 22.21 | | | | | | |
| NUE246 | 9031.1 | 0.057 | 2.3E−01 | 16.59 | 0.505 | 2.9E−01 | 20.28 | 0.424 | 6.6E−02 | 17.89 |
| Control | | 0.049 | | | 0.420 | | | 0.359 | | |
| NUE248 | 8981.5 | 0.085 | 3.9E−03 | 63.02 | 0.638 | 5.3E−01 | 11.57 | | | |
| Control | | 0.052 | | | 0.572 | | | 0.423 | | |
| NUE250 | 9132.1 | 0.078 | 1.3E−03 | 86.50 | 0.604 | 7.4E−02 | 35.67 | 0.386 | | 4.46 |
| NUE250 | 9132.2 | 0.054 | 4.2E−02 | 28.86 | | | | | | |
| NUE250 | 9134.1 | 0.051 | 1.3E−01 | 21.34 | | | | | | |
| Control | | 0.042 | | | 0.445 | | | 0.370 | | |
| NUE250 | 9134.1 | 0.043 | 6.6E−02 | 19.98 | 0.329 | 3.0E−01 | 17.87 | | | |
| Control | | 0.036 | | | 0.279 | | | 0.316 | | |
| NUE251 | 10181 | 0.059 | 5.5E−06 | 122.34 | 0.396 | 9.1E−04 | 80.08 | 0.349 | 5.2E−02 | 47.21 |
| NUE251 | 10183 | 0.048 | 2.3E−04 | 80.31 | 0.369 | 5.8E−03 | 67.70 | 0.343 | 5.7E−02 | 44.89 |
| NUE251 | 10183 | 0.042 | 2.5E−03 | 58.23 | 0.366 | 9.1E−03 | 66.32 | 0.377 | 1.9E−02 | 59.19 |
| NUE251 | 10181 | 0.039 | 5.8E−03 | 48.78 | 0.249 | 5.2E−01 | 13.16 | 0.240 | 9.5E−01 | 1.48 |
| Control | | 0.026 | | | 0.220 | | | 0.237 | | |
| NUE251 | 10181 | 0.063 | 1.5E−01 | 23.79 | 0.582 | 8.9E−03 | 51.43 | 0.381 | 3.8E−02 | 32.80 |
| Control | | 0.051 | | | 0.384 | | | 0.287 | | |
| NUE251 | 10183 | 0.072 | 9.1E−02 | 19.27 | | | | 0.324 | 6.6E−01 | 3.02 |
| Control | | 0.060 | | | 0.387 | | | 0.315 | | |
| NUE256 | 10063 | 0.050 | 7.6E−06 | 89.88 | 0.520 | 1.9E−05 | 136.35 | 0.410 | 6.7E−03 | 72.97 |
| NUE256 | 10064 | 0.076 | 2.0E−11 | 188.66 | 0.442 | 5.9E−05 | 100.99 | 0.356 | 3.4E−02 | 50.21 |
| NUE256 | 10061 | 0.056 | 5.0E−08 | 110.73 | 0.450 | 1.2E−05 | 104.36 | 0.330 | 8.2E−02 | 39.37 |
| NUE256 | 10062 | 0.054 | 2.3E−06 | 103.99 | 0.327 | 7.9E−02 | 48.64 | 0.272 | 5.3E−01 | 14.99 |
| NUE256 | 10063 | 0.051 | 9.1E−06 | 93.42 | 0.424 | 2.3E−03 | 92.64 | 0.335 | 1.0E−01 | 41.59 |
| Control | | 0.026 | | | 0.220 | | | 0.237 | | |
| NUE268 | 8996.5 | 0.072 | 7.2E−03 | 43.95 | | | | 0.388 | 7.2E−01 | 3.95 |
| Control | | 0.050 | | | 0.463 | | | 0.374 | | |
| NUE512 | 9284.2 | 0.052 | 3.6E−03 | 48.09 | 0.369 | 3.4E−01 | 18.49 | 0.372 | 9.7E−02 | 22.41 |
| NUE512 | 9282.3 | 0.073 | 4.5E−09 | 108.17 | 0.514 | 2.9E−03 | 64.80 | 0.403 | 2.2E−02 | 32.41 |
| NUE512 | 9284.4 | 0.041 | 1.5E−01 | 18.26 | 0.450 | 2.2E−02 | 44.50 | 0.390 | 5.3E−02 | 28.25 |
| Control | | 0.035 | | | 0.312 | | | 0.304 | | |
| NUE513 | 9683.5 | | | | | | | 0.511 | 5.7E−02 | 20.91 |
| Control | | 0.052 | | | 0.572 | | | 0.423 | | |
| NUE513 | 9683.5 | | | | 0.521 | | 24.10 | 0.512 | 1.8E−05 | 42.60 |
| Control | | 0.049 | | | 0.420 | | | 0.359 | | |
| NUE514 | 9404.1 | 0.082 | 7.9E−07 | 133.82 | 0.426 | 2.2E−01 | 17.18 | 0.377 | 4.6E−01 | 10.68 |
| NUE514 | 9402.2 | 0.044 | 1.7E−01 | 26.64 | 0.389 | 6.0E−01 | 7.20 | 0.356 | 7.5E−01 | 4.44 |
| NUE514 | 9403.2 | 0.046 | 1.3E−01 | 31.04 | 0.776 | 1.9E−07 | 113.56 | 0.565 | 8.5E−05 | 65.81 |
| Control | | 0.035 | | | 0.363 | | | 0.341 | | |
| NUE516 | 9291.1 | 0.054 | 4.3E−02 | 28.22 | 0.577 | 4.3E−02 | 29.59 | 0.407 | 3.9E−01 | 10.04 |
| NUE516 | 9291.4 | 0.064 | 8.4E−05 | 52.81 | 0.531 | 7.4E−02 | 19.37 | 0.392 | 5.9E−01 | 6.00 |
| Control | | 0.042 | | | 0.445 | | | 0.370 | | |
| NUE520 | 9771.4 | 0.049 | 5.8E−05 | 87.02 | 0.408 | 2.7E−03 | 85.53 | 0.370 | 1.7E−02 | 56.27 |
| NUE520 | 9771.7 | 0.050 | 6.3E−05 | 88.34 | 0.404 | 5.1E−03 | 83.74 | 0.372 | 2.1E−02 | 57.16 |
| NUE520 | 9771.2 | 0.042 | 8.9E−04 | 59.66 | 0.491 | 4.1E−05 | 122.92 | 0.330 | 1.1E−01 | 39.23 |
| NUE520 | 9772.1 | | | | 0.462 | 5.2E−04 | 109.90 | 0.301 | 2.6E−01 | 27.23 |
| NUE520 | 9771.3 | 0.035 | 3.8E−02 | 32.37 | 0.454 | 1.3E−04 | 106.42 | 0.346 | 5.1E−02 | 46.13 |
| NUE520 | 9773.1 | 0.023 | 4.8E−01 | −14.07 | 0.369 | 7.7E−02 | 67.68 | 0.329 | 2.3E−01 | 38.86 |
| Control | | 0.026 | | | 0.220 | | | 0.237 | | |
| NUE520 | 9771.4 | | | | 0.360 | 7.9E−01 | 4.93 | 0.352 | 6.6E−02 | 25.41 |
| NUE520 | 9771.7 | | | | 0.434 | 1.9E−01 | 26.37 | 0.377 | 2.5E−02 | 34.19 |
| Control | | 0.056 | | | 0.344 | | | 0.281 | | |
| NUE521 | 9362.2 | 0.051 | 4.7E−02 | 29.12 | 0.430 | 6.6E−01 | 9.02 | 0.375 | 6.4E−01 | 6.57 |
| NUE521 | 9363.4 | 0.073 | 5.8E−05 | 84.97 | 0.407 | 8.4E−01 | 3.33 | 0.349 | 9.6E−01 | −0.67 |
| Control | | 0.040 | | | 0.394 | | | 0.351 | | |
| NUE521 | 9361.2 | 0.051 | 3.9E−02 | 44.60 | 0.370 | 8.9E−01 | 1.86 | 0.349 | 8.6E−01 | 2.50 |
| NUE521 | 9363.4 | 0.059 | 3.0E−03 | 69.25 | 0.313 | 3.7E−01 | | | | |

TABLE 32-continued

Transgenic plants exogenously expressing the polynucleotides of some embodiments of the invention exhibit improved growth rate under standard nitrogen conditions

| Gene Name | Event # | RGR Of Leaf Area Ave. | p-value | % incr. | RGR Of Roots Coverage Ave. | p-value | % incr. | RGR Of Roots Length Ave. | p-value | % incr. |
|---|---|---|---|---|---|---|---|---|---|---|
| Control | | 0.035 | | | 0.363 | | | 0.341 | | |
| NUE523 | 9412.1 | 0.070 | 2.7E−02 | 35.53 | | | | | | |
| Control | | 0.052 | | | 0.572 | | | 0.423 | | |
| NUE523 | 9413.3 | 0.059 | 3.1E−02 | 49.30 | 0.466 | 4.2E−01 | 18.10 | 0.406 | 3.4E−01 | 15.59 |
| NUE523 | 9414.2 | 0.052 | 1.4E−01 | 30.19 | 0.516 | 8.7E−02 | 30.82 | 0.471 | 3.2E−02 | 34.02 |
| Control | | 0.040 | | | 0.394 | | | 0.351 | | |
| NUE523 | 9412.5 | 0.053 | 1.6E−02 | 51.59 | 0.522 | 3.6E−03 | 43.78 | 0.392 | 2.8E−01 | 15.04 |
| NUE523 | 9414.2 | 0.046 | 8.0E−02 | 32.35 | 0.523 | 4.2E−03 | 43.92 | 0.394 | 2.6E−01 | 15.82 |
| Control | | 0.035 | | | 0.363 | | | 0.341 | | |
| NUE527 | 9202.6 | 0.046 | 1.5E−01 | 22.86 | 0.375 | 2.0E−01 | 25.97 | 0.374 | 2.8E−02 | 46.88 |
| Control | | 0.038 | | | 0.297 | | | 0.254 | | |
| NUE531 | 10083 | 0.078 | 2.7E−02 | 40.47 | | | | 0.305 | 5.6E−01 | 8.47 |
| NUE531 | 10081 | 0.090 | 3.8E−03 | 62.13 | 0.535 | 7.9E−03 | 55.85 | 0.359 | 5.6E−02 | 27.85 |
| NUE531 | 10082 | 0.086 | 1.2E−02 | 55.40 | 0.554 | 1.3E−02 | 61.37 | 0.398 | 1.2E−02 | 41.80 |
| Control | | 0.056 | | | 0.344 | | | 0.281 | | |
| NUE531 | 10081 | 0.080 | 2.5E−02 | 32.77 | 0.578 | | 49.54 | 0.386 | | 22.62 |
| NUE531 | 10082 | 0.078 | 2.4E−02 | 30.60 | 0.581 | 1.5E−02 | 50.29 | 0.410 | 7.9E−04 | 30.44 |
| Control | | 0.060 | | | 0.387 | | | 0.315 | | |
| NUE535 | 9084.2 | 0.043 | 1.2E−03 | 62.38 | 0.345 | 2.6E−02 | 56.73 | 0.277 | 4.6E−01 | 17.08 |
| NUE535 | 9083.1 | 0.082 | 3.3E−09 | 211.11 | 0.388 | 5.6E−03 | 76.23 | 0.325 | 1.2E−01 | 37.19 |
| NUE535 | 9084.4 | 0.042 | 4.8E−04 | 59.66 | 0.246 | 5.8E−01 | 11.82 | 0.306 | 2.2E−01 | 29.02 |
| NUE535 | 9082.1 | 0.039 | 2.9E−02 | 46.36 | | | | | | |
| Control | | 0.026 | | | 0.220 | | | 0.237 | | |
| NUE537 | 9391.1 | 0.053 | 4.2E−03 | 51.98 | 0.444 | 6.2E−02 | 42.62 | 0.388 | 5.6E−02 | 27.48 |
| NUE537 | 9394.4 | 0.046 | 3.2E−02 | 31.60 | | | | | | |
| NUE537 | 9391.2 | 0.056 | 2.6E−04 | 60.43 | 0.385 | 2.0E−01 | 23.46 | 0.365 | 1.4E−01 | 19.94 |
| NUE537 | 9393.3 | 0.073 | 8.5E−07 | 109.66 | 0.481 | 1.3E−02 | 54.18 | 0.366 | 1.3E−01 | 20.35 |
| Control | | 0.035 | | | 0.312 | | | 0.304 | | |
| NUE538 | 9782.1 | 0.071 | 1.0E−03 | 64.80 | 0.474 | 2.4E−02 | 36.00 | 0.424 | 1.3E−01 | 17.89 |
| Control | | 0.043 | | | 0.349 | | | 0.360 | | |
| NUE538 | 9781.4 | 0.048 | 3.3E−01 | 15.40 | 0.405 | 5.9E−02 | 41.28 | 0.398 | 2.8E−02 | 31.83 |
| NUE538 | 9783.4 | 0.046 | 5.4E−01 | 9.73 | 0.414 | 9.5E−03 | 44.32 | 0.390 | 2.5E−02 | 29.10 |
| Control | | 0.042 | | | 0.287 | | | 0.302 | | |
| NUE539 | 10102 | 0.049 | 1.1E−03 | 83.56 | 0.307 | 1.3E−01 | 39.36 | 0.311 | 2.0E−01 | 31.26 |
| NUE539 | 10104 | 0.045 | 3.9E−04 | 69.52 | 0.317 | 6.6E−02 | 43.97 | 0.299 | 2.4E−01 | 26.34 |
| NUE539 | 10101 | 0.061 | 3.2E−08 | 129.48 | 0.266 | 3.2E−01 | 20.90 | 0.293 | 3.0E−01 | 23.62 |
| NUE539 | 10102 | 0.061 | 1.1E−06 | 132.28 | 0.410 | 5.3E−04 | 86.11 | 0.375 | 1.5E−02 | 58.30 |
| Control | | 0.026 | | | 0.220 | | | 0.237 | | |
| NUE539 | 10102 | | | | | | | 0.366 | 8.7E−02 | 27.65 |
| NUE539 | 10102 | | | | | | | 0.371 | 1.0E−01 | 29.42 |
| Control | | 0.051 | | | 0.384 | | | 0.287 | | |
| NUE542 | 9333.2 | 0.053 | 2.2E−04 | 50.87 | 0.445 | 3.5E−02 | 42.68 | 0.400 | 1.7E−02 | 31.61 |
| NUE542 | 9331.3 | 0.045 | 6.9E−02 | 27.12 | 0.450 | 6.4E−02 | 44.47 | 0.397 | 8.1E−02 | 30.56 |
| NUE542 | 9332.1 | 0.041 | 2.4E−01 | 16.04 | 0.414 | 8.3E−02 | 32.84 | 0.347 | 2.8E−01 | 14.05 |
| Control | | 0.035 | | | 0.312 | | | 0.304 | | |
| NUE543 | 10052 | 0.060 | 2.7E−02 | 39.61 | 0.505 | 8.0E−03 | 44.88 | 0.420 | 1.4E−01 | 16.75 |
| NUE543 | 10052 | 0.058 | 1.6E−02 | 33.92 | 0.399 | 3.4E−01 | 14.30 | | | |
| Control | | 0.043 | | | 0.349 | | | 0.360 | | |
| NUE543 | 10051 | 0.056 | 9.8E−01 | 0.47 | 0.509 | 2.1E−02 | 48.29 | 0.356 | 7.1E−02 | 26.63 |
| NUE543 | 10051 | 0.077 | 4.3E−02 | 39.35 | 0.452 | 1.5E−01 | 31.70 | 0.385 | 3.3E−02 | 36.96 |
| Control | | 0.056 | | | 0.344 | | | 0.281 | | |
| NUE544 | 9763.3 | 0.060 | 2.7E−02 | 35.77 | 0.602 | 2.4E−01 | 17.04 | | | |
| Control | | 0.044 | | | 0.514 | | | 0.426 | | |
| NUE544 | 9764.1 | 0.047 | 3.4E−01 | 11.45 | 0.367 | 7.3E−02 | 27.87 | 0.350 | 1.9E−01 | 15.92 |
| NUE544 | 9763.3 | 0.046 | 4.0E−01 | 9.93 | 0.358 | 1.0E−01 | 24.63 | 0.378 | 4.9E−02 | 24.94 |
| Control | | 0.042 | | | 0.287 | | | 0.302 | | |
| NUE548 | 9091.3 | 0.058 | 9.7E−01 | −0.55 | 0.489 | 5.6E−01 | 10.49 | 0.423 | 9.0E−02 | 26.90 |
| NUE548 | 9091.1 | 0.076 | 3.2E−02 | 29.54 | 0.578 | 1.1E−01 | 30.72 | 0.419 | 1.0E−01 | 25.87 |
| NUE548 | 9092.2 | 0.063 | 6.6E−01 | 6.64 | 0.686 | 2.4E−02 | 55.14 | 0.486 | 2.4E−02 | 45.86 |
| Control | | 0.059 | | | 0.442 | | | 0.333 | | |
| NUE549 | 9343.7 | 0.055 | 5.8E−03 | 53.63 | 0.362 | 7.2E−01 | 10.47 | | | |
| NUE549 | 9342.3 | 0.045 | 6.6E−02 | 26.67 | 0.330 | 9.7E−01 | 0.73 | 0.370 | 3.2E−01 | 15.10 |
| Control | | 0.036 | | | 0.327 | | | 0.321 | | |
| NUE550 | 9143.1 | 0.061 | 6.0E−02 | 36.03 | | | | | | |
| Control | | 0.045 | | | 0.416 | | | 0.368 | | |
| NUE550 | 9141.3 | 0.061 | 1.1E−01 | 21.68 | 0.651 | 1.3E−02 | 40.71 | 0.451 | 8.2E−02 | 20.82 |
| NUE550 | 9142.2 | 0.066 | 1.5E−02 | 31.25 | | | | | | |
| Control | | 0.050 | | | 0.463 | | | 0.374 | | |
| NUE560 | 9424.3 | 0.052 | 1.6E−02 | 31.56 | | | | 0.374 | | 6.54 |
| NUE560 | 9422.1 | 0.058 | 5.3E−04 | 46.65 | | | | | | |
| Control | | 0.040 | | | | | | 0.351 | | |
| NUE562 | 9252.8 | 0.055 | 4.1E−02 | 38.43 | | | | | | |

TABLE 32-continued

Transgenic plants exogenously expressing the polynucleotides of some embodiments of the invention exhibit improved growth rate under standard nitrogen conditions

| Gene Name | Event # | RGR Of Leaf Area Ave. | p-value | % incr. | RGR Of Roots Coverage Ave. | p-value | % incr. | RGR Of Roots Length Ave. | p-value | % incr. |
|---|---|---|---|---|---|---|---|---|---|---|
| Control | | 0.040 | | | | | | | | |
| NUE564 | 9243.2 | 0.049 | 8.7E−03 | 38.96 | 0.477 | 2.0E−02 | 53.10 | 0.356 | 2.2E−01 | 17.03 |
| NUE564 | 9242.2 | 0.060 | 7.6E−05 | 70.29 | 0.471 | 3.1E−02 | 51.25 | 0.452 | 8.2E−03 | 48.52 |
| NUE564 | 9243.4 | 0.045 | 8.0E−02 | 27.01 | 0.356 | 4.3E−01 | 14.34 | 0.349 | 2.8E−01 | 14.73 |
| Control | | 0.035 | | | 0.312 | | | 0.304 | | |
| NUE567 | 9263.2 | 0.047 | 1.8E−02 | 34.46 | | | | | | |
| Control | | 0.035 | | | | | | | | |
| NUE568 | 9471.3 | 0.059 | 4.2E−05 | 65.16 | 0.458 | 8.3E−02 | 40.04 | 0.358 | 4.4E−01 | 11.62 |
| NUE568 | 9461.3 | 0.062 | 1.5E−03 | 73.11 | 0.424 | 3.6E−01 | 29.62 | 0.347 | 6.9E−01 | 8.17 |
| NUE568 | 9474.4 | 0.056 | 4.1E−03 | 57.42 | 0.353 | 7.6E−01 | 7.67 | 0.331 | 8.6E−01 | 3.00 |
| NUE568 | 9472.2 | 0.071 | 3.5E−07 | 99.64 | 0.567 | 4.6E−03 | 73.13 | 0.364 | 4.0E−01 | 13.42 |
| NUE568 | 9462.3 | 0.047 | 5.2E−02 | 32.21 | 0.478 | 5.4E−02 | 45.99 | 0.369 | 3.9E−01 | 14.82 |
| Control | | 0.036 | | | 0.327 | | | 0.321 | | |
| NUE569 | 9381.2 | 0.056 | 5.3E−03 | 36.52 | 0.391 | 9.1E−01 | 1.25 | | | |
| Control | | 0.041 | | | 0.386 | | | 0.353 | | |
| NUE569 | 9381.1 | 0.053 | 8.1E−03 | 52.48 | 0.474 | 6.6E−02 | 52.21 | 0.342 | 4.9E−01 | 12.36 |
| Control | | 0.035 | | | 0.312 | | | 0.304 | | |
| NUE570 | 9314.1 | 0.049 | 1.8E−01 | 40.41 | 0.439 | 2.2E−01 | 40.98 | 0.420 | 7.2E−02 | 38.13 |
| Control | | 0.041 | | | 0.386 | | | 0.353 | | |
| NUE570 | 9311.4 | 0.047 | 3.3E−02 | 32.96 | 0.530 | 5.0E−03 | 70.17 | 0.456 | 7.3E−03 | 49.83 |
| NUE570 | 9311.3 | 0.040 | 2.3E−01 | 15.28 | 0.426 | 7.1E−02 | 36.71 | 0.397 | 3.7E−02 | 30.73 |
| NUE570 | 9314.4 | 0.035 | 9.4E−01 | 0.90 | 0.479 | 7.4E−03 | 53.70 | 0.368 | 1.1E−01 | 21.10 |
| NUE570 | 9314.1 | | | | 0.418 | 7.8E−02 | 34.04 | 0.374 | 1.0E−01 | 22.95 |
| Control | | 0.035 | | | 0.312 | | | 0.304 | | |
| NUE571 | 9304.2 | 0.078 | 3.4E−06 | 95.35 | 0.542 | 1.3E−01 | 37.40 | 0.420 | 2.1E−01 | 19.40 |
| NUE571 | 9301.1 | 0.063 | 9.9E−03 | 59.31 | 0.576 | 2.9E−02 | 46.03 | 0.389 | 4.4E−01 | 10.81 |
| NUE571 | 9303.2 | 0.053 | 1.1E−03 | 33.00 | | | | | | |
| NUE571 | 9302.1 | 0.062 | 7.2E−06 | 56.48 | | | | | | |
| NUE571 | 9302.3 | 0.054 | 2.1E−02 | 36.15 | | | | | | |
| Control | | 0.040 | | | 0.394 | | | 0.351 | | |
| NUE571 | 9304.3 | 0.055 | 6.8E−02 | 33.34 | | | | | | |
| NUE571 | 9304.2 | 0.054 | 7.6E−02 | 32.37 | | | | | | |
| NUE571 | 9303.2 | 0.050 | 1.0E−01 | 22.33 | | | | | | |
| NUE571 | 9301.4 | 0.049 | 9.7E−02 | 19.07 | | | | | | |
| Control | | 0.041 | | | | | | | | |
| NUE572 | 9324.3 | 0.049 | 2.7E−02 | 24.30 | 0.410 | 8.0E−01 | 3.99 | 0.381 | 5.3E−01 | 8.40 |
| Control | | 0.040 | | | 0.394 | | | 0.351 | | |
| NUE573 | 9491.1 | 0.053 | 1.5E−03 | 49.67 | 0.457 | 7.9E−02 | 39.55 | 0.382 | 1.9E−01 | 19.03 |
| NUE573 | 9491.4 | 0.050 | 8.7E−02 | 40.83 | 0.470 | 8.2E−02 | 43.44 | 0.400 | 1.9E−01 | 24.64 |
| Control | | 0.036 | | | 0.327 | | | 0.321 | | |
| NUE574 | 10366 | 0.063 | 8.1E−01 | 4.39 | 0.610 | 7.5E−03 | 57.68 | 0.473 | 6.5E−04 | 50.50 |
| Control | | 0.060 | | | 0.387 | | | 0.315 | | |
| NUE575 | 9502.1 | 0.052 | 7.9E−03 | 46.87 | 0.446 | 1.1E−01 | 36.36 | 0.343 | 6.5E−01 | 6.83 |
| Control | | 0.036 | | | 0.327 | | | 0.321 | | |
| NUE576 | 9792.4 | 0.050 | 2.2E−01 | 16.55 | 0.504 | 3.9E−03 | 44.47 | 0.390 | 4.7E−01 | 8.39 |
| NUE576 | 9794.1 | 0.054 | 5.4E−02 | 26.15 | 0.357 | 8.7E−01 | 2.30 | 0.392 | 4.4E−01 | 9.02 |
| NUE576 | 9793.3 | 0.065 | 1.8E−03 | 51.97 | 0.386 | 4.4E−01 | 10.78 | | | |
| Control | | 0.043 | | | 0.349 | | | 0.360 | | |
| NUE578 | 9524.3 | 0.055 | 1.8E−04 | 54.47 | 0.374 | 5.1E−01 | 14.35 | 0.360 | 4.1E−01 | 12.25 |
| NUE578 | 9524.1 | 0.050 | 2.5E−02 | 41.80 | | | | | | |
| Control | | 0.036 | | | 0.327 | | | 0.321 | | |
| NUE579 | 9701.3 | 0.051 | 8.7E−02 | 21.86 | 0.456 | 3.9E−03 | 58.84 | 0.377 | 8.8E−02 | 24.61 |
| Control | | 0.042 | | | 0.287 | | | 0.302 | | |
| NUE580 | 9551.4 | 0.040 | 4.3E−01 | 13.32 | 0.479 | 9.3E−02 | 46.41 | 0.361 | 4.2E−01 | 12.46 |
| NUE580 | 9554.4 | 0.049 | 1.2E−02 | 36.68 | 0.462 | 7.3E−02 | 41.18 | 0.382 | 2.3E−01 | 18.93 |
| Control | | 0.036 | | | 0.327 | | | 0.321 | | |
| NUE582 | 9562.4 | 0.059 | 3.4E−03 | 40.45 | 0.591 | 8.2E−03 | 32.70 | 0.414 | 1.9E−01 | 12.08 |
| NUE582 | 9561.2 | 0.061 | 4.1E−03 | 45.60 | | | | | | |
| Control | | 0.042 | | | 0.445 | | | 0.370 | | |
| NUE583 | 9671.1 | 0.057 | 1.3E−01 | 32.70 | 0.499 | 2.2E−02 | 43.12 | 0.401 | 4.5E−01 | 11.60 |
| Control | | 0.043 | | | 0.349 | | | 0.360 | | |
| NUE583 | 9673.4 | 0.106 | 1.1E−05 | 77.51 | 0.663 | 2.0E−04 | 71.43 | 0.416 | 4.2E−05 | 32.10 |
| NUE583 | 9673.2 | 0.077 | 4.3E−02 | 28.35 | 0.533 | 5.6E−02 | 37.79 | 0.331 | 5.4E−01 | 5.30 |
| Control | | 0.060 | | | 0.387 | | | 0.315 | | |
| NUE586 | 9751.7 | 0.067 | 5.9E−03 | 49.93 | 0.548 | 6.5E−01 | 6.47 | | | |
| NUE586 | 9752.1 | 0.066 | 4.3E−03 | 47.72 | 0.855 | 4.1E−05 | 66.23 | 0.563 | 1.2E−02 | 32.27 |
| Control | | 0.044 | | | 0.514 | | | 0.426 | | |
| NUE586 | 9751.1 | 0.052 | 8.3E−02 | 24.79 | 0.379 | 9.5E−02 | 32.19 | 0.393 | 3.6E−02 | 30.10 |
| NUE586 | 9751.7 | 0.067 | 7.5E−03 | 60.10 | 0.529 | 1.7E−03 | 84.40 | 0.452 | 1.5E−03 | 49.64 |
| NUE586 | 9752.2 | | | | 0.394 | 1.4E−02 | 37.21 | 0.390 | 2.6E−02 | 29.02 |
| NUE586 | 9752.1 | 0.055 | 5.8E−02 | 32.53 | 0.472 | 1.9E−02 | 64.61 | 0.400 | 4.5E−02 | 32.28 |
| Control | | 0.042 | | | 0.287 | | | 0.302 | | |

TABLE 32-continued

Transgenic plants exogenously expressing the polynucleotides of some embodiments of the invention exhibit improved growth rate under standard nitrogen conditions

| Gene Name | Event # | RGR Of Leaf Area | | | RGR Of Roots Coverage | | | RGR Of Roots Length | | |
|---|---|---|---|---|---|---|---|---|---|---|
| | | Ave. | p-value | % incr. | Ave. | p-value | % incr. | Ave. | p-value | % incr. |
| NUE587 | 9643.2 | 0.083 | 2.5E−06 | 97.54 | 0.439 | 3.8E−03 | 52.93 | 0.314 | 7.6E−01 | 4.01 |
| Control | | 0.042 | | | 0.287 | | | 0.302 | | |
| NUE593 | 10394 | 0.074 | 1.4E−01 | 33.10 | 0.465 | 9.0E−02 | 35.46 | 0.368 | 6.3E−02 | 31.07 |
| Control | | 0.056 | | | 0.344 | | | 0.281 | | |

Table 32: Analyses of plant growth rate (leaf area, root coverage and root length) of transgenic plants overexpressing the exogenous polynucleotides of some embodiments of the invention (using the cloned or synthetic genes listed in Table 23 above) under the regulation of a constitutive promoter (35S) when grown under standard nitrogen conditions [normal or regular growth conditions (15 mM N)]as compared to control plants.
"Incr." = increment;
"RGR" = relative growth rate;
"Ave." = average.

Example 6

Assay 2

Nitrogen Use Efficiency: Yield and Plant Growth Rate at Limited and Optimal Nitrogen Concentration Under Greenhouse Conditions This assay follows the seed yield production, biomass formation and rosette area growth of plants grown in the greenhouse at nitrogen deficient of nitrogen standard fertilization conditions. Seeds were sown in agar media supplemented with ½ MS medium and a selection agent (Kanamycin). The $T_2$ transgenic seedlings were then transplanted to 1.7 trays filled with peat and perlite. The trays were irrigated with a solution containing constant nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM $K_2SO_4$, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested separately to the above ground tissue, extracted and weight. Plant biomass (the above ground tissue) was also collected and dried for 1 week at 30° C.

Each construct was validated at its $T_2$ generation. Transgenic plants transformed with a construct conform by an empty vector carrying the 35S promoter and the selectable marker were used as controls.

The plants were analyzed for their overall size, growth rate, seed yield, 1,000-seed weight, dry matter and harvest index (HI—seed yield/dry matter). Transgenic plants performance was compared to control plants grown in parallel under the same conditions.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. During the capture process, the trays were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Growth Analysis—

Using the digital analysis leaves data was calculated, including leaf number, rosette area, rosette diameter, leaf blade area, plot coverage, leaf petiole length.

Vegetative Growth Rate: is the Rate of Growth of the Plant as Defined by Formulas VIII, Ix, X and XI Relative growth rate of leaf blade area=Regression coefficient of leaf area along time course.     Formula VIII Relative growth rate of rosette area=Regression coefficient of rosette area along time course.     Formula IX Relative growth rate of rosette diameter=Regression coefficient of rosette diameter along time course.     Formula X Relative growth rate of plot coverage=Regression coefficient of plot coverage along time course.     Formula XI Seeds Average Weight (Seed Weight or 1000 Seed Weight)—

At the end of the experiment all seeds were collected. The seeds were scattered on a glass tray and a picture was taken. Using the digital analysis, the number of seeds in each sample was calculated.

Plant Dry Weight and Seed Yield—

On about day 80 from sowing, the plants were harvested and left to dry at 30° C. in a drying chamber. The biomass and seed weight of each plot were measured and divided by the number of plants in each plot.

Dry weight=total weight of the vegetative portion above ground (excluding roots) after drying at 30° C. in a drying chamber;

Seed yield per plant=total seed weight per plant (grams).

The Harvest Index can be calculated using Formula III (as described above; Harvest Index=Average seed yield per plant/Average dry weight).

Statistical Analyses—

To identify genes conferring significantly improved nitrogen use efficiency and yield production, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experiment Results:

The genes presented in Tables 33, 34 and 35, hereinbelow, have improved plant NUE when grown at limiting nitrogen concentration levels. These genes produced higher seed yield, harvest index, seed weight (expressed as 1000–seed weight) and plant biomass [(as expressed as plant dry weight (DW)] when grown under limiting nitrogen growth conditions, compared to control.

Tables 33, 34 and 35 depict analyses of seed yield, harvest index, seed size (expressed as 1000–seed weight) when grown under limiting nitrogen conditions in plants overexpressing the polynucleotides of some embodiments of the invention under the regulation of a constitutive (35S). Evaluation of each gene was performed by testing the performance of several events. Some of the genes were evaluated in more than one tissue culture assay and the results obtained were repeated. Event with p-value<0.1 was considered statistically significant.

TABLE 33

Transgenic plants exogenously expressing the polynucleotides of some embodiments of the invention exhibit improved seed yield and weight (expressed as 1000-seed weight) under nitrogen deficient growth conditions.

| Gene Name | Event # | Seed Yield Ave. | p-value | % incr. | Gene Name | Event # | Seeds Weight Ave. | p-value | % incr. |
|---|---|---|---|---|---|---|---|---|---|
| NUE241 | 9631.6 | 0.169 | 1.3E−01 | 12.60 | NUE241 | 9632.3 | 0.020 | 2.5E−01 | 2.46 |
| NUE241 | 9631.4 | 0.150 | 9.7E−01 | 0.40 | NUE241 | 9631.4 | 0.020 | 6.4E−01 | 1.96 |
| Control | | 0.150 | | | Control | | 0.020 | | |
| NUE248 | 8982.3 | 0.144 | 3.6E−01 | 7.27 | NUE248 | 8982.4 | 0.023 | 4.1E−03 | 14.08 |
| Control | | 0.135 | | | NUE248 | 8982.3 | 0.021 | 4.3E−01 | 4.59 |
| NUE525 | 9534.1 | 0.161 | 6.7E−01 | 7.33 | NUE248 | 8981.1 | 0.021 | 7.2E−01 | 7.54 |
| NUE525 | 9531.3 | 0.169 | 5.6E−01 | 12.83 | NUE248 | 8983.1 | 0.021 | 7.3E−01 | 5.14 |
| NUE525 | 9533.4 | 0.162 | 7.0E−01 | 8.26 | Control | | 0.020 | | |
| NUE525 | 9531.1 | 0.166 | 1.0E−01 | 10.90 | NUE255 | 9431.4 | 0.021 | 1.0E−01 | 4.57 |
| Control | | 0.150 | | | Control | | 0.020 | | |
| NUE536 | 9234.1 | 0.157 | 6.1E−01 | 16.81 | NUE525 | 9533.1 | 0.022 | 2.1E−01 | 10.94 |
| Control | | 0.135 | | | NUE525 | 9531.3 | 0.020 | 7.6E−01 | 2.55 |
| NUE545 | 9482.4 | 0.184 | 1.7E−04 | 22.72 | Control | | 0.020 | | |
| Control | | 0.150 | | | NUE536 | 9234.1 | 0.020 | 6.0E−01 | 3.02 |
| NUE565 | 9443.4 | 0.204 | 1.8E−01 | 36.33 | NUE536 | 9231.3 | 0.021 | 5.3E−01 | 4.99 |
| Control | | 0.150 | | | Control | | 0.020 | | |
| NUE566 | 9514.3 | 0.163 | 1.6E−01 | 9.08 | NUE545 | 9482.4 | 0.020 | 7.1E−01 | 1.36 |
| NUE566 | 9514.1 | 0.172 | 7.0E−01 | 15.02 | Control | | 0.020 | | |
| Control | | 0.150 | | | NUE549 | 9343.6 | 0.023 | 2.7E−01 | 14.91 |
| NUE568 | 9471.3 | 0.160 | 1.8E−01 | 6.55 | NUE549 | 9342.3 | 0.021 | 5.1E−01 | 3.66 |
| Control | | 0.150 | | | Control | | 0.020 | | |
| NUE573 | 9493.4 | 0.172 | 3.8E−01 | 14.54 | NUE560 | 9424.1 | 0.023 | 1.3E−04 | 18.35 |
| NUE573 | 9491.2 | 0.181 | 3.3E−04 | 20.87 | NUE560 | 9424.3 | 0.021 | 8.0E−02 | 4.76 |
| NUE573 | 9492.2 | 0.155 | 8.9E−01 | 3.21 | NUE560 | 9422.1 | 0.020 | 3.1E−01 | 3.38 |
| Control | | 0.150 | | | Control | | 0.020 | | |
| NUE578 | 9524.1 | 0.147 | 9.3E−01 | −1.70 | NUE568 | 9461.2 | 0.024 | 1.3E−05 | 21.77 |
| Control | | 0.150 | | | Control | | 0.020 | | |
| NUE580 | 9552.3 | 0.180 | 1.9E−01 | 19.99 | NUE573 | 9491.2 | 0.023 | 1.1E−01 | 14.40 |
| Control | | 0.150 | | | NUE573 | 9492.2 | 0.021 | 3.6E−02 | 5.14 |
| NUE585 | 9661.1 | 0.150 | 1.8E−01 | 11.29 | Control | | 0.020 | | |
| Control | | 0.135 | | | NUE578 | 9524.1 | 0.022 | 8.2E−04 | 10.87 |
| | | | | | Control | | 0.020 | | |
| | | | | | NUE580 | 9551.3 | 0.025 | 7.2E−02 | 24.52 |
| | | | | | NUE580 | 9554.4 | 0.023 | 9.7E−02 | 14.78 |
| | | | | | Control | | 0.020 | | |
| | | | | | NUE585 | 9662.4 | 0.021 | 7.5E−02 | 6.26 |
| | | | | | NUE585 | 9661.1 | 0.022 | 5.2E−03 | 9.36 |
| | | | | | Control | | 0.020 | | |

Table 33: Analyses of seed yield and weight of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM $KNO_3$, 1 mM $KH_2PO_4$, 1 mM $MgSO_4$, 3.6 mM $K_2SO_4$, 2 mM $CaCl_2$ and microelements) as compared to control plants.
"Incr." = increment;
"Ave." = average.

TABLE 34

Transgenic plants exogenously expressing the polynucleotides of some embodiments of the invention exhibit improved harvest index under nitrogen deficient growth conditions.

| Gene Name | Event # | Harvest Index Average | p-value | % increment |
|---|---|---|---|---|
| NUE525 | 9534.1 | 0.321 | 1.9E-01 | 6.99 |
| NUE525 | 9533.1 | 0.319 | 7.0E-01 | 6.25 |
| NUE525 | 9533.4 | 0.322 | 4.8E-01 | 7.18 |
| NUE525 | 9531.1 | 0.356 | 3.5E-02 | 18.72 |
| Control | | 0.300 | | |
| NUE536 | 9234.1 | 0.344 | 6.9E-02 | 20.95 |
| NUE536 | 9231.3 | 0.298 | 3.7E-01 | 4.68 |
| Control | | 0.285 | | |
| NUE545 | 9482.4 | 0.328 | 2.0E-01 | 9.31 |
| Control | | 0.300 | | |
| NUE549 | 9341.1 | 0.337 | 2.9E-02 | 12.21 |
| NUE549 | 9342.3 | 0.322 | 6.8E-01 | 7.19 |
| Control | | 0.300 | | |
| NUE560 | 9424.3 | 0.316 | 9.5E-02 | 10.86 |
| NUE560 | 9422.1 | 0.318 | 8.2E-02 | 11.60 |
| Control | | 0.285 | | |
| NUE565 | 9443.4 | 0.335 | 3.9E-01 | 11.59 |
| Control | | 0.300 | | |
| NUE566 | 9514.1 | 0.351 | 5.8E-01 | 17.05 |
| Control | | 0.300 | | |

Table 34: Analyses of harvest index of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM $KNO_3$, 1 mM $KH_2PO_4$, 1 mM $MgSO_4$, 3.6 mM $K_2SO_4$, 2 mM $CaCl_2$ and microelements) as compared to control plants.

TABLE 35

Transgenic plants exogenously expressing the polynucleotides of some embodiments of the invention exhibit improved dry weight under nitrogen deficient growth conditions

| Gene Name | Event # | Dry Weight Average | p-value | % increment |
|---|---|---|---|---|
| NUE241 | 9631.6 | 0.569 | 5.2E-01 | 11.66 |
| NUE241 | 9632.3 | 0.613 | 8.0E-02 | 20.25 |
| Control | | 0.509 | | |
| NUE248 | 8982.3 | 0.534 | 2.9E-01 | 13.35 |
| Control | | 0.471 | | |
| NUE525 | 9531.3 | 0.600 | 4.3E-01 | 17.79 |
| Control | | 0.509 | | |
| NUE545 | 9482.4 | 0.561 | 2.9E-01 | 10.18 |
| Control | | 0.509 | | |
| NUE549 | 9342.2 | 0.541 | 7.3E-01 | 6.13 |
| Control | | 0.509 | | |
| NUE565 | 9444.1 | 0.589 | 6.5E-01 | 15.71 |
| NUE565 | 9443.4 | 0.609 | 3.4E-02 | 19.63 |
| Control | | 0.509 | | |
| NUE566 | 9514.3 | 0.637 | 5.2E-01 | 24.96 |
| Control | | 0.509 | | |
| NUE568 | 9471.3 | 0.515 | 8.9E-01 | 1.10 |
| NUE568 | 9462.3 | 0.639 | 1.4E-02 | 25.52 |
| Control | | 0.509 | | |
| NUE573 | 9493.4 | 0.581 | 2.9E-01 | 14.15 |
| NUE573 | 9491.2 | 0.613 | 3.4E-02 | 20.37 |
| NUE573 | 9492.2 | 0.683 | 4.2E-02 | 33.99 |
| Control | | 0.509 | | |
| NUE580 | 9552.3 | 0.561 | | 10.18 |
| NUE580 | 9551.3 | 0.634 | 2.4E-01 | 24.42 |
| NUE580 | 9554.4 | 0.526 | 7.0E-01 | 3.31 |
| Control | | 0.509 | | |
| NUE585 | 9661.1 | 0.519 | 4.6E-01 | 10.30 |
| Control | | 0.471 | | |

Table 35: Analyses of dry weight of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM $KNO_3$, 1 mM $KH_2PO_4$, 1 mM $MgSO_4$, 3.6 mM $K_2SO_4$, 2 mM $CaCl_2$ and microelements) as compared to control plants.

The genes presented in Tables 36 and 37, hereinbelow, have improved plant NUE since they produced higher seed yield, harvest index, seed weight (expressed as 1000-seed weight) and plant biomass [(as expressed as plant dry weight (DW)] when grown under standard nitrogen growth conditions, compared to control plants indicating the high ability of the plant to better metabolize the nitrogen present in the medium.

Tables 36 and 37 depict analyses of dry weight, seed yield, harvest index, seed size (expressed as 1000-seed weight) when grown under standard nitrogen conditions (6 mM $KNO_3$, 1 mM $KH_2PO_4$, 1 mM $MgSO_4$, 2 mM $CaCl_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 36

Transgenic plants exogenously expressing the polynucleotides of some embodiments of the invention exhibit improved plant biomass (dry weight) and seed yield under standard nitrogen conditions

| | | Dry Weight | | | | | | Seed Yield | | |
|---|---|---|---|---|---|---|---|---|---|---|
| Gene Name | Event # | Ave. | P-Value | % incr. | Gene Name | Event # | Ave. | P-Value | % incr. |
| NUE255 | 9431.4 | 1.394 | 5.6E-01 | 14.344 | NUE234 | 9162.5 | 0.523 | 1.0E-01 | 16.207 |
| NUE255 | 9432.1 | 1.499 | 5.9E-02 | 22.894 | Control | | 0.450 | | |
| NUE255 | 9433.1 | 1.409 | 1.0E-01 | 15.530 | NUE241 | 9631.4 | 0.364 | 3.0E-01 | -12.185 |
| Control | | 1.219 | | | Control | | 0.414 | | |
| NUE525 | 9531.1 | 1.635 | 6.1E-03 | 34.085 | NUE255 | 9431.4 | 0.436 | 7.4E-01 | 5.346 |
| Control | | 1.219 | | | NUE255 | 9432.1 | 0.483 | 3.5E-01 | 16.593 |
| NUE545 | 9484.2 | 1.246 | 7.0E-01 | 2.204 | NUE255 | 9433.1 | 0.444 | 1.0E-01 | 7.100 |
| NUE545 | 9481.3 | 1.631 | 3.4E-04 | 33.726 | Control | | 0.414 | | |
| Control | | 1.219 | | | NUE525 | 9534.1 | 0.486 | 2.6E-03 | 17.328 |
| NUE549 | 9341.1 | 1.381 | 6.7E-02 | 13.275 | NUE525 | 9531.1 | 0.504 | 4.0E-01 | 21.719 |
| NUE549 | 9342.3 | 1.310 | 2.7E-01 | 7.432 | Control | | 0.414 | | |

TABLE 36-continued

Transgenic plants exogenously expressing the polynucleotides of some embodiments of the invention exhibit improved plant biomass (dry weight) and seed yield under standard nitrogen conditions

| | | Dry Weight | | | | | Seed Yield | | |
|---|---|---|---|---|---|---|---|---|---|
| Gene Name | Event # | Ave. | P-Value | % incr. | Gene Name | Event # | Ave. | P-Value | % incr. |
| Control | | 1.219 | | | NUE549 | 9341.1 | 0.447 | 6.4E−01 | 8.031 |
| NUE563 | 9451.1 | 1.303 | 5.6E−01 | 6.868 | Control | | 0.414 | | |
| NUE563 | 9452.3 | 1.473 | 1.6E−02 | 20.788 | NUE563 | 9451.1 | 0.419 | 8.6E−01 | 1.237 |
| Control | | 1.219 | | | NUE563 | 9452.3 | 0.454 | 6.5E−01 | 9.572 |
| NUE565 | 9443.2 | 1.348 | 9.3E−02 | 10.507 | Control | | 0.414 | | |
| NUE565 | 9444.3 | 1.376 | 4.7E−01 | 12.814 | NUE566 | 9512.4 | 0.458 | 1.8E−01 | 10.657 |
| Control | | 1.219 | | | Control | | 0.414 | | |
| NUE566 | 9512.4 | 1.471 | 5.8E−03 | 20.605 | NUE568 | 9464.2 | 0.429 | 8.6E−01 | 3.674 |
| Control | | 1.219 | | | NUE568 | 9462.3 | 0.423 | 7.7E−01 | 2.233 |
| NUE568 | 9461.2 | 1.571 | 8.6E−04 | 28.806 | Control | | 0.414 | | |
| NUE568 | 9464.2 | 1.366 | 4.9E−01 | 11.994 | NUE573 | 9491.4 | 0.455 | 5.1E−01 | 9.769 |
| NUE568 | 9462.3 | 1.288 | 3.8E−01 | 5.638 | NUE573 | 9492.1 | 0.486 | 4.5E−01 | 17.465 |
| Control | | 1.219 | | | NUE573 | 9493.4 | 0.449 | 7.5E−01 | 8.482 |
| NUE573 | 9491.4 | 1.249 | 8.9E−01 | 2.460 | Control | | 0.414 | | |
| NUE573 | 9492.1 | 1.668 | 1.3E−01 | 36.802 | NUE582 | 9561.2 | 0.452 | 4.7E−01 | 9.239 |
| NUE573 | 9493.4 | 1.478 | 7.2E−02 | 21.213 | Control | | 0.414 | | |
| NUE573 | 9491.2 | 1.407 | 1.0E−01 | 15.377 | | | | | |
| Control | | 1.219 | | | | | | | |

Table 36: Analyses of plant biomass (dry weight) and see yield of transgenic plants overexpressing the exogenous polynucleotides of some embodiments of the invention (using the cloned or synthetic genes listed in Table 23 above) under the regulation of a constitutive promoter (35S) when grown under standard nitrogen conditions (6 mM $KNO_3$, 1 mM $KH_2PO_4$, 1 mM $MgSO_4$, 2 mM $CaCl_2$ and microelements) as compared to control plants.
"Incr." = increment;
"RGR" = relative growth rate;
"Ave." = average.

TABLE 37

Transgenic plants exogenously expressing the polynucleotides of some embodiments of the invention exhibit improved harvest index and seed weight under standard nitrogen conditions

| Gene | | Harvest Index | | | Gene | | Seed Weight | | |
|---|---|---|---|---|---|---|---|---|---|
| Name | Event # | Ave. | P-Value | % incr. | Name | Event # | Ave. | P-Value | % incr. |
| NUE234 | 9162.5 | 0.368 | 3.7E−02 | 15.734 | NUE241 | 9631.4 | 0.022 | 3.3E−02 | 6.274 |
| Control | | 0.318 | | | Control | | 0.021 | | |
| NUE525 | 9534.1 | 0.477 | 4.5E−01 | 38.546 | NUE255 | 9432.1 | 0.023 | 2.5E−02 | 11.793 |
| Control | | 0.344 | | | NUE255 | 9433.1 | 0.021 | 6.6E−02 | 4.087 |
| NUE573 | 9491.4 | 0.366 | 3.7E−01 | 6.179 | Control | | 0.021 | | |
| Control | | 0.344 | | | NUE525 | 9534.1 | 0.021 | 1.0E+00 | 0.008 |
| NUE582 | 9561.2 | 0.466 | 2.2E−01 | 35.384 | NUE525 | 9531.1 | 0.025 | 3.6E−01 | 22.277 |
| Control | | 0.344 | | | Control | | 0.021 | | |
| | | | | | NUE545 | 9481.3 | 0.024 | 3.0E−01 | 17.664 |
| | | | | | Control | | 0.021 | | |
| | | | | | NUE549 | 9341.1 | 0.022 | 5.8E−01 | 9.152 |
| | | | | | NUE549 | 9342.3 | 0.023 | 5.6E−01 | 11.416 |
| | | | | | Control | | 0.021 | | |
| | | | | | NUE563 | 9451.1 | 0.023 | 1.1E−01 | 10.668 |
| | | | | | NUE563 | 9452.3 | 0.022 | 3.5E−01 | 5.095 |
| | | | | | Control | | 0.021 | | |
| | | | | | NUE565 | 9443.2 | 0.024 | 2.0E−01 | 15.540 |
| | | | | | NUE565 | 9444.3 | 0.021 | 9.1E−01 | 1.159 |
| | | | | | Control | | 0.021 | | |
| | | | | | NUE566 | 9512.4 | 0.022 | 8.6E−02 | 5.164 |
| | | | | | Control | | 0.021 | | |
| | | | | | NUE568 | 9461.2 | 0.024 | 3.0E−01 | 19.048 |
| | | | | | NUE568 | 9464.2 | 0.022 | 6.1E−01 | 8.243 |
| | | | | | NUE568 | 9462.3 | 0.023 | 6.1E−04 | 10.961 |
| | | | | | Control | | 0.021 | | |
| | | | | | NUE573 | 9491.4 | 0.021 | 7.1E−01 | 1.229 |
| | | | | | NUE573 | 9492.1 | 0.021 | 1.8E−01 | 3.164 |
| | | | | | NUE573 | 9493.4 | 0.022 | 1.9E−01 | 8.883 |
| | | | | | NUE573 | 9491.2 | 0.023 | 4.0E−01 | 14.335 |
| | | | | | Control | | 0.021 | | |

TABLE 37-continued

Transgenic plants exogenously expressing the polynucleotides of some embodiments of the invention exhibit improved harvest index and seed weight under standard nitrogen conditions

| Gene Name | Event # | Harvest Index Ave. | P-Value | % incr. | Gene Name | Event # | Seed Weight Ave. | P-Value | % incr. |
|---|---|---|---|---|---|---|---|---|---|
| | | | | | NUE582 | 9561.2 | 0.024 | 1.6E−03 | 15.172 |
| | | | | | Control | | 0.021 | | |

Table 37: Analyses of harvest index and seed weight of transgenic plants overexpressing the exogenous polynucleotides of some embodiments of the invention (using the cloned or synthetic genes listed in Table 23 above) under the regulation of a constitutive promoter (35S) when grown under standard nitrogen conditions (6 mM KNO$_3$, 1 mM KH$_2$PO$_4$, 1 mM MgSO$_4$, 2 mM CaCl$_2$ and microelements) as compared to control plants.
"Incr." = increment;
"RGR" = relative growth rate;
"Ave." = average.

Improvement of rosette area as well as rosette growth rate supports the fact that plants can produce larger plant biomass by better exploiting the nitrogen available in the soil. In addition a production of a larger number of leaves as well as a higher plot coverage when grown at low nitrogen conditions indicate a larger photosynthetic capacity of the plant when grown at different nitrogen growth conditions The genes presented in Tables 38 and 39, hereinbelow, have improved plant NUE and produced larger plant biomass when grown under limiting nitrogen growth conditions, compared to control plants. In addition a production of a larger number of leaves as well as a higher plot coverage when grown at low nitrogen conditions indicate a larger photosynthetic capacity of the plant when grown at low nitrogen growth conditions Tables 38 and 39 depict analyses of rosette area and leaf number (rosette diameter, rosette area, leaf number, leaf blade area and plot coverage) when grown under limiting nitrogen conditions (1.5 mM KNO$_3$, 1 mM KH$_2$PO$_4$, 1 mM MgSO$_4$, 3.6 mM K$_2$SO$_4$, 2 mM CaCl$_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 38

Transgenic plants exogenously expressing the polynucleotides of some embodiments of the invention exhibit improved rosette growth performance (rosette diameter and area and plot coverage) under nitrogen deficient conditions

| Gene Name | Event # | Rosette Diameter [cm] | | | Rosette Area [cm$^2$] | | | Plot Coverage [%] | | |
|---|---|---|---|---|---|---|---|---|---|---|
| | | Ave. | p-value | % incr. | Ave. | p-value | % incr. | Ave. | p-value | % incr. |
| NUE234 | 9163.4 | 2.26 | 1.6E−01 | 8.49 | 1.634 | 2.7E−01 | 7.24 | 13.07 | 2.7E−01 | 7.24 |
| Control | | 2.08 | | | 1.523 | | | 12.19 | | |
| NUE241 | 9632.3 | 1.72 | 4.1E−01 | 20.77 | 1.008 | 5.3E−01 | 42.18 | 8.06 | 5.3E−01 | 42.18 |
| NUE241 | 9631.4 | 1.57 | 6.4E−02 | 10.20 | 0.886 | 1.7E−03 | 24.97 | 7.09 | 1.7E−03 | 24.97 |
| Control | | 1.42 | | | 0.709 | | | 5.67 | | |
| NUE249 | 9122.2 | 2.20 | 2.3E−01 | 5.86 | 1.696 | 2.6E−01 | 11.33 | 13.57 | 2.6E−01 | 11.33 |
| Control | | 2.08 | | | 1.523 | | | 12.19 | | |
| NUE525 | 9534.1 | 1.84 | 9.3E−02 | 29.75 | 1.255 | 6.6E−02 | 77.06 | 9.45 | 1.9E−01 | 66.71 |
| NUE525 | 9531.2 | 1.83 | 2.1E−02 | 29.02 | 1.191 | 8.3E−02 | 68.09 | 8.98 | 2.2E−01 | 58.33 |
| NUE525 | 9533.1 | 1.74 | 7.1E−02 | 22.38 | 1.060 | 1.4E−01 | 49.54 | 8.48 | 1.4E−01 | 49.54 |
| NUE525 | 9531.3 | 1.58 | 4.3E−01 | 11.39 | 0.884 | 5.3E−01 | 24.70 | 7.07 | 5.3E−01 | 24.70 |
| NUE525 | 9533.4 | 1.71 | 1.5E−03 | 20.13 | 1.048 | 1.5E−04 | 47.84 | 8.38 | 1.5E−04 | 47.84 |
| NUE525 | 9531.1 | 1.62 | 8.0E−02 | 13.70 | 1.025 | 2.8E−02 | 44.64 | 8.20 | 2.8E−02 | 44.64 |
| Control | | 1.42 | | | 0.709 | | | 5.67 | | |
| NUE536 | 9234.1 | 2.29 | 2.1E−02 | 9.74 | 1.734 | 3.2E−01 | 13.79 | 13.87 | 3.2E−01 | 13.79 |
| Control | | 2.08 | | | 1.523 | | | 12.19 | | |
| NUE545 | 9484.2 | 1.97 | 1.5E−07 | 38.83 | 1.311 | 4.1E−08 | 84.91 | 10.49 | 4.1E−08 | 84.91 |
| NUE545 | 9482.4 | 1.71 | 2.1E−01 | 19.99 | 0.999 | 2.1E−01 | 40.87 | 7.99 | 2.1E−01 | 40.87 |
| NUE545 | 9481.3 | 1.79 | 4.6E−01 | 26.22 | 1.025 | 4.9E−01 | 44.66 | 8.20 | 4.9E−01 | 44.66 |
| NUE545 | 9484.4 | 2.01 | 1.6E−07 | 41.45 | 1.265 | 2.1E−05 | 78.42 | 10.12 | 2.1E−05 | 78.42 |
| Control | | 1.42 | | | 0.709 | | | 5.67 | | |
| NUE549 | 9341.1 | 1.61 | | 13.18 | 0.956 | 2.2E−01 | 34.91 | 7.65 | 2.2E−01 | 34.91 |
| Control | | 1.42 | | | 0.709 | | | 5.67 | | |
| NUE563 | 9454.1 | 1.61 | 1.6E−01 | 13.12 | 0.930 | 1.0E−01 | 31.25 | 7.44 | 1.0E−01 | 31.25 |
| NUE563 | 9452.3 | 1.56 | 4.6E−01 | 10.02 | 0.828 | 5.7E−01 | 16.76 | 6.62 | 5.7E−01 | 16.76 |
| NUE563 | 9453.4 | 1.72 | 1.7E−01 | 21.08 | 1.077 | 1.9E−01 | 51.96 | 8.62 | 1.9E−01 | 51.96 |
| NUE563 | 9452.1 | 1.48 | 7.5E−02 | 4.31 | 0.720 | 8.4E−01 | 1.64 | 5.76 | 8.4E−01 | 1.64 |
| Control | | 1.42 | | | 0.709 | | | 5.67 | | |
| NUE565 | 9444.1 | 1.72 | 3.1E−01 | 20.73 | 0.889 | 2.7E−01 | 25.43 | 7.11 | 2.7E−01 | 25.43 |
| NUE565 | 9442.4 | 1.63 | 8.5E−04 | 14.54 | 0.839 | 9.5E−02 | 18.42 | 6.72 | 9.5E−02 | 18.42 |
| Control | | 1.42 | | | 0.709 | | | 5.67 | | |
| NUE566 | 9514.3 | 1.75 | 2.1E−01 | 22.85 | 1.113 | 2.3E−01 | 56.97 | 8.27 | 1.2E−01 | 45.76 |
| NUE566 | 9513.1 | 1.63 | 3.0E−01 | 14.74 | 0.915 | 2.3E−01 | 29.04 | 7.32 | 2.3E−01 | 29.04 |

TABLE 38-continued

Transgenic plants exogenously expressing the polynucleotides of some embodiments of the invention exhibit improved rosette growth performance (rosette diameter and area and plot coverage) under nitrogen deficient conditions

| Gene Name | Event # | Rosette Diameter [cm] Ave. | p-value | % incr. | Rosette Area [cm$^2$] Ave. | p-value | % incr. | Plot Coverage [%] Ave. | p-value | % incr. |
|---|---|---|---|---|---|---|---|---|---|---|
| NUE566 | 9512.4 | 1.58 | 5.0E−01 | 11.26 | 0.927 | 4.3E−01 | 30.79 | 7.42 | 4.3E−01 | 30.79 |
| NUE566 | 9514.1 | 1.72 | 6.9E−02 | 21.08 | 1.061 | 2.3E−01 | 49.66 | 8.02 | 3.7E−01 | 41.52 |
| Control | | 1.42 | | | 0.709 | | | 5.67 | | |
| NUE568 | 9474.4 | 1.66 | 2.3E−01 | 16.75 | 0.937 | 2.9E−02 | 32.20 | 7.50 | 2.9E−02 | 32.20 |
| NUE568 | 9461.2 | 1.79 | 2.1E−01 | 26.22 | 1.216 | 1.6E−01 | 71.50 | 9.72 | 1.6E−01 | 71.50 |
| NUE568 | 9462.1 | 1.76 | 3.3E−01 | 23.46 | 1.072 | 2.7E−01 | 51.17 | 8.57 | 2.7E−01 | 51.17 |
| NUE568 | 9462.3 | 1.69 | 5.8E−02 | 19.20 | 1.005 | 1.8E−01 | 41.72 | 8.04 | 1.8E−01 | 41.72 |
| NUE568 | 9463.4 | 1.78 | 2.3E−01 | 25.46 | 1.018 | 3.6E−01 | 43.57 | 8.14 | 3.6E−01 | 43.57 |
| NUE568 | 9473.3 | 1.52 | 3.4E−01 | 6.95 | 0.826 | 1.9E−01 | 16.55 | 6.61 | 1.9E−01 | 16.55 |
| Control | | 1.42 | | | 0.709 | | | 5.67 | | |
| NUE573 | 9491.4 | 1.72 | 2.1E−01 | 21.02 | 1.007 | 2.4E−01 | 42.03 | 8.05 | 2.4E−01 | 42.03 |
| NUE573 | 9492.1 | 2.01 | 1.1E−05 | 41.63 | 1.404 | 4.1E−03 | 98.05 | 11.23 | 4.1E−03 | 98.05 |
| NUE573 | 9493.4 | 1.77 | 4.9E−06 | 24.30 | 1.106 | 3.3E−04 | 56.00 | 8.31 | 1.5E−01 | 46.46 |
| NUE573 | 9494.3 | 1.82 | 1.4E−06 | 27.69 | 1.177 | 6.2E−03 | 66.10 | 9.42 | 6.2E−03 | 66.10 |
| NUE573 | 9491.2 | 1.79 | 1.2E−01 | 26.17 | 1.115 | 1.8E−01 | 57.32 | 8.92 | 1.8E−01 | 57.32 |
| NUE573 | 9492.2 | 1.75 | 1.2E−01 | 22.83 | 1.016 | 1.5E−01 | 43.40 | 8.13 | 1.5E−01 | 43.40 |
| Control | | 1.42 | | | 0.709 | | | 5.67 | | |
| NUE575 | 9501.4 | 2.04 | 1.4E−02 | 43.55 | 1.338 | 8.7E−08 | 88.73 | 10.70 | 8.7E−08 | 88.73 |
| NUE575 | 9504.1 | 1.93 | 1.8E−01 | 35.73 | 1.259 | 2.5E−01 | 77.60 | 10.07 | 2.5E−01 | 77.60 |
| NUE575 | 9503.1 | 1.84 | 2.2E−01 | 29.22 | 1.282 | 2.0E−01 | 80.88 | 10.26 | 2.0E−01 | 80.88 |
| NUE575 | 9502.1 | 1.73 | 2.7E−01 | 21.38 | 1.097 | 2.1E−01 | 54.82 | 8.78 | 2.1E−01 | 54.82 |
| Control | | 1.42 | | | 0.709 | | | 5.67 | | |
| NUE578 | 9524.3 | 1.92 | 6.1E−02 | 34.78 | 1.274 | 4.5E−02 | 79.68 | 10.19 | 4.5E−02 | 79.68 |
| NUE578 | 9524.1 | 2.13 | 1.5E−01 | 49.88 | 1.602 | 1.4E−01 | 126.00 | 12.12 | 2.2E−01 | #### |
| NUE578 | 9523.3 | 1.97 | 1.9E−02 | 38.35 | 1.400 | 4.0E−02 | 97.45 | 11.20 | 4.0E−02 | 97.45 |
| NUE578 | 9522.3 | 1.75 | 4.8E−04 | 22.83 | 1.095 | 6.4E−05 | 54.54 | 8.76 | 6.4E−05 | 54.54 |
| Control | | 1.42 | | | 0.709 | | | 5.67 | | |
| NUE580 | 9552.3 | 1.52 | 1.2E−01 | 6.68 | 0.783 | 3.5E−02 | 10.46 | 6.26 | 3.5E−02 | 10.46 |
| NUE580 | 9551.3 | 1.71 | 1.7E−01 | 19.93 | 1.049 | 2.0E−01 | 48.02 | 8.39 | 2.0E−01 | 48.02 |
| NUE580 | 9553.4 | 1.73 | 1.1E−05 | 21.63 | 1.058 | 5.1E−06 | 49.24 | 8.46 | 5.1E−06 | 49.24 |
| NUE580 | 9551.4 | 1.85 | 6.7E−02 | 30.17 | 1.284 | 6.8E−02 | 81.21 | 10.28 | 6.8E−02 | 81.21 |
| NUE580 | 9554.4 | 1.70 | 2.7E−01 | 19.55 | 1.084 | 2.8E−01 | 52.96 | 8.67 | 2.8E−01 | 52.96 |
| Control | | 1.42 | | | 0.709 | | | 5.67 | | |
| NUE582 | 9561.1 | 1.73 | 3.0E−01 | 21.81 | 1.026 | 3.3E−01 | 44.69 | 7.60 | 2.5E−01 | 34.04 |
| NUE582 | 9562.1 | 1.60 | 3.4E−01 | 12.36 | 0.985 | 2.2E−01 | 38.99 | 7.88 | 2.2E−01 | 38.99 |
| NUE582 | 9562.4 | 1.58 | 4.7E−01 | 11.39 | 0.920 | 4.7E−01 | 29.79 | 7.00 | 6.1E−01 | 23.36 |
| NUE582 | 9563.3 | 1.76 | 2.1E−01 | 23.73 | 1.071 | 1.4E−01 | 51.05 | 8.57 | 1.4E−01 | 51.05 |
| NUE582 | 9561.2 | 1.92 | 6.2E−02 | 34.91 | 1.328 | 9.8E−02 | 87.34 | 10.02 | 2.1E−01 | 76.63 |
| Control | | 1.42 | | | 0.709 | | | 5.67 | | |

Table 38: Analyses of rosette diameter and area and plot coverage of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM KNO$_3$, 1 mM KH$_2$PO$_4$, 1 mM MgSO$_4$, 3.6 mM K$_2$SO$_4$, 2 mM CaCl$_2$ and microelements) as compared to control plants.
"Incr." = increment;
"Ave." = average.

TABLE 39

Transgenic plants exogenously expressing the polynucleotides of some embodiments of the invention exhibit improved rosette growth performance (leaf number and leaf blade) under nitrogen deficient conditions

| Gene Name | Event # | Leaf Number Ave. | p-value | % incr. | Leaf Blade Area [cm$^2$] Ave. | p-value | % incr. |
|---|---|---|---|---|---|---|---|
| NUE241 | 9632.3 | 8.0 | 6.4E−01 | 7.34 | 0.174 | 5.3E−01 | 30.98 |
| NUE241 | 9631.4 | 8.3 | 1.6E−01 | 10.69 | 0.156 | 2.8E−02 | 17.43 |
| Control | | 7.5 | | | 0.133 | | |
| NUE249 | 9122.2 | 9.8 | 1.1E−01 | 4.20 | 0.266 | 4.7E−02 | 12.23 |
| Control | | 9.4 | | | 0.237 | | |
| NUE525 | 9534.1 | 8.8 | 5.9E−02 | 17.88 | 0.199 | 1.6E−01 | 49.90 |
| NUE525 | 9531.2 | 8.9 | 3.6E−05 | 19.80 | 0.181 | 4.1E−02 | 36.68 |
| NUE525 | 9533.1 | 7.8 | 1.9E−02 | 4.82 | 0.175 | 3.3E−01 | 31.80 |
| NUE525 | 9531.3 | 7.6 | 8.6E−01 | 2.31 | 0.149 | 6.4E−01 | 12.26 |
| NUE525 | 9533.4 | 8.3 | 8.0E−02 | 11.53 | 0.176 | 2.0E−02 | 32.40 |
| NUE525 | 9531.1 | 8.4 | 3.0E−05 | 12.37 | 0.161 | 3.4E−03 | 21.39 |
| Control | | 7.5 | | | 0.133 | | |
| NUE536 | 9234.1 | 9.4 | 9.7E−01 | 0.19 | 0.266 | 3.0E−01 | 12.00 |
| Control | | 9.4 | | | 0.237 | | |
| NUE545 | 9484.2 | 8.7 | 4.6E−02 | 16.56 | 0.216 | 2.8E−03 | 62.69 |
| NUE545 | 9482.4 | 8.0 | 4.7E−01 | 7.34 | 0.174 | 1.6E−01 | 31.20 |
| NUE545 | 9481.3 | 7.8 | 7.2E−01 | 3.98 | 0.188 | 4.7E−01 | 41.85 |
| NUE545 | 9484.4 | 8.3 | 1.6E−01 | 10.69 | 0.207 | 2.6E−07 | 56.09 |
| Control | | 7.5 | | | 0.133 | | |
| NUE549 | 9341.1 | 7.9 | 6.7E−01 | 5.66 | 0.160 | 8.3E−02 | 20.34 |
| Control | | 7.5 | | | 0.133 | | |
| NUE563 | 9454.1 | 8.3 | 1.6E−01 | 10.69 | 0.154 | 1.7E−01 | 16.19 |
| NUE563 | 9452.3 | 7.4 | 9.8E−01 | −0.21 | 0.150 | 6.1E−01 | 13.28 |
| NUE563 | 9453.4 | 8.1 | 1.9E−01 | 9.01 | 0.181 | 2.2E−01 | 36.86 |

TABLE 39-continued

Transgenic plants exogenously expressing the polynucleotides of some embodiments of the invention exhibit improved rosette growth performance (leaf number and leaf blade) under nitrogen deficient conditions

| Gene Name | Event # | Leaf Number Ave. | p-value | % incr. | Leaf Blade Area [cm$^2$] Ave. | p-value | % incr. |
|---|---|---|---|---|---|---|---|
| NUE563 | 9452.1 | | | | 0.141 | 4.4E−01 | 6.33 |
| Control | | 7.5 | | | 0.133 | | |
| NUE565 | 9444.1 | 7.7 | 8.6E−02 | 3.14 | 0.162 | 2.2E−01 | 21.85 |
| NUE565 | 9442.4 | 7.8 | 1.9E−02 | 4.82 | 0.148 | 1.4E−01 | 11.60 |
| Control | | 7.5 | | | 0.133 | | |
| NUE566 | 9514.3 | 7.8 | 4.5E−01 | 4.94 | 0.188 | 5.6E−02 | 41.70 |
| NUE566 | 9513.1 | 7.8 | 1.8E−01 | 3.98 | 0.162 | 3.2E−01 | 22.40 |
| NUE566 | 9512.4 | 8.1 | 5.4E−01 | 8.18 | 0.170 | 3.9E−01 | 28.31 |
| NUE566 | 9514.1 | 8.0 | 4.2E−01 | 7.82 | 0.180 | 1.9E−01 | 35.77 |
| Control | | 7.5 | | | 0.133 | | |
| NUE568 | 9474.4 | 7.9 | 3.1E−01 | 5.66 | 0.175 | 4.2E−02 | 31.80 |
| NUE568 | 9461.2 | 8.6 | 9.9E−03 | 15.72 | 0.195 | 9.6E−02 | 47.20 |
| NUE568 | 9462.4 | 8.1 | 1.3E−01 | 8.18 | 0.193 | 3.2E−02 | 45.51 |
| NUE568 | 9462.3 | 7.8 | 5.7E−01 | 3.98 | 0.176 | 5.3E−02 | 32.52 |
| NUE568 | 9463.4 | 7.6 | 6.1E−01 | 2.31 | 0.185 | 3.7E−01 | 39.91 |
| NUE568 | 9473.3 | 7.9 | 4.6E−01 | 6.50 | 0.148 | 1.8E−01 | 11.71 |
| Control | | 7.5 | | | 0.133 | | |
| NUE573 | 9491.4 | 7.9 | 6.7E−01 | 5.66 | 0.168 | 2.6E−01 | 27.07 |
| NUE573 | 9492.1 | 9.1 | 6.1E−02 | 22.43 | 0.234 | 3.8E−02 | 76.54 |
| NUE573 | 9493.4 | 8.0 | 3.1E−01 | 7.94 | 0.193 | 9.4E−07 | 45.94 |
| NUE573 | 9494.3 | 8.1 | 3.6E−02 | 9.01 | 0.193 | 1.3E−05 | 45.95 |
| NUE573 | 9491.2 | 8.7 | 2.0E−01 | 16.56 | 0.181 | 2.2E−01 | 36.33 |
| NUE573 | 9492.2 | 7.6 | 6.7E−01 | 1.47 | 0.183 | 5.8E−02 | 38.25 |
| Control | | 7.5 | | | 0.133 | | |
| NUE575 | 9501.4 | 8.5 | 1.1E−01 | 14.05 | 0.216 | 1.9E−02 | 62.82 |
| NUE575 | 9504.1 | 8.5 | 2.0E−01 | 14.05 | 0.214 | 2.2E−01 | 61.54 |
| NUE575 | 9503.1 | 8.4 | 3.8E−01 | 13.21 | 0.207 | 2.1E−01 | 55.92 |
| NUE575 | 9502.1 | 8.4 | 2.5E−01 | 13.21 | 0.182 | 2.6E−01 | 37.35 |
| Control | | 7.5 | | | 0.133 | | |
| NUE578 | 9524.3 | 8.4 | 2.3E−01 | 12.37 | 0.208 | 1.5E−07 | 57.07 |
| NUE578 | 9524.1 | 9.1 | 1.3E−01 | 22.19 | 0.242 | 1.6E−01 | 82.58 |
| NUE578 | 9523.3 | 8.8 | 3.1E−06 | 17.40 | 0.223 | 7.2E−02 | 68.19 |
| NUE578 | 9522.3 | 8.4 | 2.3E−01 | 12.37 | 0.178 | 2.4E−04 | 34.51 |
| Control | | 7.5 | | | 0.133 | | |
| NUE580 | 9552.3 | 8.1 | 1.6E−03 | 8.18 | 0.135 | 6.4E−01 | 1.85 |
| NUE580 | 9551.3 | 8.5 | 1.3E−05 | 14.05 | 0.175 | 2.4E−01 | 31.72 |
| NUE580 | 9553.4 | 7.9 | 1.8E−01 | 6.50 | 0.185 | 1.4E−01 | 39.73 |
| NUE580 | 9551.4 | 8.5 | 2.0E−01 | 14.05 | 0.202 | 2.0E−05 | 52.26 |
| NUE580 | 9554.4 | 7.9 | 9.4E−02 | 5.66 | 0.183 | 3.4E−01 | 38.26 |
| Control | | 7.5 | | | 0.133 | | |
| NUE582 | 9561.1 | 8.3 | 2.8E−01 | 11.29 | 0.171 | 3.9E−01 | 28.94 |
| NUE582 | 9562.1 | 8.1 | 1.9E−01 | 9.01 | 0.168 | 3.4E−01 | 26.84 |
| NUE582 | 9562.4 | 7.7 | 5.3E−01 | 2.67 | 0.164 | 5.0E−01 | 24.06 |
| NUE582 | 9563.3 | 8.4 | 1.0E−04 | 13.21 | 0.186 | 1.5E−01 | 40.09 |
| NUE582 | 9561.2 | 8.7 | 7.5E−02 | 16.08 | 0.217 | 1.5E−01 | 63.53 |
| Control | | 7.5 | | | 0.133 | | |

Table 39: Analyses of leaf number and leaf blade of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM KNO$_3$, 1 mM KH$_2$PO$_4$, 1 mM MgSO$_4$, 3.6 mM K$_2$SO$_4$, 2 mM CaCl$_2$ and microelements) as compared to control plants.
"Incr." = increment;
"Ave." = average.

The genes presented in Tables 40 and 41, hereinbelow, have improved plant growth rate when grown at limiting nitrogen fertilization levels. These genes improved the growth rate of the rosette and faster covered the soil when grown at limiting nitrogen growth conditions.

Tables 40 and 41 depict analyses of the growth rate of the rosette diameter, rosette area, leaf blade area, leaf number and plot coverage when grown under limiting nitrogen conditions (1.5 mM KNO$_3$, 1 mM KH$_2$PO$_4$, 1 mM MgSO$_4$, 3.6 mM K$_2$SO$_4$, 2 mM CaCl$_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 40

Transgenic plants exogenously expressing the polynucleotides of some embodiments of the invention exhibit improved growth rate (RGR of leaf blade area and RGR of leaf number) under nitrogen deficient conditions

| Gene Name | Event # | RGR Of Leaf Blade Area Average | p-value | % increment | RGR Of Leaf Number Average | p-value | % increment |
|---|---|---|---|---|---|---|---|
| NUE241 | 9633.4 | 0.016 | 8.8E−01 | 1.45 | 0.567 | 0.330 | 13.34 |
| NUE241 | 9632.3 | 0.021 | 4.2E−02 | 30.38 | 0.548 | 0.538 | 9.72 |
| NUE241 | 9631.4 | 0.019 | 6.1E−02 | 17.16 | 0.536 | 0.579 | 7.27 |
| Control | | 0.016 | | | 0.500 | | |
| NUE525 | 9534.1 | 0.023 | 6.7E−05 | 43.97 | 0.612 | 0.105 | 22.43 |
| NUE525 | 9531.2 | 0.020 | 6.2E−03 | 25.68 | 0.661 | 0.016 | 32.14 |
| NUE525 | 9533.1 | 0.020 | 2.0E−02 | 25.03 | 0.503 | 0.954 | 0.71 |
| NUE525 | 9531.3 | 0.017 | 7.1E−01 | 3.98 | 0.508 | 0.918 | 1.54 |
| NUE525 | 9533.4 | 0.020 | 1.4E−02 | 22.12 | 0.560 | 0.372 | 11.94 |
| NUE525 | 9531.1 | 0.018 | 1.3E−01 | 13.01 | 0.557 | 0.392 | 11.36 |
| Control | | 0.016 | | | 0.500 | | |
| NUE545 | 9484.2 | 0.026 | 1.1E−07 | 60.54 | | | |
| NUE545 | 9482.4 | 0.021 | 6.0E−03 | 28.52 | | | |
| NUE545 | 9482.2 | 0.018 | | 9.81 | | | |
| NUE545 | 9481.3 | 0.022 | 2.1E−02 | 39.32 | | | |
| NUE545 | 9484.4 | 0.025 | 1.3E−06 | 54.25 | | | |
| Control | | 0.016 | | | | | |
| NUE549 | 9341.1 | 0.018 | 1.6E−01 | 12.49 | | | |
| Control | | 0.016 | | | | | |
| NUE563 | 9454.1 | 0.018 | 1.4E−01 | 13.13 | 0.544 | 0.509 | 8.79 |

TABLE 40-continued

Transgenic plants exogenously expressing the polynucleotides of some embodiments of the invention exhibit improved growth rate (RGR of leaf blade area and RGR of leaf number) under nitrogen deficient conditions

| Gene Name | Event # | RGR Of Leaf Blade Area | | | RGR Of Leaf Number | | |
|---|---|---|---|---|---|---|---|
| | | Average | p-value | % increment | Average | p-value | % increment |
| NUE563 | 9452.3 | 0.018 | 3.7E−01 | 9.76 | | | |
| NUE563 | 9453.4 | 0.021 | 2.7E−03 | 30.97 | 0.580 | 0.223 | 16.07 |
| Control | | 0.016 | | | 0.500 | | |
| NUE565 | 9444.1 | 0.020 | 3.2E−02 | 21.06 | | | |
| Control | | 0.016 | | | | | |
| NUE566 | 9514.3 | 0.022 | 3.5E−03 | 34.09 | 0.558 | 0.384 | 11.55 |
| NUE566 | 9513.1 | 0.020 | 3.2E−02 | 22.23 | 0.551 | 0.432 | 10.19 |
| NUE566 | 9512.4 | 0.021 | 1.2E−02 | 31.16 | 0.575 | 0.285 | 14.98 |
| NUE566 | 9514.1 | 0.021 | 5.5E−03 | 29.97 | 0.515 | | 3.05 |
| Control | | 0.016 | | | 0.500 | | |
| NUE568 | 9474.4 | 0.022 | 6.2E−04 | 34.41 | | | |
| NUE568 | 9461.2 | 0.024 | 1.2E−04 | 46.02 | 0.567 | 0.327 | 13.35 |
| NUE568 | 9462.4 | 0.024 | 5.3E−04 | 48.85 | 0.527 | 0.687 | 5.52 |
| NUE568 | 9462.3 | 0.022 | 1.2E−03 | 35.77 | | | |
| NUE568 | 9463.4 | 0.022 | 2.5E−03 | 38.12 | | | |
| Control | | 0.016 | | | 0.500 | | |
| NUE573 | 9491.4 | 0.018 | 1.4E−01 | 14.16 | | | |
| NUE573 | 9492.1 | 0.029 | 7.4E−09 | 77.15 | 0.606 | 0.122 | 21.29 |
| NUE573 | 9493.4 | 0.023 | 9.0E−05 | 42.33 | 0.539 | 0.549 | 7.79 |
| NUE573 | 9494.3 | 0.023 | 1.3E−04 | 40.79 | 0.573 | 0.271 | 14.63 |
| NUE573 | 9491.2 | 0.020 | 9.4E−03 | 26.53 | 0.565 | 0.383 | 13.00 |
| NUE573 | 9492.2 | 0.022 | 4.2E−04 | 39.19 | | | |
| Control | | 0.016 | | | 0.500 | | |
| NUE575 | 9501.4 | 0.026 | 2.8E−07 | 59.00 | 0.554 | 0.441 | 10.78 |
| NUE575 | 9504.3 | 0.016 | 8.9E−01 | −1.86 | 0.517 | 0.813 | 3.41 |
| NUE575 | 9504.1 | 0.025 | 1.3E−04 | 55.64 | 0.560 | 0.398 | 12.06 |
| NUE575 | 9503.1 | 0.024 | 1.4E−04 | 51.12 | 0.615 | 0.126 | 23.04 |
| NUE575 | 9502.1 | 0.021 | 1.5E−02 | 28.36 | 0.513 | 0.852 | 2.58 |
| Control | | 0.016 | | | 0.500 | | |
| NUE578 | 9524.3 | 0.025 | 4.9E−06 | 56.63 | 0.575 | 0.268 | 14.98 |
| NUE578 | 9524.1 | 0.029 | 3.0E−07 | 77.86 | 0.630 | 0.050 | 25.93 |
| NUE578 | 9523.3 | 0.027 | 6.9E−08 | 65.64 | 0.561 | 0.372 | 12.29 |
| NUE578 | 9522.3 | 0.021 | 1.6E−03 | 32.66 | 0.606 | 0.119 | 21.29 |
| Control | | 0.016 | | | 0.500 | | |
| NUE580 | 9551.3 | 0.021 | 6.5E−03 | 28.15 | 0.538 | 0.545 | 7.62 |
| NUE580 | 9554.2 | | | | 0.564 | 0.339 | 12.76 |
| NUE580 | 9553.4 | 0.023 | 1.5E−04 | 40.79 | 0.526 | 0.686 | 5.28 |
| NUE580 | 9551.4 | 0.024 | 1.3E−05 | 47.33 | 0.524 | 0.734 | 4.82 |
| NUE580 | 9554.4 | 0.022 | 4.0E−03 | 37.25 | | | |
| Control | | 0.016 | | | 0.500 | | |
| NUE582 | 9561.1 | 0.021 | 1.3E−02 | 29.36 | 0.585 | 0.225 | 16.94 |
| NUE582 | 9562.1 | 0.020 | 1.8E−02 | 26.50 | 0.560 | 0.379 | 11.94 |
| NUE582 | 9562.4 | 0.020 | 3.7E−02 | 26.29 | 0.556 | 0.464 | 11.24 |
| NUE582 | 9563.3 | 0.023 | 1.7E−04 | 44.35 | 0.615 | 0.113 | 23.04 |
| NUE582 | 9561.2 | 0.026 | 1.4E−06 | 61.66 | 0.605 | 0.124 | 21.11 |
| Control | | 0.016 | | | 0.500 | | |

Table 40: Analyses of growth rate (RGR of leaf blade area and RGR of leaf number) of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM KNO$_3$, 1 mM KH$_2$PO$_4$, 1 mM MgSO$_4$, 3.6 mM K$_2$SO$_4$, 2 mM CaCl$_2$ and microelements) as compared to control plants.

TABLE 41

Transgenic plants exogenously expressing the polynucleotides of some embodiments of the invention exhibit improved growth rate (RGR of rosette area and diameter and RGR of plot coverage) under nitrogen deficient conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | p-value | % incr. | Ave. | p-value | % incr. | Ave. | p-value | % incr. |
| NUE241 | 9633.4 | 0.102 | 2.9E−01 | 13.04 | 0.130 | 6.4E−01 | −3.23 | 0.82 | 2.9E−01 | 13.04 |
| NUE241 | 9632.3 | 0.131 | 2.2E−02 | 44.18 | 0.163 | 5.3E−02 | 21.41 | 1.05 | 2.2E−02 | 44.18 |
| NUE241 | 9631.4 | 0.114 | 2.6E−02 | 25.68 | 0.151 | 8.4E−02 | 12.12 | 0.91 | 2.6E−02 | 25.68 |
| Control | | 0.091 | | | 0.135 | | | 0.72 | | |
| NUE525 | 9534.1 | 0.160 | 3.4E−07 | 76.36 | 0.164 | 3.4E−03 | 21.78 | 1.20 | 2.3E−05 | 66.06 |
| NUE525 | 9531.2 | 0.150 | 3.9E−06 | 65.52 | 0.161 | 7.7E−03 | 19.52 | 1.13 | 2.0E−04 | 55.87 |
| NUE525 | 9533.1 | 0.135 | 3.4E−04 | 48.53 | 0.153 | 5.1E−02 | 13.37 | 1.08 | 3.4E−04 | 48.53 |
| NUE525 | 9531.3 | 0.111 | 1.1E−01 | 22.62 | 0.135 | 9.8E−01 | 0.21 | 0.89 | 1.1E−01 | 22.62 |

TABLE 41-continued

Transgenic plants exogenously expressing the polynucleotides of some embodiments of the invention exhibit improved growth rate (RGR of rosette area and diameter and RGR of plot coverage) under nitrogen deficient conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | p-value | % incr. | Ave. | p-value | % incr. | Ave. | p-value | % incr. |
| NUE525 | 9533.4 | 0.130 | 3.6E−04 | 43.83 | 0.149 | 1.1E−01 | 11.07 | 1.04 | 3.6E−04 | 43.83 |
| NUE525 | 9531.1 | 0.129 | 6.5E−04 | 42.14 | 0.140 | 5.5E−01 | 4.10 | 1.03 | 6.5E−04 | 42.14 |
| Control | | 0.091 | | | 0.135 | | | 0.72 | | |
| NUE545 | 9484.2 | 0.168 | 4.4E−08 | 85.85 | 0.184 | 4.2E−06 | 36.37 | 1.35 | 4.4E−08 | 85.85 |
| NUE545 | 9482.4 | 0.127 | 3.1E−03 | 40.34 | 0.154 | 6.9E−02 | 14.35 | 1.02 | 3.1E−03 | 40.34 |
| NUE545 | 9482.2 | 0.098 | | 8.66 | 0.135 | 9.6E−01 | 0.34 | 0.79 | 4.4E−01 | 8.66 |
| NUE545 | 9481.3 | 0.130 | 2.3E−02 | 43.77 | 0.173 | 3.3E−02 | 28.42 | 1.04 | 2.3E−02 | 43.77 |
| NUE545 | 9484.4 | 0.163 | 2.7E−07 | 79.91 | 0.194 | 4.6E−07 | 43.83 | 1.30 | 2.7E−07 | 79.91 |
| Control | | 0.091 | | | 0.135 | | | 0.72 | | |
| NUE549 | 9341.1 | 0.118 | 1.4E−02 | 30.70 | 0.140 | 6.0E−01 | 3.79 | 0.95 | 1.4E−02 | 30.70 |
| Control | | 0.091 | | | 0.135 | | | 0.72 | | |
| NUE563 | 9454.1 | 0.119 | 9.5E−03 | 31.19 | 0.148 | 1.5E−01 | 9.88 | 0.95 | 9.5E−03 | 31.19 |
| NUE563 | 9452.3 | 0.104 | 2.4E−01 | 15.20 | 0.140 | 6.0E−01 | 4.00 | 0.84 | 2.4E−01 | 15.20 |
| NUE563 | 9453.4 | 0.137 | 2.1E−04 | 51.54 | 0.155 | 3.6E−02 | 15.50 | 1.10 | 2.1E−04 | 51.54 |
| Control | | 0.091 | | | 0.135 | | | 0.72 | | |
| NUE565 | 9444.1 | 0.111 | 6.2E−02 | 22.99 | 0.157 | 6.4E−02 | 16.45 | 0.89 | 6.2E−02 | 22.99 |
| Control | | 0.091 | | | 0.135 | | | 0.72 | | |
| NUE566 | 9514.3 | 0.143 | 3.0E−04 | 58.15 | 0.162 | 4.2E−02 | 20.44 | 1.07 | 6.9E−04 | 47.03 |
| NUE566 | 9513.1 | 0.118 | 1.7E−02 | 30.34 | 0.155 | 4.8E−02 | 14.92 | 0.94 | 1.7E−02 | 30.34 |
| NUE566 | 9512.4 | 0.121 | 2.4E−02 | 33.06 | 0.156 | 7.6E−02 | 15.84 | 0.96 | 2.4E−02 | 33.06 |
| NUE566 | 9514.1 | 0.134 | 1.1E−03 | 48.17 | 0.160 | 1.1E−02 | 18.57 | 1.02 | 1.0E−02 | 40.14 |
| Control | | 0.091 | | | 0.135 | | | 0.72 | | |
| NUE568 | 9474.4 | 0.121 | 7.0E−03 | 33.08 | 0.160 | 1.2E−02 | 19.19 | 0.96 | 7.0E−03 | 33.08 |
| NUE568 | 9461.2 | 0.157 | 7.6E−06 | 73.36 | 0.170 | 4.1E−03 | 26.24 | 1.26 | 7.6E−06 | 73.36 |
| NUE568 | 9462.4 | 0.139 | 5.3E−04 | 53.79 | 0.172 | 5.8E−03 | 27.76 | 1.11 | 5.3E−04 | 53.79 |
| NUE568 | 9462.3 | 0.131 | 1.4E−03 | 44.88 | 0.167 | 1.3E−03 | 23.84 | 1.05 | 1.4E−03 | 44.88 |
| NUE568 | 9463.4 | 0.129 | 3.7E−03 | 42.01 | 0.159 | 2.5E−02 | 18.33 | 1.03 | 3.7E−03 | 42.01 |
| Control | | 0.091 | | | 0.135 | | | 0.72 | | |
| NUE573 | 9491.4 | 0.123 | 6.0E−03 | 35.42 | 0.149 | 1.7E−01 | 10.44 | 0.98 | 6.0E−03 | 35.42 |
| NUE573 | 9492.1 | 0.182 | 5.7E−09 | 100.76 | 0.190 | 1.2E−06 | 41.04 | 1.46 | 5.7E−09 | 100.76 |
| NUE573 | 9493.4 | 0.141 | 5.6E−05 | 55.36 | 0.166 | 2.1E−03 | 23.03 | 1.06 | 6.8E−04 | 45.86 |
| NUE573 | 9494.3 | 0.151 | 5.3E−06 | 66.87 | 0.171 | 6.6E−04 | 26.79 | 1.21 | 5.3E−06 | 66.87 |
| NUE573 | 9491.2 | 0.139 | 1.3E−04 | 53.69 | 0.164 | 1.1E−02 | 21.53 | 1.11 | 1.3E−04 | 53.69 |
| NUE573 | 9492.2 | 0.130 | 1.5E−03 | 43.69 | 0.165 | 4.8E−03 | 22.63 | 1.04 | 1.5E−03 | 43.69 |
| Control | | 0.091 | | | 0.135 | | | 0.72 | | |
| NUE575 | 9501.4 | 0.172 | 9.2E−09 | 89.99 | 0.198 | 1.1E−07 | 47.36 | 1.38 | 9.2E−09 | 89.99 |
| NUE575 | 9504.3 | 0.095 | 7.7E−01 | 4.69 | 0.135 | 1.0E+00 | −0.04 | 0.76 | 7.7E−01 | 4.69 |
| NUE575 | 9504.1 | 0.160 | 4.5E−05 | 76.22 | 0.178 | 3.5E−03 | 32.48 | 1.28 | 4.5E−05 | 76.22 |
| NUE575 | 9503.1 | 0.165 | 4.1E−06 | 82.22 | 0.168 | 1.2E−02 | 24.58 | 1.32 | 4.1E−06 | 82.22 |
| NUE575 | 9502.1 | 0.136 | 9.0E−04 | 50.03 | 0.151 | 1.3E−01 | 12.57 | 1.09 | 9.0E−04 | 50.03 |
| Control | | 0.091 | | | 0.135 | | | 0.72 | | |
| NUE578 | 9524.3 | 0.165 | 6.9E−07 | 81.99 | 0.185 | 2.5E−04 | 37.68 | 1.32 | 6.9E−07 | 81.99 |
| NUE578 | 9524.1 | 0.206 | 3.9E−09 | 127.63 | 0.202 | 1.1E−06 | 49.79 | 1.56 | 4.4E−07 | 115.41 |
| NUE578 | 9523.3 | 0.181 | 4.2E−09 | 99.40 | 0.179 | 1.9E−05 | 33.16 | 1.45 | 4.2E−09 | 99.40 |
| NUE578 | 9522.3 | 0.141 | 6.5E−05 | 55.95 | 0.167 | 1.6E−03 | 24.01 | 1.13 | 6.5E−05 | 55.95 |
| Control | | 0.091 | | | 0.135 | | | 0.72 | | |
| NUE580 | 9551.3 | 0.135 | 3.5E−04 | 48.50 | 0.157 | 2.7E−02 | 16.48 | 1.08 | 3.5E−04 | 48.50 |
| NUE580 | 9554.2 | 0.093 | 8.5E−01 | | 0.130 | 7.1E−01 | | 0.74 | 8.5E−01 | |
| NUE580 | 9553.4 | 0.137 | 1.5E−04 | 51.17 | 0.169 | 8.0E−04 | 25.59 | 1.10 | 1.5E−04 | 51.17 |
| NUE580 | 9551.4 | 0.165 | 2.1E−07 | 82.42 | 0.170 | 1.3E−03 | 26.33 | 1.32 | 2.1E−07 | 82.42 |
| NUE580 | 9554.4 | 0.138 | 1.0E−03 | 52.73 | 0.152 | 9.4E−02 | 12.99 | 1.11 | 1.0E−03 | 52.73 |
| Control | | 0.091 | | | 0.135 | | | 0.72 | | |
| NUE582 | 9561.1 | 0.133 | 2.5E−03 | 47.08 | 0.167 | 6.9E−03 | 24.32 | 0.99 | 7.7E−03 | 36.09 |
| NUE582 | 9562.1 | 0.127 | 3.4E−03 | 40.44 | 0.152 | 7.7E−02 | 13.15 | 1.02 | 3.4E−03 | 40.44 |
| NUE582 | 9562.4 | 0.120 | 2.8E−02 | 32.82 | 0.153 | 1.1E−01 | 13.90 | 0.91 | 1.0E−01 | 26.19 |
| NUE582 | 9563.3 | 0.141 | 2.1E−04 | 55.33 | 0.178 | 4.6E−04 | 32.62 | 1.13 | 2.1E−04 | 55.33 |
| NUE582 | 9561.2 | 0.172 | 9.3E−08 | 89.88 | 0.186 | 1.1E−05 | 37.84 | 1.30 | 4.6E−06 | 79.08 |
| Control | | 0.091 | | | 0.135 | | | 0.72 | | |

Table 41: Analyses of growth rate (RGR of rosette area and diameter and RGR of plot coverage) of transgenic plants overexpressing the exogenous polynucleotides of some embodiments of the invention (using the cloned or synthetic genes listed in Table 23 above) under the regulation of a constitutive promoter (35S) when grown under nitrogen deficient conditions (1.5 mM $KNO_3$, 1 mM $KH_2PO_4$, 1 mM $MgSO_4$, 3.6 mM $K_2SO_4$, 2 mM $CaCl_2$ and microelements) as compared to control plants.

The genes presented in Tables 42 and 43, hereinbelow, have improved plant NUE and produced larger plant biomass when grown under standard nitrogen fertilization conditions, compared to control plants. In addition a production of a larger number of leaves as well as a higher plot coverage when grown at low nitrogen conditions indicate a larger photosynthetic capacity of the plant when grown at high nitrogen growth conditions. Table 42 and 43 depict analyses of rosette area and leaf number (rosette diameter, rosette area, leaf number, leaf blade area and plot coverage) when grown under standard nitrogen fertilization conditions (6 mM $KNO_3$, 1 mM $KH_2PO_4$, 1 mM $MgSO_4$, 2 mM $CaCl_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 42

Transgenic plants exogenously expressing the polynucleotides of some embodiments of the invention exhibit improved rosette growth performance (rosette diameter and area and plot coverage) under standard nitrogen conditions

| Gene Name | Event # | Rosette Diameter [cm] | | | Rosette Area [cm$^2$] | | | Plot Coverage [%] | | |
|---|---|---|---|---|---|---|---|---|---|---|
| | | Ave. | P-Value | % incr. | Ave. | P-Value | % incr. | Ave. | P-Value | % incr. |
| NUE230 | 9154.2 | 2.16 | 1.1E−02 | 6.87 | 1.57 | 4.6E−03 | 17.45 | 12.56 | 4.6E−03 | 17.45 |
| Control | | 2.02 | | | 1.34 | | | 10.69 | | |
| NUE234 | 9163.4 | 2.40 | 2.7E−02 | 18.64 | 1.72 | 1.7E−02 | 28.84 | 13.78 | 1.7E−02 | 28.84 |
| NUE234 | 9162.5 | 2.14 | 2.1E−02 | 5.87 | 1.52 | 1.6E−02 | 13.45 | 12.13 | 1.6E−02 | 13.45 |
| Control | | 2.02 | | | 1.34 | | | 10.69 | | |
| NUE248 | 8983.1 | 2.21 | 2.2E−03 | 9.45 | 1.58 | 3.5E−03 | 18.29 | 12.65 | 3.5E−03 | 18.29 |
| Control | | 2.02 | | | 1.34 | | | 10.69 | | |
| NUE249 | 9122.2 | 2.27 | 8.3E−02 | 12.44 | 1.62 | 1.8E−03 | 20.83 | 12.92 | 1.8E−03 | 20.83 |
| Control | | 2.02 | | | 1.34 | | | 10.69 | | |
| NUE268 | 8996.3 | 2.17 | 1.2E−02 | 7.34 | 1.64 | 2.2E−03 | 23.05 | 13.16 | 2.2E−03 | 23.05 |
| Control | | 2.02 | | | 1.34 | | | 10.69 | | |
| NUE525 | 9534.1 | 1.96 | 1.0E−01 | 12.33 | 1.37 | 4.5E−02 | 27.78 | 10.97 | 4.5E−02 | 27.78 |
| NUE525 | 9531.2 | 2.17 | 8.8E−02 | 24.47 | 1.65 | 7.2E−02 | 53.32 | 13.17 | 7.2E−02 | 53.32 |
| NUE525 | 9533.1 | 2.11 | 3.4E−01 | 21.09 | 1.57 | 3.5E−01 | 46.56 | 12.59 | 3.5E−01 | 46.56 |
| NUE525 | 9531.3 | 2.00 | 2.9E−02 | 14.68 | 1.47 | 1.9E−02 | 37.33 | 11.79 | 1.9E−02 | 37.33 |
| NUE525 | 9533.4 | 2.08 | 3.2E−01 | 19.24 | 1.47 | 3.6E−01 | 36.69 | 11.74 | 3.6E−01 | 36.69 |
| Control | | 1.75 | | | 1.07 | | | 8.59 | | |
| NUE536 | 9233.3 | 2.28 | 2.2E−01 | 12.83 | 1.71 | 1.7E−01 | 27.70 | 13.66 | 1.7E−01 | 27.70 |
| NUE536 | 9234.1 | 2.43 | 6.8E−02 | 20.35 | 1.92 | 2.6E−02 | 43.88 | 15.39 | 2.6E−02 | 43.88 |
| Control | | 2.02 | | | 1.34 | | | 10.69 | | |
| NUE545 | 9484.2 | 2.37 | 1.2E−03 | 35.50 | 1.74 | 8.5E−03 | 62.13 | 13.92 | 8.5E−03 | 62.13 |
| NUE545 | 9482.4 | 1.93 | 6.8E−01 | 10.29 | 1.37 | 5.9E−01 | 27.95 | 10.99 | 5.9E−01 | 27.95 |
| NUE545 | 9481.3 | 2.09 | 8.6E−03 | 19.87 | 1.51 | 7.8E−03 | 40.62 | 12.08 | 7.8E−03 | 40.62 |
| NUE545 | 9484.4 | 2.15 | 8.4E−02 | 22.97 | 1.55 | 1.7E−01 | 43.98 | 12.37 | 1.7E−01 | 43.98 |
| Control | | 1.75 | | | 1.07 | | | 8.59 | | |
| NUE549 | 9343.6 | 1.93 | 4.9E−01 | 10.73 | 1.22 | 6.2E−01 | 13.86 | 9.78 | 6.2E−01 | 13.86 |
| NUE549 | 9341.1 | 1.94 | 5.1E−01 | 11.16 | 1.33 | 4.3E−01 | 23.54 | 10.61 | 4.3E−01 | 23.54 |
| NUE549 | 9342.3 | 2.01 | 2.7E−02 | 15.03 | 1.38 | 4.3E−01 | 28.53 | 11.04 | 4.3E−02 | 28.53 |
| Control | | 1.75 | | | 1.07 | | | 8.59 | | |
| NUE560 | 9423.4 | 2.23 | 4.7E−01 | 10.17 | 1.66 | 4.2E−01 | 24.21 | 13.28 | 4.2E−01 | 24.21 |
| Control | | 2.02 | | | 1.34 | | | 10.69 | | |
| NUE568 | 9461.2 | 2.35 | 2.3E−03 | 34.72 | 2.01 | 1.3E−02 | 87.26 | 16.08 | 1.3E−02 | 87.26 |
| NUE568 | 9461.3 | 2.05 | 9.9E−02 | 17.54 | 1.48 | 7.0E−02 | 38.17 | 11.87 | 7.0E−02 | 38.17 |
| NUE568 | 9462.4 | 1.92 | 2.1E−01 | 9.87 | 1.25 | 3.4E−01 | 16.76 | 9.46 | 6.7E−01 | 10.14 |
| NUE568 | 9463.4 | 2.01 | 7.4E−02 | 14.90 | 1.41 | 7.7E−02 | 31.41 | 11.29 | 7.7E−02 | 31.41 |
| Control | | 1.75 | | | 1.07 | | | 8.59 | | |
| NUE573 | 9491.4 | 2.10 | 9.7E−03 | 20.13 | 1.48 | 1.4E−02 | 37.74 | 11.83 | 1.4E−02 | 37.74 |
| NUE573 | 9492.1 | 2.01 | 1.0E−01 | 15.05 | 1.36 | 7.2E−02 | 26.45 | 8.02 | 8.5E−01 | −6.67 |
| NUE573 | 9493.4 | 1.99 | 1.3E−01 | 14.08 | 1.38 | 7.7E−02 | 28.86 | 10.42 | 3.7E−01 | 21.28 |
| NUE573 | 9491.2 | 2.18 | 1.1E−01 | 25.09 | 1.59 | 1.3E−01 | 48.09 | 12.72 | 1.3E−01 | 48.09 |
| NUE573 | 9494.3 | 1.98 | 7.0E−02 | 13.52 | 1.45 | 1.0E−01 | 34.78 | 11.57 | 1.0E−01 | 34.78 |
| NUE573 | 9492.2 | 1.94 | 4.4E−01 | 11.14 | 1.46 | 5.2E−01 | 35.94 | 9.79 | 5.7E−01 | 14.02 |
| Control | | 1.75 | | | 1.07 | | | 8.59 | | |
| NUE575 | 9501.4 | 1.96 | 2.8E−01 | 12.36 | 1.31 | 2.7E−01 | 22.00 | 10.48 | 2.7E−01 | 22.00 |
| NUE575 | 9504.1 | 2.13 | 4.8E−02 | 21.96 | 1.58 | 7.9E−02 | 47.31 | 12.65 | 7.9E−02 | 47.31 |
| NUE575 | 9503.1 | 1.95 | 9.7E−02 | 11.94 | 1.24 | 3.4E−01 | 15.70 | 9.94 | 3.4E−01 | 15.70 |
| NUE575 | 9502.1 | 1.99 | 4.1E−01 | 14.24 | 1.44 | 3.8E−01 | 34.12 | 10.35 | 6.9E−01 | 20.49 |
| Control | | 1.75 | | | 1.07 | | | 8.59 | | |
| NUE578 | 9524.1 | 2.15 | 3.4E−03 | 23.14 | 1.64 | 1.9E−03 | 52.74 | 13.12 | 1.9E−03 | 52.74 |
| NUE578 | 9524.3 | 2.08 | 6.0E−01 | 18.89 | 1.58 | 5.2E−01 | 47.61 | 12.68 | 5.2E−01 | 47.61 |
| NUE578 | 9523.3 | 2.37 | 8.6E−02 | 35.89 | 1.79 | 2.9E−02 | 66.79 | 13.36 | 1.4E−03 | 55.59 |
| NUE578 | 9522.3 | 2.07 | 1.3E−01 | 18.61 | 1.63 | 1.2E−01 | 51.78 | 13.03 | 1.2E−01 | 51.78 |
| Control | | 1.75 | | | 1.07 | | | 8.59 | | |
| NUE580 | 9552.3 | 1.92 | 1.1E−01 | 10.01 | 1.24 | 2.4E−01 | 15.83 | 9.95 | 2.4E−01 | 15.83 |
| NUE580 | 9551.3 | 1.98 | 4.3E−01 | 13.26 | 1.47 | 1.4E−02 | 37.05 | 11.77 | 1.4E−02 | 37.05 |
| NUE580 | 9554.4 | 2.03 | 3.7E−01 | 16.34 | 1.52 | 2.0E−01 | 41.78 | 12.18 | 2.0E−01 | 41.78 |
| Control | | 1.75 | | | 1.07 | | | 8.59 | | |
| NUE582 | 9561.1 | 2.25 | 9.2E−02 | 28.98 | 1.73 | 1.6E−01 | 61.52 | 13.87 | 1.6E−01 | 61.52 |
| NUE582 | 9561.2 | 2.10 | 7.1E−03 | 20.11 | 1.56 | 4.6E−03 | 45.40 | 12.49 | 4.6E−03 | 45.40 |

TABLE 42-continued

Transgenic plants exogenously expressing the polynucleotides of some embodiments of the invention exhibit improved rosette growth performance (rosette diameter and area and plot coverage) under standard nitrogen conditions

| Gene Name | Event # | Rosette Diameter [cm] | | | Rosette Area [cm$^2$] | | | Plot Coverage [%] | | |
|---|---|---|---|---|---|---|---|---|---|---|
| | | Ave. | P-Value | % incr. | Ave. | P-Value | % incr. | Ave. | P-Value | % incr. |
| Control | | 1.75 | | | 1.07 | | | 8.59 | | |
| NUE585 | 9661.1 | 2.46 | 4.9E−02 | 21.69 | 2.02 | 1.2E−05 | 50.77 | 16.12 | 1.2E−05 | 50.77 |
| Control | | 2.02 | | | 1.34 | | | 10.69 | | |
| NUE588 | 9591.3 | 2.14 | 1.3E−01 | 5.91 | 1.50 | 5.3E−02 | 12.38 | 12.02 | 5.3E−02 | 12.38 |
| Control | | 2.02 | | | 1.34 | | | 10.69 | | |

Table 42: Analyses of rosette growth performance (rosette diameter and area and plot coverage) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM KNO$_3$, 1 mM KH$_2$PO$_4$, 1 mM MgSO$_4$, 2 mM CaCl$_2$ and microelements) as compared to control plants.

TABLE 43

Transgenic plants exogenously expressing the polynucleotides of some embodiments of the invention exhibit improved rosette growth performance (leaf number and leaf blade area) under standard nitrogen conditions

| Gene Name | Event # | Leaf Number | | | Leaf Blade Area [cm$^2$] | | |
|---|---|---|---|---|---|---|---|
| | | Ave. | P-Value | % incr. | Ave. | P-Value | % incr. |
| NUE230 | 9154.2 | 8.75 | 1.4E−01 | 4.03 | 0.26 | 7.3E−03 | 16.16 |
| Control | | 8.41 | | | 0.23 | | |
| NUE234 | 9163.4 | 8.88 | 4.2E−01 | 5.52 | 0.28 | 2.9E−02 | 23.30 |
| NUE234 | 9162.5 | 8.06 | 5.7E−01 | −4.14 | 0.26 | 9.0E−02 | 12.41 |
| Control | | 8.41 | | | 0.23 | | |
| NUE248 | 8983.1 | 8.75 | 1.4E−01 | 4.03 | 0.25 | 1.0E−02 | 11.97 |
| Control | | 8.41 | | | 0.23 | | |
| NUE249 | 9122.2 | 9.25 | 2.2E−02 | 9.98 | 0.27 | 3.5E−03 | 17.48 |
| Control | | 8.41 | | | 0.23 | | |
| NUE268 | 8996.3 | 8.81 | 1.4E−02 | 4.78 | 0.28 | 6.2E−04 | 21.22 |
| Control | | 8.41 | | | 0.23 | | |
| NUE525 | 9534.1 | 8.88 | 3.4E−02 | 9.44 | 0.23 | 6.6E−02 | 20.64 |
| NUE525 | 9531.2 | 9.06 | 9.5E−03 | 11.75 | 0.26 | 1.3E−01 | 39.24 |
| NUE525 | 9533.1 | 8.63 | 5.6E−01 | 6.36 | 0.24 | 3.4E−01 | 29.39 |
| NUE525 | 9531.3 | 8.69 | 4.8E−01 | 7.13 | 0.23 | 2.3E−01 | 23.65 |
| NUE525 | 9533.4 | 8.88 | 4.8E−01 | 9.44 | 0.23 | 3.5E−01 | 24.51 |
| Control | | 8.11 | | | 0.19 | | |
| NUE536 | 9233.3 | 9.50 | 1.2E−02 | 12.95 | 0.27 | 2.8E−01 | 18.94 |
| NUE536 | 9234.1 | 9.44 | 6.1E−02 | 12.21 | 0.29 | 7.6E−02 | 28.74 |
| Control | | 8.41 | | | 0.23 | | |
| NUE545 | 9484.2 | 9.31 | 1.5E−01 | 14.84 | 0.28 | 2.1E−03 | 47.68 |
| NUE545 | 9482.4 | 8.56 | 6.3E−01 | 5.59 | 0.22 | 6.6E−01 | 18.07 |
| NUE545 | 9481.3 | 8.06 | 8.7E−01 | −0.58 | 0.27 | 1.2E−03 | 41.88 |
| NUE545 | 9484.4 | 8.88 | 1.1E−01 | 9.44 | 0.25 | 8.3E−02 | 31.54 |
| Control | | 8.11 | | | 0.19 | | |
| NUE549 | 9343.6 | 8.81 | 7.7E−02 | 8.67 | 0.20 | 6.6E−01 | 8.33 |
| NUE549 | 9341.1 | 8.44 | 6.7E−01 | 4.05 | 0.21 | 6.0E−01 | 14.37 |
| NUE549 | 9342.3 | 9.06 | 1.1E−01 | 11.75 | 0.21 | 1.3E−01 | 13.98 |
| Control | | 8.11 | | | 0.19 | | |
| NUE560 | 9423.4 | 8.75 | 1.3E−02 | 4.03 | 0.28 | 4.4E−01 | 21.95 |
| Control | | 8.41 | | | 0.23 | | |
| NUE568 | 9461.2 | 9.63 | 1.5E−02 | 18.69 | 0.30 | 2.1E−02 | 59.80 |
| NUE568 | 9461.3 | 8.94 | 2.6E−02 | 10.21 | 0.23 | 3.2E−02 | 25.07 |
| NUE568 | 9462.4 | 8.48 | 3.5E−01 | 4.60 | 0.21 | 4.6E−01 | 13.21 |
| NUE568 | 9463.4 | 8.69 | 7.2E−02 | 7.13 | 0.24 | 7.0E−02 | 28.16 |
| Control | | 8.11 | | | 0.19 | | |
| NUE573 | 9491.4 | 8.63 | 2.3E−01 | 6.36 | 0.23 | 6.2E−02 | 22.82 |
| NUE573 | 9492.1 | 8.81 | 7.7E−02 | 8.67 | 0.23 | 3.9E−02 | 20.79 |
| NUE573 | 9493.4 | 8.86 | 4.2E−02 | 9.22 | 0.22 | 8.1E−02 | 17.66 |
| NUE573 | 9491.2 | 8.63 | 1.2E−01 | 6.36 | 0.25 | 1.2E−01 | 33.61 |
| NUE573 | 9494.3 | 9.13 | 1.5E−02 | 12.52 | 0.23 | 9.9E−02 | 20.47 |
| NUE573 | 9492.2 | 8.46 | 7.1E−01 | 4.30 | 0.23 | 5.5E−01 | 25.07 |
| Control | | 8.11 | | | 0.19 | | |
| NUE575 | 9501.4 | 8.38 | 3.6E−01 | 3.28 | 0.21 | 3.9E−01 | 14.56 |
| NUE575 | 9504.1 | 9.06 | 9.5E−03 | 11.75 | 0.25 | 1.1E−01 | 33.06 |
| NUE575 | 9503.1 | 8.06 | 9.2E−01 | −0.58 | 0.22 | 3.3E−01 | 16.13 |
| NUE575 | 9502.1 | 8.98 | 3.9E−01 | 10.73 | 0.22 | 3.0E−01 | 18.72 |
| Control | | 8.11 | | | 0.19 | | |
| NUE578 | 9524.1 | 8.50 | 1.9E−01 | 4.82 | 0.26 | 7.3E−03 | 40.77 |
| NUE578 | 9524.3 | 8.31 | 8.7E−01 | 2.50 | 0.25 | 5.4E−01 | 32.70 |
| NUE578 | 9523.3 | 9.48 | 1.5E−02 | 16.93 | 0.28 | 4.2E−03 | 51.09 |
| NUE578 | 9522.3 | 9.06 | 1.1E−01 | 11.75 | 0.24 | 1.9E−01 | 27.90 |
| Control | | 8.11 | | | 0.19 | | |
| NUE580 | 9552.3 | 8.56 | 1.4E−01 | 5.59 | 0.20 | 4.9E−01 | 7.20 |
| NUE580 | 9551.3 | 8.69 | 7.2E−02 | 7.13 | 0.23 | 1.6E−02 | 25.62 |
| NUE580 | 9554.4 | 8.63 | 4.8E−01 | 6.36 | 0.23 | 3.5E−01 | 24.90 |
| Control | | 8.11 | | | 0.19 | | |
| NUE582 | 9561.1 | 9.44 | 2.7E−01 | 16.38 | 0.27 | 1.6E−01 | 43.32 |
| NUE582 | 9561.2 | 8.94 | 1.8E−02 | 10.21 | 0.25 | 5.5E−03 | 33.79 |
| Control | | 8.11 | | | 0.19 | | |
| NUE585 | 9661.1 | 8.94 | 4.0E−03 | 6.26 | 0.33 | 1.8E−02 | 43.63 |
| Control | | 8.41 | | | 0.23 | | |
| NUE588 | 9591.3 | 9.19 | 5.6E−04 | 9.24 | 0.25 | 2.6E−02 | 9.62 |
| Control | | 8.41 | | | 0.23 | | |

Table 43: Analyses of rosette growth performance (leaf number and leaf blade area) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM KNO$_3$, 1 mM KH$_2$PO$_4$, 1 mM MgSO$_4$, 2 mM CaCl$_2$ and microelements) as compared to control plants.

The genes presented in Tables 44 and 45, hereinbelow, have improved plant growth rate when grown at limiting nitrogen fertilization levels. These genes improved the growth rate of the rosette and faster covered the soil when grown at standard nitrogen fertilization levels. These genes produced faster growing plants showing a better utilization of the nitrogen present.

Tables 44 and 45 depict analyses of the growth rate of the rosette diameter, rosette area, leaf blade area, leaf number and plot coverage when grown under standard nitrogen conditions (6 mM KNO$_3$, 1 mM KH$_2$PO$_4$, 1 mM MgSO$_4$, 2 mM CaCl$_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 44

Transgenic plants exogenously expressing the polynucleotides of some embodiments of the invention exhibit improved growth rate (RGR of leaf blade area, leaf number and rosette area) under standard nitrogen conditions

| Gene Name | Event # | RGR Of Leaf Blade Area | | | RGR Of Leaf Number | | | RGR Of Rosette Area | | |
|---|---|---|---|---|---|---|---|---|---|---|
| | | Ave. | P-Value | % incr. | Ave. | P-Value | % incr. | Ave. | P-Value | % incr. |
| NUE230 | 9154.2 | 0.032 | 2.5E−01 | 18.08 | 0.561 | 0.862 | −1.88 | 0.20 | 2.8E−01 | 18.63 |
| NUE230 | 9153.3 | 0.034 | 1.5E−01 | 25.07 | 0.629 | 0.404 | 9.96 | 0.22 | 9.2E−02 | 32.65 |
| Control | | 0.027 | | | 0.572 | | | 0.16 | | |
| NUE525 | 9534.1 | 0.027 | 3.4E−01 | 17.00 | 0.577 | 0.820 | 3.62 | 0.18 | 2.5E−01 | 25.20 |
| NUE525 | 9531.2 | 0.032 | 4.9E−02 | 37.26 | 0.619 | 0.479 | 11.17 | 0.21 | 2.0E−02 | 53.67 |
| NUE525 | 9533.1 | 0.029 | 2.1E−01 | 23.87 | 0.570 | 0.889 | 2.25 | 0.20 | 6.0E−02 | 45.89 |
| NUE525 | 9531.3 | 0.028 | 2.3E−01 | 21.75 | 0.618 | 0.485 | 10.96 | 0.19 | 9.2E−02 | 37.52 |
| NUE525 | 9533.4 | 0.028 | 2.4E−01 | 22.32 | 0.581 | 0.783 | 4.35 | 0.19 | 1.2E−01 | 36.12 |
| Control | | 0.023 | | | 0.557 | | | 0.14 | | |
| NUE536 | 9233.3 | 0.032 | 2.0E−01 | 21.11 | 0.696 | 0.053 | 21.70 | 0.21 | 9.8E−02 | 30.44 |
| NUE536 | 9234.1 | 0.035 | 6.2E−02 | 31.13 | 0.719 | 0.025 | 25.69 | 0.24 | 1.6E−02 | 46.81 |
| Control | | 0.027 | | | 0.572 | | | 0.16 | | |
| NUE545 | 9484.2 | 0.034 | 1.4E−02 | 47.61 | 0.666 | 0.224 | 19.56 | 0.23 | 7.1E−03 | 63.45 |
| NUE545 | 9482.4 | 0.026 | 5.0E−01 | 13.65 | 0.617 | 0.523 | 10.85 | 0.18 | 2.8E−01 | 26.57 |
| NUE545 | 9481.3 | 0.032 | 3.8E−02 | 39.71 | 0.478 | | | 0.19 | 7.9E−02 | 38.94 |
| NUE545 | 9484.4 | 0.030 | 1.3E−01 | 27.62 | 0.542 | | | 0.20 | 6.8E−02 | 41.88 |
| Control | | 0.023 | | | 0.557 | | | 0.14 | | |
| NUE568 | 9474.3 | 0.025 | 7.0E−01 | 7.00 | 0.535 | | | 0.15 | 6.4E−01 | 10.17 |
| NUE568 | 9471.3 | 0.024 | 7.5E−01 | 5.65 | 0.627 | 0.423 | 12.49 | 0.17 | 3.4E−01 | 20.52 |
| NUE568 | 9461.2 | 0.037 | 3.1E−03 | 58.77 | 0.665 | 0.208 | 19.45 | 0.26 | 3.9E−04 | 88.65 |
| NUE568 | 9474.4 | 0.026 | 5.5E−01 | 10.89 | 0.526 | 0.726 | −5.61 | 0.15 | 6.2E−01 | 10.72 |
| NUE568 | 9461.3 | 0.029 | 1.9E−01 | 23.81 | 0.643 | 0.342 | 15.47 | 0.20 | 8.0E−02 | 39.53 |
| Control | | 0.023 | | | 0.557 | | | 0.14 | | |
| NUE573 | 9491.4 | 0.026 | 4.3E−01 | 14.05 | 0.543 | 0.872 | −2.57 | 0.19 | 1.2E−01 | 34.11 |
| NUE573 | 9493.4 | 0.026 | 4.9E−01 | 12.34 | 0.653 | 0.270 | 17.18 | 0.18 | 2.0E−01 | 28.04 |
| NUE573 | 9491.2 | 0.030 | 1.0E−01 | 30.33 | 0.519 | 0.657 | −6.87 | 0.21 | 4.2E−02 | 46.75 |
| NUE573 | 9492.2 | 0.029 | 2.3E−01 | 24.31 | 0.531 | 0.791 | −4.60 | 0.19 | 1.6E−01 | 35.61 |
| Control | | 0.023 | | | 0.557 | | | 0.14 | | |
| NUE575 | 9504.1 | 0.030 | 1.1E−01 | 30.22 | 0.624 | 0.428 | 12.01 | 0.21 | 4.0E−02 | 47.00 |
| NUE575 | 9503.1 | 0.027 | 4.0E−01 | 15.42 | 0.516 | 0.651 | −7.29 | 0.16 | 4.7E−01 | 15.58 |
| NUE575 | 9502.1 | 0.026 | 4.7E−01 | 13.38 | 0.609 | 0.566 | 9.32 | 0.19 | 1.7E−01 | 32.29 |
| Control | | 0.023 | | | 0.557 | | | 0.14 | | |
| NUE578 | 9524.1 | 0.033 | 3.3E−02 | 41.00 | 0.613 | 0.511 | 10.12 | 0.22 | 1.8E−02 | 54.74 |
| NUE578 | 9524.3 | 0.031 | 1.5E−01 | 31.93 | 0.608 | 0.642 | 9.18 | 0.21 | 7.3E−02 | 49.17 |
| NUE578 | 9523.3 | 0.034 | 1.6E−02 | 46.45 | 0.665 | 0.213 | 19.44 | 0.23 | 5.4E−03 | 65.74 |
| NUE578 | 9522.3 | 0.029 | 2.1E−01 | 23.38 | 0.685 | 0.143 | 23.02 | 0.21 | 2.4E−02 | 52.52 |
| Control | | 0.023 | | | 0.557 | | | 0.14 | | |
| NUE580 | 9551.3 | 0.029 | 1.4E−01 | 26.91 | 0.602 | 0.608 | 8.02 | 0.19 | 8.4E−02 | 38.45 |
| NUE580 | 9554.4 | 0.027 | 3.8E−01 | 16.77 | 0.543 | 0.875 | −2.57 | 0.19 | 9.4E−02 | 38.64 |
| Control | | 0.023 | | | 0.557 | | | 0.14 | | |
| NUE582 | 9561.1 | 0.032 | 4.1E−02 | 39.34 | 0.666 | 0.252 | 19.56 | 0.22 | 1.2E−02 | 60.37 |
| NUE582 | 9562.1 | 0.027 | 3.5E−01 | 17.41 | 0.577 | 0.833 | 3.51 | 0.17 | 3.0E−01 | 23.28 |
| NUE582 | 9562.4 | 0.027 | 3.8E−01 | 15.92 | 0.568 | 0.902 | 1.94 | 0.16 | 4.4E−01 | 16.65 |
| NUE582 | 9561.2 | 0.032 | 7.0E−02 | 37.29 | 0.665 | 0.255 | 19.42 | 0.22 | 3.1E−02 | 54.06 |
| Control | | 0.023 | | | 0.557 | | | 0.14 | | |
| NUE585 | 9661.3 | 0.030 | 4.5E−01 | 11.39 | 0.684 | 0.145 | 19.49 | 0.18 | 5.3E−01 | 10.62 |
| NUE585 | 9661.1 | 0.039 | 1.2E−02 | 43.80 | 0.658 | 0.178 | 14.96 | 0.25 | 7.0E−03 | 52.30 |
| Control | | 0.027 | | | 0.572 | | | 0.16 | | |
| NUE588 | 9591.3 | 0.031 | 2.6E−01 | 17.23 | 0.713 | 0.052 | 24.56 | 0.19 | 3.2E−01 | 17.29 |
| Control | | 0.027 | | | 0.572 | | | 0.16 | | |

Table 44: Analyses of growth rate (RGR of leaf blade area, leaf number and rosette area) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM KNO$_3$, 1 mM KH$_2$PO$_4$, 1 mM MgSO$_4$, 2 mM CaCl$_2$ and microelements) as compared to control plants.

TABLE 45

Transgenic plants exogenously expressing the polynucleotides of some embodiments of the invention exhibit improved growth rate (RGR of rosette diameter and plot coverage) under standard nitrogen conditions

| Gene Name | Event # | RGR Of Rosette Diameter | | | RGR Of Plot Coverage | | |
|---|---|---|---|---|---|---|---|
| | | Ave. | P-Value | % incr. | Ave. | P-Value | % incr. |
| NUE230 | 9154.2 | 0.20 | 0.612 | 5.67 | 1.56 | 0.283 | 18.63 |
| NUE230 | 9153.3 | 0.21 | 0.382 | 10.99 | 1.75 | 0.092 | 32.65 |
| Control | | 0.19 | | | 1.32 | | |
| NUE525 | 9534.1 | 0.18 | 0.672 | 6.16 | 1.40 | 0.249 | 25.20 |

TABLE 45-continued

Transgenic plants exogenously expressing the polynucleotides of some embodiments of the invention exhibit improved growth rate (RGR of rosette diameter and plot coverage) under standard nitrogen conditions

| Gene Name | Event # | RGR Of Rosette Diameter | | | RGR Of Plot Coverage | | |
|---|---|---|---|---|---|---|---|
| | | Ave. | P-Value | % incr. | Ave. | P-Value | % incr. |
| NUE525 | 9531.2 | 0.21 | 0.188 | 19.78 | 1.72 | 0.020 | 53.67 |
| NUE525 | 9533.1 | 0.21 | 0.239 | 18.66 | 1.63 | 0.060 | 45.89 |
| NUE525 | 9531.3 | 0.20 | 0.407 | 12.27 | 1.54 | 0.092 | 37.52 |
| NUE525 | 9533.4 | 0.20 | 0.308 | 16.23 | 1.52 | 0.125 | 36.12 |
| Control | | 0.17 | | | 1.12 | | |
| NUE536 | 9233.3 | 0.22 | 0.250 | 13.45 | 1.72 | 0.098 | 30.44 |
| NUE536 | 9234.1 | 0.23 | 0.068 | 21.81 | 1.93 | 0.016 | 46.81 |
| Control | | 0.19 | | | 1.32 | | |
| NUE545 | 9484.2 | 0.23 | 0.024 | 34.81 | 1.83 | 0.007 | 63.45 |
| NUE545 | 9482.4 | 0.18 | 0.741 | 5.45 | 1.42 | 0.281 | 26.57 |
| NUE545 | 9481.3 | 0.20 | 0.304 | 15.24 | 1.55 | 0.079 | 38.94 |
| NUE545 | 9484.4 | 0.21 | 0.215 | 18.52 | 1.59 | 0.068 | 41.88 |
| Control | | 0.17 | | | 1.12 | | |
| NUE568 | 9474.3 | 0.18 | 0.868 | 2.45 | 1.23 | 0.641 | 10.17 |
| NUE568 | 9471.3 | 0.17 | 0.853 | −2.69 | 1.35 | 0.345 | 20.52 |
| NUE568 | 9461.2 | 0.23 | 0.039 | 31.20 | 2.11 | 0.000 | 88.65 |
| NUE568 | 9474.4 | 0.18 | 0.947 | 0.98 | 1.24 | 0.624 | 10.72 |
| NUE568 | 9461.3 | 0.21 | 0.218 | 18.40 | 1.56 | 0.080 | 39.53 |
| Control | | 0.17 | | | 1.12 | | |
| NUE573 | 9491.4 | 0.19 | 0.582 | 8.00 | 1.50 | 0.121 | 34.11 |
| NUE573 | 9493.4 | 0.19 | 0.589 | 7.89 | 1.35 | 0.349 | 20.66 |
| NUE573 | 9491.2 | 0.21 | 0.222 | 18.90 | 1.64 | 0.042 | 46.75 |
| NUE573 | 9492.2 | 0.18 | 0.821 | 3.40 | 1.27 | 0.542 | 13.46 |
| Control | | 0.17 | | | 1.12 | | |
| NUE575 | 9504.1 | 0.21 | 0.196 | 19.39 | 1.64 | 0.040 | 47.00 |
| NUE575 | 9503.1 | 0.19 | 0.644 | 6.72 | 1.29 | 0.472 | 15.58 |
| NUE575 | 9502.1 | 0.19 | 0.637 | 7.16 | 1.33 | 0.439 | 19.10 |
| Control | | 0.17 | | | 1.12 | | |
| NUE578 | 9524.1 | 0.21 | 0.154 | 21.31 | 1.73 | 0.018 | 54.74 |
| NUE578 | 9524.3 | 0.21 | 0.302 | 19.94 | 1.67 | 0.073 | 49.17 |
| NUE578 | 9523.3 | 0.23 | 0.036 | 33.14 | 1.73 | 0.017 | 54.56 |
| NUE578 | 9522.3 | 0.19 | 0.472 | 10.54 | 1.71 | 0.024 | 52.52 |
| Control | | 0.17 | | | 1.12 | | |
| NUE580 | 9551.3 | 0.20 | 0.319 | 14.57 | 1.55 | 0.084 | 38.45 |
| NUE580 | 9554.4 | 0.18 | 0.764 | 4.75 | 1.55 | 0.094 | 38.64 |
| Control | | 0.17 | | | 1.12 | | |
| NUE582 | 9561.1 | 0.22 | 0.112 | 24.58 | 1.79 | 0.012 | 60.37 |
| NUE582 | 9562.1 | 0.19 | 0.548 | 9.10 | 1.38 | 0.300 | 23.28 |
| NUE582 | 9562.4 | 0.19 | 0.469 | 10.79 | 1.31 | 0.438 | 16.65 |
| NUE582 | 9561.2 | 0.20 | 0.325 | 16.03 | 1.72 | 0.031 | 54.06 |
| Control | | 0.17 | | | 1.12 | | |
| NUE585 | 9661.3 | 0.20 | 0.518 | 7.29 | 1.46 | 0.528 | 10.62 |
| NUE585 | 9661.1 | 0.22 | 0.142 | 17.93 | 2.00 | 0.007 | 52.30 |
| Control | | 0.19 | | | 1.32 | | |
| NUE588 | 9591.3 | 0.21 | 0.413 | 9.34 | 1.54 | 0.317 | 17.29 |
| Control | | 0.19 | | | 1.32 | | |

Table 45: Analyses of growth rate (RGR of rosette diameter and plot coverage) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM $KNO_3$, 1 mM $KH_2PO_4$, 1 mM $MgSO_4$, 2 mM $CaCl_2$ and microelements) as compared to control plants.

Example 7

Assay 3

Nitrogen Use Efficiency Measured Until Bolting Stage: Plant Biomass and Plant Growth Rate at Limited and Standard Nitrogen Concentration Under Greenhouse Conditions This assay follows seed yield production, the biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 1.5 mM inorganic nitrogen in the form of $KNO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $KNO_3$ with 1 mM $KH_2PO_4$, 1 mM $MgSO_4$, 2 mM $CaCl_2$ and microelements. All plants were grown in the greenhouse until mature seeds. Plant biomass (the above ground tissue) was weight immediately after harvesting the rosette (plant fresh weight [FW]). Following, plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, leaf blade area, plot coverage and leaf petiole area.

Vegetative Growth Rate: is the Rate of Growth of the Plant as Defined by Formula VIII, IX, X and XI as Described Above:

Relative growth rate of leaf blade area=Regression coefficient of leaf area along time course.   Formula VIII Relative growth rate of rosette area=Regression coefficient of rosette area along time course.   Formula IX Relative growth rate of rosette diameter=Regression coefficient of rosette diameter along time course.   Formula X Relative growth rate of plot coverage=Regression coefficient of plot coverage along time course.   Formula XI Plant Fresh and Dry Weight—

On about day 40 from sowing, the plants were harvested and directly weight for the determination of the plant fresh weight (FW) and left to dry at 50° C. in a drying chamber for about 48 hours before weighting to determine plant dry weight (DW).

Statistical Analyses—

To identify genes conferring significantly improved NUE, the results obtained from the transgenic plants were compared to those obtained from control plants. To identify outperforming genes and constructs, results from the independent transformation events tested are analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

The genes presented in Tables 46 and 47, hereinbelow, have improved plant NUE when grown under limiting nitrogen growth conditions, compared to control plants. These genes produced larger plants with a larger photosynthetic capacity when grown under limiting nitrogen conditions.

Tables 46 and 47 depict analyses of plant biomass and photosynthetic area (fresh weight, dry weight, rosette diameter, rosette area and plot coverage) when grown under limiting nitrogen conditions (1.5 mM $KNO_3$, 1 mM $KH_2PO_4$, 1 mM $MgSO_4$, 3.6 mM KCl, 2 mM $CaCl_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 46

Transgenic plants exogenously expressing the polynucleotides of some embodiments of the invention exhibit improved plant biomass (dry weight and fresh weight) under limiting nitrogen conditions

| Gene Name | Event # | Dry Weight [g] | | | Fresh Weight [g] | | |
| --- | --- | --- | --- | --- | --- | --- | --- |
| | | Average | P-Value | % increment | Average | P-Value | % increment |
| NUE227 | 9851.4 | 0.076 | 0.014 | 44.26 | 0.725 | 0.002 | 79.65 |
| NUE227 | 9854.2 | 0.059 | 0.202 | 12.33 | 0.569 | 0.000 | 40.93 |
| NUE227 | 9853.1 | 0.069 | 0.025 | 31.25 | 0.581 | 0.092 | 44.03 |
| NUE227 | 9851.1 | 0.063 | 0.052 | 19.43 | 0.581 | 0.205 | 44.03 |
| NUE227 | 9852.3 | 0.063 | 0.063 | 18.24 | 0.519 | 0.469 | 28.54 |
| Control | | 0.053 | | | 0.404 | | |
| NUE233 | 10173.5 | 0.035 | 0.055 | 34.48 | 0.243 | 0.838 | −1.89 |
| Control | | 0.026 | | | 0.248 | | |
| NUE256 | 10061.4 | 0.034 | 0.031 | 32.08 | | | |
| NUE256 | 10061.1 | 0.044 | 0.126 | 70.50 | 0.325 | 0.250 | 31.29 |
| Control | | 0.026 | | | 0.248 | | |
| NUE512 | 9284.2 | 0.044 | 0.417 | −17.23 | 0.419 | 0.794 | 3.76 |
| NUE512 | 9283.1 | 0.066 | 0.033 | 25.34 | 0.488 | 0.088 | 20.80 |
| NUE512 | 9284.3 | 0.052 | 0.900 | −1.86 | 0.469 | 0.566 | 16.15 |
| NUE512 | 9282.3 | 0.064 | 0.066 | 20.61 | 0.506 | 0.005 | 25.44 |
| NUE512 | 9283.3 | 0.063 | 0.247 | 18.24 | 0.538 | 0.002 | 33.19 |
| NUE512 | 9281.3 | 0.079 | 0.066 | 49.32 | 0.538 | 0.023 | 33.41 |
| Control | | 0.053 | | | 0.404 | | |
| NUE514 | 9403.5 | 0.050 | 0.581 | −5.41 | 0.388 | 0.807 | −3.98 |
| NUE514 | 9404.4 | 0.054 | 0.964 | 2.20 | 0.439 | 0.759 | 8.85 |
| NUE514 | 9402.2 | 0.056 | 0.468 | 6.42 | 0.594 | 0.000 | 47.12 |
| NUE514 | 9402.5 | 0.057 | 0.553 | 7.60 | 0.488 | 0.088 | 20.80 |
| Control | | 0.053 | | | 0.404 | | |
| NUE531 | 10082.2 | 0.042 | 0.001 | 62.84 | 0.235 | 0.976 | −5.26 |
| NUE531 | 10081.5 | 0.029 | 0.810 | 10.46 | 0.219 | 0.334 | −11.63 |
| Control | | 0.026 | | | 0.248 | | |
| NUE532 | 9222.4 | 0.069 | 0.066 | 31.25 | 0.606 | 0.296 | 50.22 |
| NUE532 | 9222.3 | 0.061 | 0.773 | 15.88 | 0.444 | 0.148 | 9.96 |
| NUE532 | 9222.1 | 0.064 | 0.570 | 20.61 | 0.525 | 0.117 | 30.09 |
| NUE532 | 9223.3 | 0.062 | 0.093 | 17.06 | 0.475 | 0.603 | 17.70 |
| NUE532 | 9224.4 | 0.035 | 0.007 | −32.94 | 0.467 | 0.037 | 15.71 |
| NUE532 | 9223.5 | 0.057 | 0.746 | 7.60 | 0.556 | 0.242 | 37.83 |
| Control | | 0.053 | | | 0.404 | | |
| NUE535 | 9086.2 | 0.056 | 0.915 | 5.24 | 0.550 | 0.477 | 36.28 |
| Control | | 0.053 | | | 0.404 | | |
| NUE537 | 9392.2 | 0.053 | 0.988 | 0.51 | 0.550 | 0.021 | 36.28 |
| NUE537 | 9393.2 | 0.055 | 0.847 | 3.72 | 0.589 | 0.065 | 46.02 |
| NUE537 | 9393.1 | 0.060 | 0.274 | 13.51 | 0.444 | 0.148 | 9.96 |
| NUE537 | 9393.3 | 0.068 | 0.033 | 28.89 | 0.575 | 0.014 | 42.48 |
| Control | | 0.053 | | | 0.404 | | |
| NUE576 | 9794.1 | 0.039 | 0.090 | 48.89 | 0.294 | 0.028 | 18.67 |
| Control | | 0.026 | | | 0.248 | | |
| NUE576 | 9791.3 | | | | 0.431 | 0.838 | 6.86 |
| NUE576 | 9792.4 | | | | 0.500 | 0.007 | 23.89 |

TABLE 46-continued

Transgenic plants exogenously expressing the polynucleotides of some embodiments of the invention exhibit improved plant biomass (dry weight and fresh weight) under limiting nitrogen conditions

| Gene | | Dry Weight [g] | | | Fresh Weight [g] | | |
|---|---|---|---|---|---|---|---|
| Name | Event # | Average | P-Value | % increment | Average | P-Value | % increment |
| NUE576 | 9792.3 | | | | 0.550 | 0.159 | 36.28 |
| Control | | | | | 0.404 | | |

Table 46: Analyses of plant biomass (dry and fresh weight) of transgenic plants overexpressing the exogenous polynucleotides of some embodiments of the invention (using the cloned or synthetic genes listed in Table 23 above) under the regulation of a constitutive promoter (35S) when grown under limiting nitrogen (1.5 mM KNO₃, 1 mM KH₂PO₄, 1 mM MgSO₄, 3.6 mM KCl, 2 mM CaCl₂ and microelements) as compared to control plants.

TABLE 47

Transgenic plants exogenously expressing the polynucleotides of some embodiments of the invention exhibit improved plant biomass (rosette diameter and area and plot coverage) under limiting nitrogen conditions

| Gene Name | Event # | Rosette Diameter [cm] | | | Rosette Area [cm²] | | | Plot Coverage [%] | | |
|---|---|---|---|---|---|---|---|---|---|---|
| | | Ave. | P-Value | % incr. | Ave. | P-Value | % incr. | Ave. | P-Value | % incr. |
| NUE227 | 9851.4 | 2.040 | 2.4E−02 | 48.28 | 1.477 | 7.6E−02 | 115.90 | 11.819 | 7.6E−02 | 115.90 |
| NUE227 | 9854.2 | 1.778 | 5.9E−02 | 29.24 | 1.070 | 7.0E−03 | 56.44 | 8.564 | 7.0E−03 | 56.44 |
| NUE227 | 9853.1 | 1.679 | 9.5E−02 | 22.03 | 0.979 | 1.1E−01 | 43.09 | 7.833 | 1.1E−01 | 43.09 |
| NUE227 | 9851.1 | 1.555 | 2.8E−01 | 13.03 | 0.915 | 2.8E−01 | 33.71 | 7.320 | 2.8E−01 | 33.71 |
| NUE227 | 9852.3 | 1.889 | 1.7E−01 | 37.33 | 1.298 | 1.8E−01 | 89.71 | 10.386 | 1.8E−01 | 89.71 |
| Control | | 1.376 | | | 0.684 | | | 5.474 | | |
| NUE233 | 10173.5 | 1.778 | 1.9E−01 | 7.66 | 1.080 | 3.2E−01 | 16.76 | 7.559 | 7.1E−01 | 5.15 |
| Control | | 1.651 | | | 0.925 | | | 7.189 | | |
| NUE256 | 10061.1 | 1.991 | 2.6E−03 | 20.56 | 1.333 | 2.7E−02 | 44.13 | 10.664 | 2.0E−02 | 48.34 |
| Control | | 1.651 | | | 0.925 | | | 7.189 | | |
| NUE512 | 9284.2 | 1.475 | 7.1E−01 | 7.21 | 0.794 | 7.0E−01 | 15.97 | 6.349 | 7.0E−01 | 15.97 |
| NUE512 | 9283.1 | 1.581 | 1.8E−01 | 14.91 | 0.916 | 2.6E−02 | 33.86 | 7.328 | 2.6E−02 | 33.86 |
| NUE512 | 9284.3 | 1.395 | 9.0E−01 | 1.41 | 0.719 | 8.2E−01 | 5.14 | 5.755 | 8.2E−01 | 5.14 |
| NUE512 | 9282.3 | 1.588 | 2.6E−01 | 15.43 | 0.928 | 6.3E−02 | 35.67 | 7.427 | 6.3E−02 | 35.67 |
| NUE512 | 9283.3 | 1.410 | 8.2E−01 | 2.50 | 0.789 | 3.9E−01 | 15.37 | 6.315 | 3.9E−01 | 5.37 |
| NUE512 | 9281.3 | 1.526 | 3.8E−01 | 10.94 | 0.824 | 4.1E−01 | 20.42 | 6.236 | 6.5E−01 | 13.91 |
| Control | | 1.376 | | | 0.684 | | | 5.474 | | |
| NUE514 | 9403.5 | 1.581 | 5.6E−01 | 14.93 | 0.901 | 5.4E−01 | 31.69 | 7.209 | 5.4E−01 | 31.69 |
| NUE514 | 9404.4 | 1.608 | 2.3E−01 | 16.92 | 0.930 | 2.0E−01 | 35.86 | 6.923 | 2.2E−02 | 26.47 |
| NUE514 | 9402.2 | 1.996 | 1.8E−01 | 45.07 | 1.395 | 1.5E−01 | 103.85 | 11.159 | 1.5E−01 | 103.85 |
| NUE514 | 9402.5 | 1.860 | 3.2E−01 | 35.21 | 1.160 | 3.2E−01 | 69.52 | 9.280 | 3.2E−01 | 69.52 |
| NUE514 | 9404.5 | 1.689 | 2.2E−01 | 22.77 | 1.006 | 4.7E−02 | 47.02 | 8.048 | 4.7E−02 | 47.02 |
| Control | | 1.376 | | | 0.684 | | | 5.474 | | |
| NUE527 | 9201.1 | 1.773 | 1.4E−02 | 28.89 | 1.109 | 9.3E−02 | 62.12 | 8.875 | 9.3E−02 | 62.12 |
| Control | | 1.376 | | | 0.684 | | | 5.474 | | |
| NUE531 | 10081.5 | 1.758 | 4.5E−01 | 6.49 | 1.043 | 5.1E−01 | 12.74 | 8.342 | 4.3E−01 | 16.04 |
| Control | | 1.651 | | | 0.925 | | | 7.189 | | |
| NUE532 | 9222.4 | 1.752 | 3.9E−01 | 27.34 | 1.056 | 4.4E−01 | 54.32 | 8.448 | 4.4E−01 | 54.32 |
| NUE532 | 9222.3 | 1.668 | 4.6E−04 | 21.24 | 1.034 | 8.3E−05 | 51.08 | 8.270 | 8.3E−05 | 51.08 |
| NUE532 | 9222.1 | 1.623 | 3.8E−01 | 17.95 | 1.016 | 2.8E−01 | 48.52 | 8.130 | 2.8E−01 | 48.52 |
| NUE532 | 9223.3 | 1.585 | 5.5E−03 | 15.23 | 0.902 | 6.2E−03 | 31.88 | 7.219 | 6.2E−03 | 31.88 |
| NUE532 | 9224.4 | 1.732 | 1.4E−04 | 25.88 | 1.060 | 6.5E−05 | 54.91 | 7.941 | 2.3E−02 | 45.06 |
| NUE532 | 9223.5 | 1.899 | 7.1E−02 | 38.02 | 1.294 | 3.2E−02 | 89.11 | 10.353 | 3.2E−02 | 89.11 |
| Control | | 1.376 | | | 0.684 | | | 5.474 | | |
| NUE535 | 9086.2 | 1.696 | 2.2E−01 | 23.27 | 0.938 | 2.2E−01 | 37.03 | 7.502 | 2.2E−01 | 37.03 |
| NUE535 | 9084.2 | 1.463 | 6.4E−01 | 6.35 | 0.827 | 4.3E−01 | 20.92 | 6.270 | 4.3E−01 | 20.92 |
| NUE535 | 9081.1 | 1.521 | 3.3E−01 | 10.57 | 0.823 | 3.0E−01 | 20.21 | 6.581 | 3.0E−01 | 20.21 |
| NUE535 | 9082.1 | 1.432 | 5.6E−01 | 4.10 | 0.742 | 3.8E−01 | 8.46 | 5.938 | 3.8E−01 | 8.46 |
| Control | | 1.376 | | | 0.684 | | | 5.474 | | |
| NUE537 | 9391.1 | 1.503 | 5.2E−01 | 9.24 | 0.807 | 3.8E−01 | 17.86 | 6.452 | 3.8E−01 | 17.86 |
| NUE537 | 9392.2 | 1.475 | 4.9E−01 | 7.21 | 0.851 | 3.4E−01 | 24.32 | 6.806 | 3.4E−01 | 24.32 |
| NUE537 | 9393.2 | 1.532 | 8.5E−03 | 11.34 | 0.955 | 4.1E−04 | 39.59 | 7.157 | 4.5E−02 | 30.73 |
| NUE537 | 9393.1 | 1.856 | 1.7E−03 | 34.95 | 1.225 | 7.0E−05 | 78.96 | 9.797 | 7.0E−05 | 78.96 |
| NUE537 | 9392.3 | 1.429 | 8.3E−01 | 3.89 | 0.784 | 7.3E−01 | 14.54 | 6.270 | 7.3E−01 | 14.54 |
| NUE537 | 9393.3 | 1.739 | 5.3E−02 | 26.42 | 1.092 | 1.5E−02 | 59.52 | 8.733 | 1.5E−02 | 59.52 |
| Control | | 1.376 | | | 0.684 | | | 5.474 | | |
| NUE576 | 9794.1 | 1.963 | 1.5E−01 | 18.86 | 1.350 | 2.3E−01 | 45.96 | 10.800 | 2.1E−01 | 50.23 |
| Control | | 1.651 | | | 0.925 | | | 7.189 | | |
| NUE576 | 9791.3 | 1.416 | 8.6E−01 | 2.94 | 0.753 | 7.4E−01 | 10.01 | 6.022 | 7.4E−01 | 10.01 |

TABLE 47-continued

Transgenic plants exogenously expressing the polynucleotides of some embodiments of the invention exhibit improved plant biomass (rosette diameter and area and plot coverage) under limiting nitrogen conditions

| Gene Name | Event # | Rosette Diameter [cm] | | | Rosette Area [cm²] | | | Plot Coverage [%] | | |
|---|---|---|---|---|---|---|---|---|---|---|
| | | Ave. | P-Value | % incr. | Ave. | P-Value | % incr. | Ave. | P-Value | % incr. |
| NUE576 | 9792.4 | 1.826 | 2.1E−05 | 32.75 | 1.204 | 2.4E−04 | 75.90 | 9.629 | 2.4E−04 | 75.90 |
| NUE576 | 9792.3 | 1.912 | 5.4E−06 | 39.03 | 1.208 | 1.1E−05 | 76.46 | 9.660 | 1.1E−05 | 76.46 |
| Control | | 1.376 | | | 0.684 | | | 5.474 | | |

Table 47: Analyses of plant biomass (rosette diameter and area and plot coverage) of transgenic plants overexpressing the exogenous polynucleotides of some embodiments of the invention (using the cloned or synthetic genes listed in Table 23 above) under the regulation of a constitutive promoter (35S) when grown under limiting nitrogen (1.5 mM KNO₃, 1 mM KH₂PO₄, 1 mM MgSO₄, 3.6 mM KCl, 2 mM CaCl₂ and microelements) as compared to control plants.

The genes presented in Table 48, hereinbelow, have improved plant NUE when grown under limiting nitrogen growth conditions, compared to control plants. These genes produced larger photosynthetic areas as it can be observed by their larger leaf number, leaf blade area and petiole area.

Table 48 depicts analyses of plant photosynthetic area (leaf number, leaf blade area and petiole area) when grown under limiting nitrogen conditions (1.5 mM KNO₃, 1 mM KH₂PO₄, 1 mM MgSO₄, 3.6 mM KCl, 2 mM CaCl₂ and microelements) in plants overexpressing the polynucleotides of some embodiments of the invention under the regulation of a constitutive promoter (35S)). Evaluation of each gene was performed by testing the performance of several events. Some of the genes were evaluated in more than one tissue culture assay and the results obtained were repeated. Event with p-value<0.1 was considered statistically significant.

TABLE 48

Transgenic plants exogenously expressing the polynucleotides of some embodiments of the invention exhibit improved photosynthetic area (leaf number, leaf blade area and petiole area) under limiting nitrogen conditions

| Gene Name | Event # | Leaf Number | | | Leaf Blade Area [cm²] | | | Leaf Petiole Length [cm] | | |
|---|---|---|---|---|---|---|---|---|---|---|
| | | Ave. | P-Value | % incr. | Ave. | P-Value | % incr. | Ave. | P-Value | % incr. |
| NUE227 | 9851.4 | 8.56 | 1.9E−02 | 16.38 | 0.24 | 4.6E−02 | 108.44 | 0.38 | 6.5E−02 | 69.59 |
| NUE227 | 9854.2 | 7.63 | 1.5E−01 | 3.64 | 0.19 | 5.8E−03 | 67.63 | 0.32 | 1.2E−04 | 41.44 |
| NUE227 | 9853.1 | 7.81 | 3.5E−02 | 6.19 | 0.17 | 2.2E−01 | 49.04 | 0.26 | 3.8E−02 | 14.04 |
| NUE227 | 9851.1 | 7.69 | 2.8E−01 | 4.49 | 0.16 | 2.9E−01 | 35.75 | 0.24 | 4.7E−01 | 5.61 |
| NUE227 | 9852.3 | 8.50 | 2.4E−01 | 15.53 | 0.21 | 1.1E−01 | 82.96 | 0.32 | 4.4E−01 | 41.85 |
| Control | | 7.36 | | | 0.11 | | | 0.22 | | |
| NUE233 | 10173.5 | 7.79 | 6.0E−01 | 2.05 | 0.19 | 4.0E−01 | 15.50 | 0.26 | 5.8E−01 | 8.27 |
| Control | | 7.63 | | | 0.17 | | | 0.24 | | |
| NUE256 | 10061.1 | 8.13 | 2.5E−01 | 6.50 | 0.23 | 8.4E−02 | 39.00 | 0.31 | 2.0E−01 | 30.30 |
| Control | | 7.63 | | | 0.17 | | | 0.24 | | |
| NUE512 | 9283.1 | 7.63 | 2.5E−01 | 3.64 | 0.16 | 7.0E−02 | 42.74 | 0.24 | 1.2E−01 | 8.56 |
| NUE512 | 9284.3 | 6.88 | 5.0E−01 | −6.55 | 0.13 | 4.9E−01 | 15.53 | 0.21 | 8.3E−01 | −5.04 |
| NUE512 | 9282.3 | 7.38 | 9.8E−01 | 0.24 | 0.16 | 3.9E−02 | 41.04 | 0.26 | 5.5E−01 | 14.40 |
| NUE512 | 9283.3 | 7.56 | 6.3E−01 | 2.79 | 0.13 | 6.1E−01 | 12.00 | 0.25 | 6.2E−02 | 11.05 |
| NUE512 | 9281.3 | 7.08 | 7.9E−01 | −3.76 | 0.15 | 3.8E−02 | 31.49 | 0.23 | 9.9E−01 | 0.30 |
| Control | | 7.36 | | | 0.11 | | | 0.22 | | |
| NUE514 | 9403.5 | 7.31 | 8.7E−01 | −0.61 | 0.16 | 5.0E−01 | 35.23 | 0.28 | 4.7E−01 | 25.62 |
| NUE514 | 9404.4 | 8.04 | 4.1E−01 | 9.22 | 0.14 | 1.2E−01 | 25.05 | 0.26 | 1.1E−02 | 17.01 |
| NUE514 | 9402.2 | 8.75 | 2.5E−01 | 18.93 | 0.22 | 1.4E−01 | 89.22 | 0.35 | 3.1E−01 | 55.03 |
| NUE514 | 9402.5 | 8.38 | 2.7E−01 | 13.83 | 0.19 | 3.3E−01 | 63.94 | 0.32 | 3.1E−01 | 42.26 |
| NUE514 | 9404.5 | 8.56 | 1.0E−01 | 16.38 | 0.16 | 3.9E−02 | 37.00 | 0.30 | 3.7E−01 | 31.67 |
| Control | | 7.36 | | | 0.11 | | | 0.22 | | |
| NUE527 | 9201.1 | 8.19 | 2.0E−03 | 11.29 | 0.17 | 1.3E−01 | 49.68 | 0.33 | 1.7E−03 | 45.43 |
| NUE527 | 9201.2 | 6.94 | 6.5E−01 | −5.70 | 0.12 | 5.8E−01 | 7.58 | 0.22 | 9.3E−01 | −1.31 |
| Control | | 7.36 | | | 0.11 | | | 0.22 | | |
| NUE531 | 10082.2 | 8.24 | 7.1E−02 | 7.98 | 0.15 | 2.3E−01 | −12.84 | 0.27 | 3.9E−01 | 13.71 |
| NUE531 | 10081.5 | 8.31 | 4.4E−02 | 8.95 | 0.17 | 9.4E−01 | 1.15 | 0.27 | 3.2E−02 | 15.99 |
| Control | | 7.63 | | | 0.17 | | | 0.24 | | |
| NUE532 | 9222.4 | 7.56 | 8.4E−01 | 2.79 | 0.17 | 4.2E−01 | 51.79 | 0.30 | 4.1E−01 | 32.08 |
| NUE532 | 9222.3 | 8.31 | 3.5E−02 | 12.99 | 0.16 | 2.5E−05 | 41.75 | 0.29 | 1.5E−03 | 30.67 |
| NUE532 | 9222.1 | 7.94 | 1.1E−01 | 7.89 | 0.16 | 2.6E−01 | 40.64 | 0.27 | 5.0E−01 | 21.12 |
| NUE532 | 9223.3 | 7.31 | 9.4E−01 | −0.61 | 0.15 | 2.6E−01 | 32.70 | 0.28 | 1.5E−03 | 26.20 |
| NUE532 | 9224.4 | 8.27 | 1.3E−03 | 12.38 | 0.16 | 3.4E−02 | 41.63 | 0.32 | 6.8E−02 | 43.77 |
| NUE532 | 9223.5 | 8.25 | 9.8E−02 | 12.14 | 0.20 | 1.5E−20 | 72.88 | 0.35 | 1.5E−02 | 58.06 |
| Control | | 7.36 | | | 0.11 | | | 0.22 | | |
| NUE535 | 9086.2 | 7.75 | 5.7E−01 | 5.34 | 0.16 | 2.0E−01 | 37.02 | 0.34 | 2.1E−01 | 52.44 |
| NUE535 | 9084.2 | 6.88 | 4.0E−01 | −6.55 | 0.15 | 2.4E−01 | 28.20 | 0.23 | 8.7E−01 | 2.43 |
| NUE535 | 9081.1 | 8.31 | 1.4E−01 | 12.99 | 0.13 | 4.7E−01 | 12.91 | 0.28 | 2.6E−03 | 25.65 |
| NUE535 | 9082.1 | 7.25 | 6.2E−01 | −1.46 | 0.13 | 2.5E−02 | 12.04 | 0.26 | 4.5E−01 | 14.26 |
| Control | | 7.36 | | | 0.11 | | | 0.22 | | |

TABLE 48-continued

Transgenic plants exogenously expressing the polynucleotides of some embodiments of the invention exhibit improved photosynthetic area (leaf number, leaf blade area and petiole area) under limiting nitrogen conditions

| Gene Name | Event # | Leaf Number | | | Leaf Blade Area [cm$^2$] | | | Leaf Petiole Length [cm] | | |
|---|---|---|---|---|---|---|---|---|---|---|
| | | Ave. | P-Value | % incr. | Ave. | P-Value | % incr. | Ave. | P-Value | % incr. |
| NUE537 | 9391.1 | 7.81 | 4.8E−01 | 6.19 | 0.14 | 2.6E−01 | 23.28 | 0.25 | 5.7E−01 | 11.88 |
| NUE537 | 9392.2 | 7.31 | 9.4E−01 | −0.61 | 0.14 | 2.9E−01 | 25.68 | 0.26 | 4.1E−01 | 14.53 |
| NUE537 | 9393.2 | 7.56 | 7.2E−01 | 2.79 | 0.15 | 2.2E−02 | 33.42 | 0.24 | 5.1E−01 | 4.72 |
| NUE537 | 9393.1 | 8.63 | 1.7E−03 | 17.23 | 0.19 | 4.6E−02 | 69.46 | 0.34 | 4.7E−04 | 52.73 |
| NUE537 | 9392.3 | 7.19 | 8.5E−01 | −2.31 | 0.13 | 7.3E−01 | 10.02 | 0.25 | 7.4E−01 | 11.68 |
| NUE537 | 9393.3 | 8.00 | 4.8E−01 | 8.74 | 0.18 | 2.6E−02 | 56.70 | 0.30 | 3.1E−04 | 33.39 |
| Control | | 7.36 | | | 0.11 | | | 0.22 | | |
| NUE576 | 9794.1 | 8.13 | 5.7E−01 | 6.50 | 0.24 | 1.4E−01 | 42.20 | 0.30 | 5.0E−01 | 28.80 |
| Control | | 7.63 | | | 0.17 | | | 0.24 | | |
| NUE576 | 9791.3 | 7.00 | 6.7E−01 | −4.85 | 0.13 | 6.3E−01 | 15.21 | 0.24 | 8.0E−01 | 7.24 |
| NUE576 | 9792.4 | 8.75 | 1.1E−03 | 18.93 | 0.18 | 1.4E−04 | 55.06 | 0.35 | 2.8E−02 | 56.82 |
| NUE576 | 9792.3 | 8.06 | 2.1E−01 | 9.59 | 0.20 | 2.9E−05 | 71.82 | 0.34 | 9.6E−04 | 52.50 |
| Control | | 7.36 | | | 0.11 | | | 0.22 | | |

Table 48: Analyses of photosynthetic area (leaf number, leaf blade area and petiole area) of transgenic plants overexpressing the exogenous polynucleotides of some embodiments of the invention (using the cloned or synthetic genes listed in Table 23 above) under the regulation of a constitutive promoter (35S) when grown under limiting nitrogen (1.5 mM KNO$_3$, 1 mM KH$_2$PO$_4$, 1 mM MgSO$_4$, 3.6 mM KCl, 2 mM CaCl$_2$ and microelements) as compared to control plants.

The genes presented in Table 49, hereinbelow, have improved plant growth rate when grown at limiting nitrogen fertilization levels. These genes improved the growth rate of the rosette and faster covered the soil when grown under limiting nitrogen growth conditions, compared to control plants. These genes produced faster growing plants showing a better utilization of the nitrogen present.

Table 49 depicts analyses of the growth rate of the rosette diameter, rosette area, leaf blade area, leaf number and plot coverage when grown under standard nitrogen conditions when grown under limiting nitrogen conditions (1.5 mM KNO$_3$, 1 mM KH$_2$PO$_4$, 1 mM MgSO$_4$, 3.6 mM KCl, 2 mM CaCl$_2$ and microelements) in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 49

Transgenic plants exogenously expressing the polynucleotides of some embodiments of the invention exhibit improved rosette growth performance (RGR of rosette area and diameter and plot coverage) under limiting nitrogen conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Value | % incr. | Ave. | P-Value | % incr. | Ave. | P-Value | % incr. |
| NUE227 | 9851.4 | 0.183 | 2.6E−05 | 118.89 | 0.189 | 2.0E−03 | 44.11 | 1.462 | 2.6E−05 | 118.89 |
| NUE227 | 9854.2 | 0.133 | 7.4E−03 | 59.50 | 0.172 | 2.0E−02 | 31.13 | 1.066 | 7.4E−03 | 59.50 |
| NUE227 | 9853.1 | 0.120 | 4.6E−02 | 43.12 | 0.157 | 1.2E−01 | 19.92 | 0.956 | 4.6E−02 | 43.12 |
| NUE227 | 9851.1 | 0.112 | 1.2E−01 | 33.76 | 0.152 | 2.5E−01 | 15.45 | 0.894 | 1.2E−01 | 33.76 |
| NUE227 | 9852.3 | 0.161 | 5.4E−04 | 93.37 | 0.174 | 2.5E−02 | 32.77 | 1.292 | 5.4E−04 | 93.37 |
| Control | | 0.084 | | | 0.131 | | | 0.668 | | |
| NUE256 | 10063.4 | 0.132 | 5.2E−01 | 11.42 | 0.132 | 7.1E−01 | −6.29 | 0.923 | 9.8E−01 | 0.41 |
| NUE256 | 10061.1 | 0.167 | 1.2E−02 | 40.75 | 0.160 | 4.0E−01 | 13.13 | 1.332 | 1.2E−02 | 44.97 |
| Control | | 0.118 | | | 0.141 | | | 0.919 | | |
| NUE512 | 9284.2 | 0.100 | 3.9E−01 | 19.99 | 0.142 | 5.7E−01 | 8.06 | 0.802 | 3.9E−01 | 19.99 |
| NUE512 | 9283.1 | 0.115 | 7.3E−02 | 37.78 | 0.150 | 2.7E−01 | 14.31 | 0.920 | 7.3E−02 | 37.78 |
| NUE512 | 9284.3 | 0.091 | 6.8E−01 | 8.61 | 0.136 | 7.8E−01 | 3.59 | 0.726 | 6.8E−01 | 8.61 |
| NUE512 | 9282.3 | 0.116 | 6.6E−02 | 38.73 | 0.151 | 2.8E−01 | 14.64 | 0.927 | 6.6E−02 | 38.73 |
| NUE512 | 9283.3 | 0.098 | 4.0E−01 | 17.73 | 0.125 | 6.8E−01 | −5.14 | 0.787 | 4.0E−01 | 17.73 |
| NUE512 | 9281.3 | 0.103 | 2.5E−01 | 23.92 | 0.140 | 6.0E−01 | 6.87 | 0.783 | 4.2E−01 | 17.24 |
| Control | | 0.084 | | | 0.131 | | | 0.668 | | |
| NUE514 | 9403.5 | 0.108 | 2.4E−01 | 28.84 | 0.137 | 7.8E−01 | 4.40 | 0.861 | 2.4E−01 | 28.84 |
| NUE514 | 9404.4 | 0.117 | 6.4E−02 | 39.59 | 0.155 | 1.6E−01 | 17.67 | 0.869 | 1.4E−01 | 30.04 |
| NUE514 | 9402.2 | 0.177 | 8.9E−05 | 111.43 | 0.195 | 1.5E−03 | 48.26 | 1.412 | 8.9E−05 | 111.43 |
| NUE514 | 9403.2 | 0.105 | 3.4E−01 | 26.02 | 0.140 | 7.1E−01 | 6.57 | 0.842 | 3.4E−01 | 26.02 |
| NUE514 | 9402.5 | 0.144 | 8.3E−03 | 72.44 | 0.180 | 2.7E−02 | 37.10 | 1.152 | 8.3E−03 | 72.44 |
| NUE514 | 9404.5 | 0.126 | 1.8E−02 | 50.85 | 0.164 | 6.6E−02 | 24.82 | 1.008 | 1.8E−02 | 50.85 |
| Control | | 0.084 | | | 0.131 | | | 0.668 | | |
| NUE527 | 9201.1 | 0.131 | 1.5E−02 | 56.83 | 0.146 | 3.8E−01 | 11.45 | 1.048 | 1.5E−02 | 56.83 |
| Control | | 0.084 | | | 0.131 | | | 0.668 | | |
| NUE532 | 9222.4 | 0.132 | 3.4E−02 | 58.62 | 0.177 | 4.2E−02 | 34.79 | 1.060 | 3.4E−02 | 58.62 |
| NUE532 | 9222.3 | 0.124 | 2.7E−02 | 48.99 | 0.148 | 3.2E−01 | 12.66 | 0.995 | 2.7E−02 | 48.99 |

TABLE 49-continued

Transgenic plants exogenously expressing the polynucleotides of some embodiments of the invention exhibit improved rosette growth performance (RGR of rosette area and diameter and plot coverage) under limiting nitrogen conditions

| Gene Name | Event # | RGR Of Rosette Area | | | RGR Of Rosette Diameter | | | RGR Of Plot Coverage | | |
|---|---|---|---|---|---|---|---|---|---|---|
| | | Ave. | P-Value | % incr. | Ave. | P-Value | % incr. | Ave. | P-Value | % incr. |
| NUE532 | 9222.1 | 0.124 | 3.9E−02 | 48.48 | 0.153 | 2.5E−01 | 16.37 | 0.992 | 3.9E−02 | 48.48 |
| NUE532 | 9223.3 | 0.106 | 2.0E−01 | 26.75 | 0.135 | 8.3E−01 | 2.62 | 0.847 | 2.0E−01 | 26.75 |
| NUE532 | 9224.4 | 0.132 | 9.5E−03 | 58.37 | 0.159 | 1.0E−01 | 21.08 | 0.991 | 2.7E−02 | 48.37 |
| NUE532 | 9223.5 | 0.162 | 1.4E−04 | 94.31 | 0.169 | 3.4E−02 | 28.67 | 1.298 | 1.4E−04 | 94.31 |
| Control | | 0.084 | | | 0.131 | | | 0.668 | | |
| NUE535 | 9086.2 | 0.118 | 6.7E−02 | 40.98 | 0.169 | 3.7E−02 | 28.72 | 0.942 | 6.7E−02 | 40.98 |
| NUE535 | 9084.2 | 0.103 | 2.6E−01 | 23.65 | 0.138 | 7.0E−01 | 4.93 | 0.826 | 2.6E−01 | 23.65 |
| NUE535 | 9081.1 | 0.101 | 3.1E−01 | 20.62 | 0.137 | 7.2E−01 | 4.66 | 0.806 | 3.1E−01 | 20.62 |
| Control | | 0.084 | | | 0.131 | | | 0.668 | | |
| NUE537 | 9391.1 | 0.101 | 3.0E−01 | 20.89 | 0.143 | 5.1E−01 | 8.62 | 0.808 | 3.0E−01 | 20.89 |
| NUE537 | 9392.2 | 0.107 | 1.9E−01 | 27.77 | 0.142 | 5.0E−01 | 8.29 | 0.854 | 1.9E−01 | 27.77 |
| NUE537 | 9393.2 | 0.120 | 4.4E−02 | 43.18 | 0.135 | 8.3E−01 | 2.61 | 0.894 | 1.1E−01 | 33.89 |
| NUE537 | 9393.1 | 0.156 | 5.1E−04 | 86.73 | 0.198 | 2.4E−04 | 50.58 | 1.247 | 5.1E−04 | 86.73 |
| NUE537 | 9392.3 | 0.101 | 3.8E−01 | 20.36 | 0.140 | 6.6E−01 | 6.28 | 0.804 | 3.8E−01 | 20.36 |
| NUE537 | 9393.3 | 0.133 | 1.0E−02 | 59.56 | 0.162 | 7.9E−02 | 23.54 | 1.066 | 1.0E−02 | 59.56 |
| Control | | 0.084 | | | 0.131 | | | 0.668 | | |
| NUE576 | 9793.4 | 0.163 | 1.1E−01 | 37.49 | 0.157 | 5.5E−01 | 11.44 | 1.139 | 3.0E−01 | 23.91 |
| NUE576 | 9792.4 | 0.139 | 2.6E−01 | 17.71 | 0.167 | 2.7E−01 | 18.29 | 1.047 | 4.2E−01 | 13.98 |
| NUE576 | 9794.1 | 0.168 | 1.7E−02 | 41.95 | 0.161 | 4.0E−01 | 14.09 | 1.343 | 1.6E−02 | 46.20 |
| Control | | 0.118 | | | 0.141 | | | 0.919 | | |
| NUE576 | 9792.4 | 0.150 | 8.5E−04 | 79.96 | 0.162 | 6.5E−02 | 23.36 | 1.202 | 8.5E−04 | 79.96 |
| NUE576 | 9792.3 | 0.149 | 1.2E−03 | 78.96 | 0.177 | 1.3E−02 | 34.59 | 1.196 | 1.2E−03 | 78.96 |
| NUE576 | 9794.1 | 0.095 | 5.1E−01 | 14.23 | 0.145 | 4.7E−01 | 10.57 | 0.763 | 5.1E−01 | 14.23 |
| NUE576 | 9793.3 | 0.104 | 2.4E−01 | 24.59 | 0.140 | 6.4E−01 | 6.33 | 0.771 | 4.4E−01 | 15.45 |
| Control | | 0.084 | | | 0.131 | | | 0.668 | | |

Table 49: Analyses of rosette growth performance (RGR of rosette area and diameter and plot coverage) of transgenic plants overexpressing the exogenous polynucleotides of some embodiments of the invention (using the cloned or synthetic genes listed in Table 23 above) under the regulation of a constitutive promoter (35S) when grown under limiting nitrogen (1.5 mM $KNO_3$, 1 mM $KH_2PO_4$, 1 mM $MgSO_4$, 3.6 mM KCl, 2 mM $CaCl_2$ and microelements) as compared to control plants.

The genes presented in Tables 50 and 51, hereinbelow, have improved plant NUE when grown under standard nitrogen growth conditions, compared to control plants. These genes produced larger plants with a larger photosynthetic area when grown under standard nitrogen growth conditions, compared to control plants.

Tables 50 and 51 depicts analyses of plant biomass (fresh weight, dry weight, rosette diameter, rosette area and plot coverage) when grown under standard nitrogen conditions (6 mM $KNO_3$, 1 mM $KH_2PO_4$, 1 mM $MgSO_4$, 2 mM $CaCl_2$ and microelements) in plants overexpressing the polynucleotides of some embodiments of the invention under the regulation of a constitutive promoter (35S)). Evaluation of each gene was performed by testing the performance of several events. Some of the genes were evaluated in more than one tissue culture assay and the results obtained were repeated. Event with p-value<0.1 was considered statistically significant.

TABLE 50

Transgenic plants exogenously expressing the polynucleotides of some embodiments of the invention exhibit improved plant biomass (dry weight and fresh weight) under standard nitrogen conditions

| Gene Name | Event # | Dry Weight | | | Fresh Weight | | |
|---|---|---|---|---|---|---|---|
| | | Ave. | P-Value | % increment | Ave. | P-Value | % increment |
| NUE227 | 9851.4 | 0.170 | 1.8E−01 | 18.41 | 1.631 | 2.1E−01 | 12.64 |
| NUE227 | 9854.2 | 0.163 | 1.7E−01 | 13.18 | 1.744 | 2.1E−02 | 20.41 |
| NUE227 | 9853.1 | 0.202 | 2.1E−01 | 40.61 | 2.019 | 1.9E−02 | 39.40 |
| NUE227 | 9852.3 | 0.199 | 2.6E−01 | 38.87 | 1.794 | 3.7E−01 | 23.86 |
| Control | | 0.144 | | | 1.448 | | |
| NUE233 | 10174.3 | 0.128 | 1.3E−01 | 21.58 | 1.206 | 1.0E−01 | 19.80 |
| NUE233 | 10173.7 | 0.143 | 1.4E−02 | 36.31 | 1.210 | 3.8E−01 | 20.15 |
| Control | | 0.105 | | | 1.007 | | |
| NUE256 | 10063.4 | 0.139 | 4.0E−01 | 32.65 | 1.363 | 1.6E−01 | 35.31 |
| NUE256 | 10061.3 | 0.118 | 5.8E−01 | 12.64 | 1.025 | 9.2E−01 | 1.80 |
| Control | | 0.105 | | | 1.007 | | |
| NUE512 | 9282.3 | 0.177 | 2.0E−01 | 23.20 | 1.881 | 2.8E−03 | 29.90 |
| Control | | 0.144 | | | 1.448 | | |
| NUE514 | 9403.5 | 0.168 | 2.3E−02 | 17.10 | 1.556 | 5.9E−01 | 7.46 |
| NUE514 | 9402.2 | 0.161 | 2.2E−01 | 11.88 | 1.769 | 3.7E−02 | 22.13 |
| NUE514 | 9404.5 | 0.153 | 5.0E−01 | 6.65 | 1.531 | 3.9E−01 | 5.73 |
| NUE514 | 9402.5 | 0.171 | 1.7E−01 | 19.28 | 1.488 | 7.3E−01 | 2.71 |
| Control | | 0.144 | | | 1.448 | | |

TABLE 50-continued

Transgenic plants exogenously expressing the polynucleotides of some embodiments of the invention exhibit improved plant biomass (dry weight and fresh weight) under standard nitrogen conditions

| Gene Name | Event # | Dry Weight | | | Fresh Weight | | |
|---|---|---|---|---|---|---|---|
| | | Ave. | P-Value | % increment | Ave. | P-Value | % increment |
| NUE531 | 10081.5 | 0.115 | 5.2E−01 | 10.00 | 1.086 | 5.9E−01 | 7.83 |
| Control | | 0.105 | | | 1.007 | | |
| NUE532 | 9222.4 | 0.175 | 4.9E−01 | 21.89 | 1.750 | 3.4E−01 | 20.84 |
| NUE532 | 9223.3 | 0.156 | 2.3E−01 | 8.83 | 1.556 | 2.8E−01 | 7.46 |
| NUE532 | 9223.5 | 0.164 | 4.4E−01 | 14.05 | 1.669 | 5.3E−02 | 15.23 |
| Control | | 0.144 | | | 1.448 | | |
| NUE537 | 9391.1 | 0.178 | 1.3E−01 | 24.07 | 1.669 | 4.8E−02 | 15.23 |
| NUE537 | 9393.1 | 0.168 | 2.4E−01 | 16.92 | 1.743 | 3.2E−02 | 20.35 |
| Control | | 0.144 | | | 1.448 | | |

Table 50: Analyses of plant biomass (dry weight and fresh weight) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM $KNO_3$, 1 mM $KH_2PO_4$, 1 mM $MgSO_4$, 2 mM $CaCl_2$ and microelements) as compared to control plants.
"Ave." = average.

TABLE 51

Transgenic plants exogenously expressing the polynucleotides of some embodiments of the invention exhibit improved plant biomass (rosette diameter and area and plot coverage) under standard nitrogen conditions

| Gene Name | Event # | Rosette Diameter | | | Rosette Area | | | Plot Coverage | | |
|---|---|---|---|---|---|---|---|---|---|---|
| | | Ave. | P-Value | % incr. | Ave. | P-Value | % incr. | Ave. | P-Value | % incr. |
| NUE227 | 9851.4 | 1.82 | 8.6E−01 | −1.70 | 1.29 | 3.5E−01 | 9.98 | 10.30 | 3.5E−01 | 9.98 |
| NUE227 | 9854.2 | 2.13 | 7.6E−02 | 14.82 | 1.40 | 2.1E−01 | 19.82 | 11.22 | 2.1E−01 | 19.82 |
| NUE227 | 9853.1 | 1.96 | 6.1E−01 | 5.70 | 1.45 | 1.8E−01 | 23.64 | 11.58 | 1.8E−01 | 23.64 |
| NUE227 | 9852.3 | 1.94 | 5.9E−01 | 4.72 | 1.40 | 5.8E−01 | 19.24 | 11.17 | 5.8E−01 | 19.24 |
| Control | | 1.85 | | | 1.17 | | | 9.37 | | |
| NUE233 | 10174.3 | 2.69 | 2.8E−01 | 12.27 | 2.54 | 3.0E−01 | 24.73 | 20.36 | 2.7E−01 | 27.64 |
| NUE233 | 10173.7 | 2.61 | 4.7E−01 | 9.02 | 2.49 | 4.0E−01 | 22.00 | 18.84 | 5.9E−01 | 18.14 |
| Control | | 2.40 | | | 2.04 | | | 15.95 | | |
| NUE256 | 10063.4 | 3.37 | 1.5E−03 | 40.59 | 3.25 | 1.4E−01 | 59.40 | 24.17 | 2.9E−02 | 51.58 |
| NUE256 | 10061.3 | 2.89 | 3.3E−01 | 20.50 | 2.38 | 5.8E−01 | 16.48 | 19.01 | 5.3E−01 | 19.20 |
| Control | | 2.40 | | | 2.04 | | | 15.95 | | |
| NUE512 | 9282.3 | 2.08 | 3.8E−02 | 12.43 | 1.38 | 1.3E−01 | 18.07 | 11.06 | 1.3E−01 | 18.07 |
| Control | | 1.85 | | | 1.17 | | | 9.37 | | |
| NUE514 | 9403.5 | 2.14 | 1.9E−02 | 15.56 | 1.44 | 6.0E−02 | 23.37 | 11.56 | 6.0E−02 | 23.37 |
| NUE514 | 9402.2 | 2.03 | 9.8E−02 | 9.60 | 1.46 | 5.4E−02 | 24.90 | 11.70 | 5.4E−02 | 24.90 |
| NUE514 | 9404.5 | 2.13 | 2.1E−02 | 14.76 | 1.56 | 1.6E−02 | 32.88 | 12.45 | 1.6E−02 | 32.88 |
| NUE514 | 9402.5 | 2.15 | 3.9E−02 | 16.09 | 1.45 | 5.6E−02 | 23.83 | 11.60 | 5.6E−02 | 23.83 |
| Control | | 1.85 | | | 1.17 | | | 9.37 | | |
| NUE531 | 10081.5 | 2.78 | 1.5E−01 | 16.08 | 2.50 | 2.5E−01 | 22.65 | 18.66 | 3.0E−01 | 17.01 |
| NUE531 | 10083.2 | 2.99 | 6.6E−02 | 24.72 | 3.18 | 2.0E−01 | 56.02 | 24.12 | 3.4E−01 | 51.24 |
| Control | | 2.40 | | | 2.04 | | | 15.95 | | |
| NUE532 | 9222.4 | 2.04 | 2.8E−01 | 10.29 | 1.43 | 2.2E−01 | 22.08 | 11.44 | 2.2E−01 | 22.08 |
| NUE532 | 9223.3 | 2.04 | 9.0E−02 | 10.28 | 1.38 | 1.3E−01 | 18.26 | 11.08 | 1.3E−01 | 18.26 |
| NUE532 | 9223.5 | 2.23 | 5.3E−03 | 20.20 | 1.64 | 6.4E−03 | 40.20 | 13.13 | 6.4E−03 | 40.20 |
| Control | | 1.85 | | | 1.17 | | | 9.37 | | |
| NUE537 | 9391.1 | 1.87 | 8.6E−01 | 0.96 | 1.22 | 6.7E−01 | 4.43 | 9.78 | 6.7E−01 | 4.43 |
| NUE537 | 9393.1 | 1.90 | 7.6E−01 | 2.36 | 1.34 | 4.7E−01 | 14.85 | 10.17 | 7.5E−01 | 8.55 |
| Control | | 1.85 | | | 1.17 | | | 9.37 | | |

Table 51: Analyses of plant biomass (rosette diameter and area and plot coverage) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM $KNO_3$, 1 mM $KH_2PO_4$, 1 mM $MgSO_4$, 2 mM $CaCl_2$ and microelements) as compared to control plants.
"Incr." = increment;
"Ave." = average.

The genes presented in Table 52, hereinbelow, have improved plant NUE when grown under standard nitrogen growth conditions, compared to control plants. These genes produced larger photosynthetic areas as it can be observed by their larger leaf number, leaf blade area and petiole area as compared to control plants.

Table 52 depicts analyses of plant photosynthetic area (leaf number and petiole area) when grown under standard nitrogen conditions (6 mM $KNO_3$, 1 mM $KH_2PO_4$, 1 mM $MgSO_4$, 2 mM $CaCl_2$ and microelements) in plants overexpressing the polynucleotides of some embodiments of the invention under the regulation of a constitutive promoter (35S)). Evaluation of each gene was performed by testing the performance of several events. Some of the genes were evaluated in more than one tissue culture assay and the results obtained were repeated. Event with p-value<0.1 was considered statistically significant.

TABLE 52

Transgenic plants exogenously expressing the polynucleotides of some embodiments of the invention exhibit improved photosynthetic areas (leaf blade area and leaf petiole length) under standard nitrogen growth conditions

| | | Leaf Blade Area [cm$^2$] | | | Leaf Petiole Length | | |
|---|---|---|---|---|---|---|---|
| Gene Name | Event # | Ave. | P-Value | % increment | Ave. | P-Value | % increment |
| NUE227 | 9851.4 | 0.219 | 1.6E−01 | 15.14 | 0.305 | 7.2E−02 | −14.52 |
| NUE227 | 9854.2 | 0.249 | 2.6E−02 | 30.94 | 0.373 | 4.6E−01 | 4.52 |
| NUE227 | 9853.1 | 0.248 | 6.6E−02 | 30.68 | 0.364 | 7.9E−01 | 2.16 |
| NUE227 | 9852.3 | 0.232 | 4.4E−01 | 22.31 | 0.331 | 4.7E−01 | −7.20 |
| Control | | 0.190 | | | 0.357 | | |
| NUE233 | 10174 | 0.437 | 1.8E−01 | 28.66 | 0.424 | 3.3E−01 | 15.67 |
| NUE233 | 10174 | 0.440 | 1.8E−01 | 29.28 | 0.440 | 2.3E−01 | 20.06 |
| Control | | 0.340 | | | 0.366 | | |
| NUE256 | 10063 | 0.518 | 2.3E−01 | 52.46 | 0.491 | 1.9E−01 | 34.00 |
| NUE256 | 10061 | 0.384 | 4.9E−01 | 13.04 | 0.426 | 4.3E−01 | 16.39 |
| Control | | 0.340 | | | 0.366 | | |
| NUE512 | 9282.3 | 0.244 | 2.3E−02 | 28.51 | 0.370 | 4.7E−01 | 3.82 |
| Control | | 0.190 | | | 0.357 | | |
| NUE514 | 9403.5 | 0.245 | 1.2E−01 | 28.88 | 0.380 | 2.4E−01 | 6.47 |
| NUE514 | 9402.2 | 0.225 | 1.3E−01 | 18.56 | 0.373 | 4.4E−01 | 4.60 |
| NUE514 | 9404.5 | 0.246 | 5.1E−02 | 29.57 | 0.358 | 9.5E−01 | 0.42 |
| NUE514 | 9402.5 | 0.235 | 4.4E−02 | 23.86 | 0.414 | 3.7E−02 | 16.10 |
| Control | | 0.190 | | | 0.357 | | |
| NUE531 | 10082 | 0.393 | 2.5E−01 | 15.61 | 0.445 | 5.6E−02 | 21.67 |
| NUE531 | 10083 | 0.526 | 4.9E−02 | 54.72 | 0.503 | 4.4E−02 | 37.48 |
| Control | | 0.340 | | | 0.366 | | |
| NUE532 | 9222.4 | 0.238 | 1.8E−01 | 25.41 | 0.380 | 4.4E−01 | 6.51 |
| NUE532 | 9223.3 | 0.217 | 3.5E−01 | 13.98 | 0.418 | 3.3E−02 | 17.17 |
| NUE532 | 9223.5 | 0.261 | 1.1E−02 | 37.44 | 0.404 | 9.7E−02 | 13.18 |
| Control | | 0.190 | | | 0.357 | | |
| NUE537 | 9391.1 | 0.206 | 4.1E−01 | 8.34 | 0.340 | 4.9E−01 | −4.82 |
| NUE537 | 9393.1 | 0.204 | 6.9E−01 | 7.22 | 0.369 | 5.6E−01 | 3.52 |
| Control | | 0.190 | | | 0.357 | | |

Table 52: Analyses of photosynthetic areas (leaf blade area and leaf petiole length) of transgenic plants overexpressing the exogenous polynucleotides of some embodiments of the invention (using the cloned or synthetic genes listed in Table 23 above) under the regulation of a constitutive promoter (35S) when grown under standard nitrogen (6 mM KNO$_3$, 1 mM KH$_2$PO$_4$, 1 mM MgSO$_4$, 2 mM CaCl$_2$ and microelements) as compared to control plants.
"Ave." = average.

Example 8

Evaluating Transgenic Plant Growth Under Abiotic Stress Conditions

One of the consequences of drought is the induction of osmotic stress in the area surrounding the roots; therefore, in many scientific studies, PEG (e.g., 1.5% PEG8000) is used to simulate the osmotic stress conditions resembling the high osmolarity found during drought stress.

Assay 1: Abiotic Stress Tolerance Assay Under Tissue Culture Conditions—

Plant growth was evaluated under salinity (150 mM NaCl) or osmotic stress [poly(ethylene glycol) (PEG)] in tissue culture conditions.

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing 150 mM or 1.5% PEG: 0.5 MS media or Normal growth conditions (0.5 MS media). Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following formulas V, VI and VII as described above.

Relative growth rate of leaf area=Regression coefficient of leaf area along time course.   Formula V Relative growth rate of root coverage=Regression coefficient of root coverage along time course.   Formula VI Relative growth rate of root length=Regression coefficient of root coverage along time course.   Formula VII At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions, was determined by comparing the plants' fresh and dry weight to that of control plants (containing the GUS reporter gene under the same promoter). From every construct created, 3-5 independent transformation events were examined in replicates.

Statistical Analyses—

To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

The genes presented in Tables 53, 54 and 55, hereinbelow, have improved plant ABST (abiotic stress tolerance) when grown under high salinity concentration levels, compared to control plants. Results showed that the genes also improved plant performance under non-salinity conditions.

Tables 53, 54 and 55 depict analyses of plant performance (leaves and roots area) under normal (0 mM NaCl) or high salinity (150 mM NaCl) conditions in plants overexpressing the polynucleotides of some embodiments of the invention under the regulation of a constitutive promoter (35S). Evaluation of each gene was performed by testing the performance of several events. Some of the genes were evaluated in more than one tissue culture assay and the results obtained were repeated. Event with p-value<0.1 was considered statistically significant.

TABLE 53

Transgenic plants exogenously expressing the polynucleotides of some embodiments of the invention exhibit improved plant performance (leaves and roots area) under normal (standard) conditions

| Treatment | Gene name | Event | Leaves Area [cm$^2$] | | | Roots Area [cm$^2$] | | |
|---|---|---|---|---|---|---|---|---|
| | | | Average | Statistics | % increment | Average | Statistics | % increment |
| 0 mM NaCl | CT81 | 4995.1 | 0.60 | A | 23.04 | 0.25 | A | 57.13 |
| 0 mM NaCl | CT81 | 4991.1 | 0.53 | AB | 7.91 | 0.16 | B | 0.18 |
| 0 mM NaCl | Control | 4543.3 | 0.49 | B | | 0.16 | B | |

Table 53: Analyses of plant performance (leaves area and root area) of transgenic plants overexpressing the exogenous polynucleotides of some embodiments of the invention (using the cloned or synthetic genes listed in Table 23 above) under the regulation of a constitutive promoter (35S) when grown under standard conditions (0 mM NaCl) compared to control plants.

TABLE 54

Transgenic plants exogenously expressing the polynucleotides of some embodiments of the invention exhibit improved plant performance (leaves area) under salinity stress

| Treatment | Gene name | Event | Leaves Area [cm$^2$] | | |
|---|---|---|---|---|---|
| | | | Average | Statistics | % increment |
| 150 mM NaCl | CT81 | 4991.1 | 0.25 | A | 27.57 |
| 150 mM NaCl | CT81 | 4995.1 | 0.21 | B | 3.74 |
| 150 mM NaCl | CT81 | 4993.1 | 0.20 | B | 2.09 |
| 150 mM NaCl | Control | 4543.3 | 0.20 | B | |

Table 54: Analyses of plant performance (leaves area) of transgenic plants overexpressing the exogenous polynucleotides of some embodiments of the invention (using the cloned or synthetic genes listed in Table 23 above) under the regulation of a constitutive promoter (35S) when grown under salinity conditions (150 mM NaCl) compared to control plants.

TABLE 55

Transgenic plants exogenously expressing the polynucleotides iof some embodiments of the nvention exhibit improved plant performance (roots area) under salinity conditions

| Treatment | Gene name | Event | Roots Area [cm$^2$] | | |
|---|---|---|---|---|---|
| | | | Average | Statistics | % increment |
| 150 mM NaCl | CT81 | 4995.1 | 0.24 | A | 44.30 |
| 150 mM NaCl | CT81 | 4991.1 | 0.22 | A | 30.09 |
| 150 mM NaCl | Control | 4543.3 | 0.17 | B | 0.00 |

Table 55: Analyses of plant performance (roots area) of transgenic plants overexpressing the exogenous polynucleotides of some embodiments of the invention (using the cloned or synthetic genes listed in Table 23 above) under the regulation of a constitutive promoter (35S) when grown under salinity conditions (150 mM NaCl) compared to control plants.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (3064 sequences)

SEQ ID NO: 1 - DNA, 1349 bp, Gossypium hirsutum
ggtaaacaaaaatggatggttattgtagcagaagggtaatcatgtttttggtgtttgcatttgcagcaataagcagagggtatggacaagaatcaaccactcttgttcctgcaatcatcacctttggtgactctgtggtagatgtgggcaataatgactatctccctaccatcttcaaggctaactatcctccttatggacgggactttgccaacaaaaagcctactgggaggttttgcaatggaaaattagccactgacatcactgctgaaactctggggtttacaacttatccaccagcttaccttagcccagaagcatcagggaagaaccttctgcttggagccaattttgcttcagctggctctggctatgatgacaaagctgccatggtgaatcatgccatcacattgacccagcaattagagtatttcaaggaataccaggcaaagctagcaaaggtagcaggcagcaccaaatcagcatccattaccaaggatgcactgtatgtattgagtgcaggaagcggtgacttcctccagaactactatgtcaaccctctacttaaccatgcctatactccagaccagtacggctcattccttattgataccttcacaaacttcgtcaagaacctctatgggttgggagctaggaaaattggggttacctcacttccaccgttaggttgcgttccattagcaagagcattgttcggttaccacgagaaaggatgcatctccaggttcaataccgatgctcaacaattcaataaaaagctcaacgccgcagcagccaatctccagaagcagcatcctggtcttaagattgtggttttcgacatattcaaggcactttacgacattgttaaatctccctctaactatggttttgttgaagcaacaaaagggtgttgtggaactggaacagtagagacaaccgcatttttgtgcaatccaaaggcaccaggaacttgttccaatgccagccaatatgtattttgggacagtgttcatccatctcaggctgctaatcaagtccttgcagatgcattgattgttcagggcattgccctcatttgattctgttggggcctttctcaactcttctaagcctgcctgccactactcttttaccattaccttattaaaatttgattcatattgcaccctaccccctttataatcatgtgtgccacaaaattcaatgtctttgaaggtactttttatttacttttgtgacattattattatttaggagtttgagacaatgtttgttgaggaaagggctatcttatttaaatataaatttattagttatttatataaaatattcgatcattttaataa

SEQ ID NO: 2 - DNA, 1160 bp, Gossypium hirsutum
ggcacgagcccaccccatctctctaagctccctccctataatatcacctataagcttaggcctaccctcctcggaggaaagttattaaatatatactctcaaaacactttgctttctttgggattcgtgattttccgaaagctgaattggccggaactcttaccaaaatacctcaggtacaagtgatcaaagagaatgggaagaggaaaaatagagataaagaggatcgaaaacacaacaaatcgtcaggttaccttttgcaaacgcaggaatggcctgctgaagaaagcttacgaactgtcagtcctgtgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtagaaaacaggcttgaaagaggaattactaggatcaggtccaagaagcacgaaatgctactagctgaaatagagtttttgcagaaaagggaaatcgaattggaaaatgaaagtgtttgtctccgaaccaagattgcagaaattgagaggcttcagcaggcaaacatggtgactggacctgagcttaatgctattcaagctttagcttctcgcaatttctttagccccaatgtcattgagcatccatctgcttactcccatccctctgacaagaagattctccatcttgggtagaggagttggagaaaacaaatatggaaaatggtgttttccataatataatatgttatatcatattatattctatattgaaagttaaataaaataaggaaatgacaactcttgcgaagttcgtatgatgtaaaactgtgactacttctgtcgtgtgcttgtttttggagtatcacttattacaaagaagcataaatttggatatatttatttttggattttgcttttgaaattgttttattagttaatgaaaatattagtcttgaatgttggaaataaaaaaaaaaaagagaaaa

SEQ ID NO: 3 - DNA, 2026 bp, Gossypium hirsutum
cccttttctacttaatctctcattgcttacttatattgtaagtgtgaccaagtaaaccaagtacagaagctcaatgcccaagatggaggccagcagcagcacctcccatgacccagcattgttccatgctcccttgctataccaccctcggagaaggagcagcagacccttaaagggtttcgcagtgataattgggtccgtcgttttcctactctcactggtcacattaatcgttaaccaaagcccggagccattagcaagtaaccccagtagtgtaacggaggcagggtcgtattcaatggcggcgcagccaagagggatagctgaaggtgtttcagccaagtcaaacccatcactttttgacaaagttgggtttaattggacaaacgctatgttttactggcaaagaactgcctaccactttcagcctcaaaagaattggatgaatgatcctgacggtccgttatatcacaagggatggtaccatcttttctatcaatacaaccctgattcagccatatggggaaacatcacttggggccacgctgtatcaacggacctcattcactggttctatctcccactcgccatggtccctgatcaatggtacgatatcaacggttgttggacggggtcggccactctcctgccagatggccgaatcgtaatgctttacaccggcagcaccaatgactccgtgcaagtccaaaaccttgcatatcccgccaacctatctgatcccctcctccttcagtggttaaaatacccgggtaacccggttgttgttcccccaaccgggatcgaagacgaagagttccgagacccgacaacagcttggcttggacccgatggttcctggcggattgttgttggtacaaggtttaataccaccataggaacagcccttgtttttcaaacgacaaacttttcggactatgaattattggatggggtcttacatgctgttccgggtacgggtatgtgggaatgtgtagatttttaccccgttgcaataaacgggtcggtcggactggacacgacggcacttgggcctggaattaagcatgtcctgaaggctagtttggatgatacgaaagttgatcattatgcaatagggacctacgacatgataacggataaatggacacctgataacccggaagaagatgtaggcatcgggttgaaagtggattatgggagatactatgcctccaagacattttttgatcagagtaaacaaaggaggattctttatggttgggttaatgaaactgattctgaagctgatgacctcgaaaaaggatgggcttccattcagacaattcccaggagtgtgttgtatgacaacaagaccggaacccatttactacagtggcctgtggaagaagtggagagcttgagactgaatgctacagtgtttaaggatgttgtagttgaagcaggatcagttgtgcccctcgacataggcaccgctactcagttggatatattagcagagtttgaaatagagacgttggtatcgaacagcacggaggatgaagtcagtgattgcggtgatggggcggttgataggaacacttacgggccatttggggtcctggttattgctgatgattcactttctgagctcactcctatatatttccgtccacttaatatatccgatgggagtcttgaaacttacttttgcgctgatgaaacaaggtcttctaaagctcccaatgtcacgaaacgagtgtatggaggcaaagttccagtgcttgacgatgaaaactacaatatgagggtattggtggatcattcagtagtggaaagctttggagaaggagggaggacggtgataacatcaagagtgtatccaacggaagccatatatggagcagcacggctgttcttgttcaacaatgcaagtggagtgaatgtgaaggccacactcaaaatttgggagatgaattctgcttttattcgtcctttcccctttgaagaaacattatttcaggaaatggttgcttccacatgattatca

SEQ ID NO: 4 - DNA, 1496 bp, Gossypium hirsutum
gttttaagctgcaattcgaaagcccccaggggaaaaaaaaaaacacacacacacacacacacacatccaaagaacccaagtccttccctattgcatgcctttcaatttgatttcatggatgtaacaagcacaccaaatagaaaagaaatggatcggatcaaaggtccatggagccccgaagaagatgacttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcatcttcttacgtgtacaagccgatcccaaggaccggcggtgttaacgttgatgtaaatgttacgccagctggagtggaagcggcatcatcttccaacgatccaccgacctcactgagtctgtctttaccgggggtggagtcatgtgaggtggtgtcaacccagccaataaccgagtcaactcagaatcggagtgaagaaaggggaggtggggtgatgggtttcagtgcggagtttatggcggtgatgcaagagatgataagggttgaggtgaggaattacatgacccagatgcagcaacagcagcagcagcaaaacggcgcagttccgggaggagcgggaatggggatgtgtttggatggggggttcaggaatcttatggctgtgaaccgagtcggggtgagtaagatcgagtgaaaggttaaaaatgagagtaaaagatgagaaaaaactgggctgtgttttttcttggtatgggaattaggcggtgaataattttgttcattttacggagagagagatgggtgaaaaagctgaaaaatgaccgagtaaaagaaaaaaacagagacttttctaattaaaatttacctgtctcttagccttgtttttagtagatattagtgaaggaagacaacggaaaaaaagaaagggaaaaaattcccattgaaatttcaatctcacgtctcttttattggttttgttttcctatctaaatttaaattatttttgcatgtaaatctgaaaattttctgaatttggaactataaatatacttcttataacagggaactgaaaacaagacaaaatttgtatatgtttttgttagtataaatatatttcttatatacttaaaattttcatttttc

SEQ ID NO: 5 - DNA, 2045 bp, Gossypium hirsutum
agagagtgagagatagagagatgggaggtccaccgtacgattgcttggcgaatcccctaggagccgtccgattagcattcgagaaggcaatagggtcagaattggagactccttcgacccatccctccgcctttaacggcaaagattggggtgcccttgaactcttccgccacttcctcttccaagaatcagggctttcccaggttcccatccttaatcccaaaacattaagatgggttcaacccaacagtcttgtccgttaccgtggtatgatccaagacatgttgggaaatgaattctatgccggcgcttacaaggatggaaatttatggcggaccaacaaattcatggatgtttctcaatacccaatgggttcctctcctgatatgtgtatttgggaacgccgcttgctctactgtgttcctgtcccaggacagaattcatggactgaaccttctagtgaaatggaacctaattggtcatctcaaaccagggagaagcggcgtaggatggatgacgaagatgatgatcccatggatttggttcctgatgatgagattaaaagctctccaattaccaagaagatgagagaagatggacttccttccccttcacaatctatggatgctaaaactacaagctcttcttctatcacaagtacatttcaatctgttgacaaagataaccttccttgcctagtcaagatatatgattctccagaatcagaattgaagctgaatgatgtttttgaatttattggggtcctcacttttgattcagagcttgcagttgagaaagatgacaatgatgagttatcaaatagtttctatgatgatgccctggtccatttgccccctaataaggtccctcgcttgcactgtcttatacataggaagcttgcagtgcaggactttctgccaggttccccaatcatagagccaaagccacatttggtgaaagagacaagggaagctctgttcaggcatcttactgctgttcttggaaatgatgaggtagctgctcattttgtgttgttgcatcttctgtccaaggttcatgctcgagtagatgatgttgcagtggggaagttgtcactcaatctaacaggtttaaacaaagaaagtgtatctgtgtttggtactcgacttagtgatacattcaaaaacctcctaccattcacgaattgcatgcctctcacactggaatatctgaacattgcctcgcttgccccgaaaaaggattatcaagccaacagattggttcctggcgttcttcagctacccgagggctcacacttgatggtagacgagacccgactagaatcaggaagcctcaattctactggaattgagaatacaaagttgctgaaaaatctcatcgagtttcaaaaagtggagtatgactttcaatactataaagtggaaatggcaacggatgtccagttacttatcttctcggaggggaaatctaatattgttcctgctgatgttattgtaccttttcaaccttcttgtcttgaatccactgaaatgccagttgctgaggcactagaagcttggagatggtacttggctactgttagatcattaccacattccattggatcagaaatacagaaggtggtagaagatgatttggttgcagcaagacaaatggatcggagcttgggaagtcgagattttagcagatggttgacgatggctcggctcatatcgtcaagtttcggagaaaccagtttgtcaaaggaacattgggaaatggccaaagaaatggagaggctaaggagggagagactgaaatagaatccgaaagtccacaagattttgaagctttggtatttggtaaatgattgttgtcccaaagggtgatgaaaaaagcaaaaaccaaaatagcaaacatggggattgtgatgtatgaatgttgcccatcaccactcttaaatataatatatcatcgaatttcttatgtattctaattgctgccaaagttgaactcaacttcttgtggaaatacaatgcaatccgagtctaaatccagttcatttt

SEQ ID NO: 6 - DNA, 2219 bp, Gossypium hirsutum
tagcttttagctttgaaatgtctactggagttcaacatcaagagagagtaccaatgaacctgaagaaacaacttgctcttgctgtgaggaacattcaatggagttatgcaattttctggtccatatcaactagacaaccaggggtgttagaatggggagaaggttattacaatggagatataaagacaaggaaaacagttcaatctgtagaactcaacactgaccaattgagtttacagagaagtgagcaactgagacagctttatgagtctctttcagctggtgaaagcagtcctcaagctaaacgaccttcagcagcattatctcctgaagatcttactgatactgaatggtattacttggtttgtatgtcatttgtattcaacattggccaaggattacctggaagaacattgtctagtggtcaacctgtttggctttgtaatgctcattgtgctgacagtaaagtgtttggtcgttcactactagctaagagtgcatcgattcagactgcagtatgctttccgttttcaggaggtgtggttgagctcggtgtgactgatttggtatttgaagatttgagcctcattcagcgcgttaaaactttgctcttggatgatccacagccgattgtttctaagagatcgattcaagtcgatgggatgaacaacgatcttgcttgtccagctcttgatcctttgatccttgccaccaaattgagtccaatattaggctgtgaacaactagaaacggtttctcctgatgatagtccggacggcttggagcctaagcaatcaagagaagattcattattgattgaagggataaatggtggagcttctcaagtacaaagttggcaattcatggatgaagagttcagcaattgtgttcaccattccttgaattcaagtgactgcatatctcaaaccattgcggatcatcgaaaggtcgttcctctttgccggggagaaaatgataatggtttgcaagatgttgaagagtgcaatcagactaaactaacatcttttgatcgtcaaaacgatgatcggcacttccatgaagttctctcggccttattcaagagctcacacccgttgattttaggaccacagtttcgaaactctaacaaggaatcgagctttatcagatggcagaaaaatggcttggtgaagcctcaaaaagaaagagatgaaacccctcaaaagttactgaagaagatattgttcttggttcctcatatgcatgatagaggattgattgaatctcctgaaactaatgctgttcgagatgcagcttggagacccgaagctgatgaaatttgcggaaaccatgtgttatcggagaggaagcggagggaaaaaataaacgaacgacttatgatgttgaaatcacttgtccctgcaaataacaaggctgacaaggtttctatactagatgtcacgatagaatacttacaaaccctcgaaagaagggttgcggaattggaatcttgcagaaagtcagaagcaagaacgaaaatcgagcgaacatcagataactacggcaataataaaaccaacaacggaaagaaatcgtccctaagtaaaaggaaagcctatgatgttgttgatgaagctgatcaagagatcggctatgttgcatctaaagacggttcaacagataaagttactctcagtatgaacaacaaggagcttctaatcgagttcaagtgtccatggcgagaaggaattttgcttgaggtaatggatgcattaagcattctcaatttggattgccactcagttcagtcatctaccactgaggggattctctccctgaccataaaatccaagtacaaaggatcaagtgttgcaaaagcaggaccaatcgagcaagcattgcaaagaattgctagcaagtgttgaagctatttgttctagattttaccagtttcttttgtaagatcccatgtcataaggtgccagaagcaagattgatcctgcatgcaagtagtaaaagtaaaggcaattaaaccttgtttggagccttgtaacaaagcttgaccaaggacatcaatctttttcaccatgcattaactttgagaaatatcaacttttccttgcaactgtaacaggaaaacagctttgagccttgttcgaacatggaaacaggattggtaggggttcgaatttcaacaactatggtataataatggtattaatctaggtttccatgatctc

SEQ ID NO: 7 - DNA, 935 bp, Gossypium hirsutum
aacaccacaagtttgctttcctcccattacttggtttggccactttgatgggaaaaaggaaaaaagaggcagaaatttagagaagttgattcaaacagaaagggtgatggaactgagcattcagaaaatagaagccttgattaggctaagtacgatagtgatgttggttttaacagcttgtttaattgggttggattctcaaacaaaggtcatcttctacgttcaaaagaaagcttctttcaaggatttgcgtgctcttgttggattgctgtatatcacttcattggctgctgcttataatctacttcaactatgctgttcttcattctcagcttcttacaaaggaacctcgctgcaatcttacgcatatctggcttggcttcgttatattttggatcaggcagtagtgtacgcagtgtttgcgggaaacctagcggctttggagcattcatttttggtattaaccggagaagagaacttccaatggctcaagtggtgcaataaatatactcgattctgcacccaaatcggaggatccttgctctgcggcttcgttgcaagcttactaatgttttccatcgcttccatctccgcattcaacttgttcaggctgtattcccccaccaagttcatgcacttgaaactctaatcataaattacggttaatgtggtattaaaaatttttaactttataaattgattgatattttgccatataatttaaaatttttaaaaataaaatgtttgtgaagttaaaaaatttcatgcaaaataattacttatgttaatattattatttataaaagaaatgaaaaatagattaaaaaaataaagttaaaaaaatagctttggatttttattattaatagattgtctatgtttatcatgtacttaatagtatttgttcatatacgcttcagttgtgggttttgttt

SEQ ID NO: 8 - DNA, 722 bp, Gossypium hirsutum
aacaccatttaaactccaaacactagtagaaggtttagttttacaaacatggctagttccggtgtccttaagttggtttccatgattctcatggtgtgcatgacgatgatgagtgcacccaaggcagccaaagccgccatcacgtgcagcgacgtggtgaaccacttgatcccgtgcttgtcctacgtacaaaacggcggtacacccgctgctgcatgctgcagtggggtaaaagcactctacggcgaggttcagacctccccggaccgccaaaacgtgtgcaagtgcatcaaatcggcggtgaacggaattccgtacaccagcaataacctcaatctcgcagccggcctacctgctaaatgtggtctccaactcccttacagcatcagcccctccactgactgcaacaaggtgcagtgaggttgatgatgatgatatggaaggagtggaagaaggttccagctcagctagataaagtagctagctaaggttaaataagctgtgttggtgtgttgttttttagaaaattccatatataatcggggaaagaaaaaaaaatagaaaatgtactttgtaactgtatttcgtatgtgatatatataatgtatcgtaatctttaattttttagtgatgctactacgttttatacgagtctgtaatgacaatagctttcccttttccatatataggaaggctcgtttggaaatgttatttgctttaaa

SEQ ID NO: 9 - DNA, 1620 bp, Gossypium hirsutum
attctttttcttttgttgttgttgttgtcatggcttctctgcctttcatcttcttcttatctttctttataatctccacaacattgacgtcagccggcgccgccgccgccaccatcaaactctccctctctcccttccctcacccttcttcctcccatccttaccaaattctcaacaacttagtcacttcttctgttgcaagagcccaccacctcaaacatcccaaagccaaggccgataatactacctcttctcttctcagggctcccctattttctcacagttatgggggctacactatctccctcaaatttggaactccgcctcaaacccttcctttcgtcatggacaccgggagcagcctctcctggttcccttgcacctctcgttacctttgttcccaatgcgcattccccaatgttgaccctgcaaaaatccccacttttgcccctaaactttcatcttccagtaagctcgtaggttgtagaaaccccaagtgtagttggctttttggccccgacgttgagtctcgttgccaagactgtgaacccacttccgaaaactgcactcaaacctgccctccttacataattcaatacggtttaggttccactgctgggcttctattagtagaaaaccttgctttcccccagaaaaccttccaagatttccttgtcggatgctccatcctctccaaccgacagcccgctggaatagccgggttcggtcggagcgctgagtctataccctcccaattaggcctcaagaaattctcttactgtctcgtttctcgccggttcgatgacactggcgtcagcagcaacatgttgttggaaaccgggtcgggttccggtgatgccaagaccccaggccttagctacacaccgttttacaggaaccaagtggcttcaaacccagttttcaaagagttctactacgtaactctacgtaaaattctggtgggcgataagcacgtcaaagttccgtacagttatttggtcccaggatcagacggtaacggtggcaccatagtggactcgggatcaacattcacttttatggagagaccagtgttcgaggtagtctcgaaagagttcgagaaacaaatgggaaattatagaagagtgcgtgaaatagaaaacagatcgggtttagccccatgcttcaacacttcgggctatacttcaatagaaatccccgaattgagtttccagttcaaaggaggagccaaaatggcattgcctttggttaactatttctcatttgacggtgatgataaggttgtgtgtttgatgatcgtttcagacaatgtggtcggccaaggctcacacagcggtcctgcaataatactagggagctttcagcagcagaattattacatcgaatttgatatcgcaaacaataggtttggatgggctgaacgaagctgtgcgtgagctgcactttgttattttgtgttttggccatgaatatgaaagtcatctttttcttttgcttctatttttaatggaatggtgacaaaagggttattagcttcttttttctgtcatttttaatcaaaaagtttgattatattgaaaattttaatgcatcaatatactattataacaataatagtgg

SEQ ID NO: 10 - DNA, 1569 bp, Gossypium hirsutum
ggaaatggcaggcgtcgaagcagggaaggaggaggaggcgaccgctgtgagaatcaccggaaaaagccacgtcaagccgggtaagttgataggaagaaaagagtgtcagttggtcacatttgatctcccctacctggctttctattataaccagaagctgctgttttacaagaacgacggtggtggtgagttcgaggacaaggttgaaaagctcaagggagggctgagggtggtgttagaggagttttatcagctaggaggtaagctcgggaaagatgacgatggggttcttagagttgattatgacgatgatatggatggtgttgaagtggtggaagccgtggcagaggggattaccgtcgatgaattgaccggtgatgatggtacgagctcatttaaggaattgataccttttaatggcgtcttgaacttggagggtcttcacaggcctcttttgtccatacagttgacgaagttgaaagatggtgttgcaatggggtgtgctttcaaccatgccatcctcgacggaacctccacttggcattttatgagctcttgggctcaaatctgtaacggtacttcgagctccgtcgttgtgccgccgtttcttgatcggaccacagctcgaaacacccgcgtgaagctcgacctcagtccggttgtttcctgcaacggcgacgacgccaccaaacaaggccagccggcgccgcagatgagggagaaactcttccgtttttccgaagccgccgtcgataagatcaaatcgagagttaattcaaccccaccaccgtccgatggctctaaaccgttctcgactttccaatctctagctgtccacatttggcgacacgtatcccaagcacgtaaccttaaacccgaagactacacggtttttactgtcttcgccgattgtcgtaaaagggttgatccaccgatgcccgacagttacttcggaaacttgattcaagccatcttcaccgccacagcggccgggttgttattggaaaacccaccgtcattcggagcttcagtgatacaaaaagctatagaatcccacgacgctaaagccatcgatgaacgtaacaaggcatgggaagcagcgccgaagattttccagttcaaagacgccggtgtcaactgcgtagcggtcggaagctccccgaggtttaaagtttacgaagtggatttcgggtggggaaagccggtaggggtgaggagtggatccaacaacaggttcgatggaatggtgtatttgtatcaagggaagagcggtggccggagcattgacgttgaaatcaccatggaagctcaagctatggagaaattggagaaggataaagagtttttaatggaagtatagtattttgcatggaagtagggtactgtgaaaattgaaagtgtgctaattaccgttttaggatttattttggtgtttgtaatattttaataattcgtatttttaatgttttgtctttggttgttgggtctgtgttattaatggcagtgctgcatggttttgtcttgtttaggtgatgttgctcaaatttaacgacacattagaattaaggt

SEQ ID NO: 11 - DNA, 1391 bp, Gossypium hirsutum
tacttgttctaaggctcctactacatttctcattataaatgtggagaaatcttgttctactttccattccatgcaacactaacttttagattccctttccattgcactgctctttctttctatagaattagtcactcctgttctagatgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagcacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgttggagacccttttaattacctatatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcactgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctgacggaacaaaagccaaagcagtagcagtctgccacacagatacatcagcatggaaccctaagcatttggcttttcaagtcctaaaagttgaaccaggaaccattcctgtctgccatttccttcctcgggatcacattgtttgggtccctaagtaaaaatcctgaagagtagattcatacactataagtttcatcatagtgtgcattaaaacagcttaaagcaatatccagtttgttctataataatatacccacgagtttagttatgtgaaatctatccatgaatcatgttcttggtaatggataaaatgatattactttctgtatcacaatggtttggtgataaatgtattagtatttgaagtatcgttgcagacatcgtatgccaagtaa

SEQ ID NO: 12 - DNA, 1184 bp, Gossypium hirsutum
ttatattgatcatccccctcattcttctcaactcacacatcttccaatctttcattctttgctgttgaagtagtaatatctatagcatacagagatggagaggcaaagaagcaagcaggtttgtttgttgatgtgggttttggttgctgcctttttctcccacaatagggtcattgcagtgacctccactggccttggtgagcagaaaaactactatccagctcctgaccctcatgctggaactcccccttcaggttcacatggcacaccaccatcttcaggaggtggatcacctccctctcatggaaccccgtcacatggaggtggttaccacccttcaccaacaccatcaacgccttcgggtggaaattgtggaactcccccacatgacccttcaactccatcaacaccatcacacactcctcctcatggtactccaccatcatctggaggtggtagtcccccatcgtatggaggaggcagtcccccatcgtatggaggaggcagtcccccatcgtatggaggaggcagtcccccatcatacggaggtggcagtcccccatcatatggaggtggcagtccaccaactactcccattgatccaggaactccaagcattccctcacctccattctttcctgctccaactccaccaattggtggtacatgcgatttctggaggagtcaccccacactgatatggggtctgcttggttggtggggcactgtaggcaacgcatttggcgtgaccaacgctcctggacttggaacaagcatgagcttgccccaagcactttcaaacacacgtactgatggacttggggcgctttaccgggaaggaacagcctcatttctcaactccatggtgaataataggttcccattctcgactaagcaagtcagggagacttttgttgcagcacttggttcaaacagcgctgcagcagctcaggctcgtctcttcaagcttgccaatgaaggccacctcaagccaaggacctaagcaaacaccttttggtttgtcagtttcttgaagcattttatccactagtgtgtgctacttagattttatgttcctaatattcgacatctataatgctacagctttcatttggatagatactgtgtctagaactgaatgttaagtttatgttttcttattttaaataaaatttaagatattt

SEQ ID NO: 13 - DNA, 885 bp, Gossypium hirsutum
ggaagttgagcagtgaagaaagatgatggaaaggggttttattgttttggccttgacggtggttttcgccgcgacggtggttacggcggctgacgagagtgggttagcgaatgagtgcagcaaagatttccagagcgtgatgacttgcttaagctttgctcaaggaaaagcagcgtcgccgtcgaaggagtgttgtaattcagtggcggggattaaagagaataaacccaaatgtttgtgttatattttgcaacaaacacaaacttccggtgctcaaaatctcaaaagcttaggtgttcaagaagataagctgtttcagttaccgtcggcttgtcaattgaagaacgctagcgtcagtgattgcccaaagcttcttgggttatctccgagctcaccagacgccgccatcttcaccaactcctcctctaaagcaacgacacccagtacttcaacaaccaccgcaacgccgtcttccgcggccgataaaaccgatagcaaatccagtggaatcaagcttggtccccacttcgtcggttccacggcggcgctactggttgctacagcggccgtgtttttccttgtattcccagctggatttgcttcaatagtttaggggttttgcatgggatttcgagatttggaggtttatttattgttgaagtccatttgtttttaaacggtctcagaaaaaaaatggactgagttgacaattatgatgatttttcgtttatttttcctttttcttatttgatttaacgtccctttgaattaaaactagtatattttcccagcttcgcctgggaaatccttttatatatatatatttaaaattttataaataataattataattatcggaagtaatgtgttgtagtaaaaatatag

SEQ ID NO: 14 - DNA, 2176 bp, Gossypium hirsutum
aagttcccttccaccttacgttcctctttcttttatgggttctcaccggaaaatcgtttccggttccgactagccgccggaggaaataacggcaacttaaaagaaaaccttttctttcctcattgttttactactaaaatcccataatgccggtcgtggattttgtctgtgtttttttagtttcagttgtgatgtttaatttgagagtaagcacagaaccagttgaagacaagcaagctctacttgctttcatttcgggaattagacatgccgaccgggttaaatggaattcatcgacctcagcctgtgattggttcggtgttcaatgcgacgccaaccggtctttcgtctacactttacggctccccggtgcggcccttatcggttcgattccgcccaatacaatcggtcggttgaaccgacttcgagttttaagtctacgagcaaaccgtttgtccggtgagatccctgccgatttctacaatttgactcagctgcgtagcctttatttgcaaggtaacgagttcaccggtccgttcccacctagtgtgactcgtttaactcgtttgactcgccttgatctttcttctaataatttcaccggtccaattcctttgggtgtcaacaatttgactcagttgaccagactcttcttgcaaaataacaagttttccggttctctcccgagcatcgactcggacggtttaaacgatttcaatgtgtctaacaacaaccttaaaggttcaatccccgactcgttatctaaattccccgaatcttcattcgccggaaacattgggctttgcggcggtccacttcggccatgtaacccatttcctccatctccatctccgactgagcccattccgcccaaaacttccggtcaaagctcgaaaagccttcccaccggcgccatcattgccattgccgtggggtcagcaattgttgcgttactgttattactattcctcattatctgcttccgtaaatggaaacggaagtcaccgaggcggcagaaggcgataccatcgacgacacatgcagttccggtggaggaggcggggacttcctcgtcgaaagatgatataaccggaggctcaacggaaatcgaaaggatgatgaataataagctcatgttcttcaaaggtggcgtttacagtttcgatttggaggatttgatgagggcgtcggctgaaatgttgggaaaaggcagcaccggaacgtcgtacagggtggttttagcggtggggacgacggtggcagttaaacggttgaaagacgtggcggttagtaaacgagagttcgtaatgaagatgggaatgttgggtaaaatcatgcatgaaaacgtggttccgttgagagctttttattattccgacgaggagaaattgctggtttatgattacatgcatggtggaagcttgtttgcgctgcttcacggtagcagaagctcggctcgtacaccgttagaatgggacccccggatgaaaatagccctaggcgtggctagaggcctcgcgcacctccacagttcacaaaacatggtccacggcaacattaaatcttccaacatccttctccgaccagaccacgaagcctgcatctcagagttcggtcttaactctcttttcaacaccaacactccacctagtcgcatcgcgggttaccaagcacctgaagtaattcaaacccataaagttacggtgaagtcagacgtttatagtttcggggtgttattattggaattattaaccggtagggcaccaatccaaccatcaataactgaagaagggttcgatcttccgcgttgggtccaatccgtggttcgggaggaatgggcggccgaggtgtttgacgcagagttaatggcataccacgacatcgaggaagaaatggtgcaagcgttacaaattgcaatggtttgtgtctcgacagtgcccgatcaaagacccgtcatgtcggaagtggtacgtatgatcggagatatgatagatagagggggaacaaatgacggtacggcagccgccatatgatccgttaaacaatgaaacaaaattcaaagtgtgttgaccttgagaagccaacaatggagttgaaagtttcaatttaaaaaaaaaatcaattccatttgcaggccatctataaaacgttaaatgctttgtatttgatttatttt

SEQ ID NO: 15 - DNA, 1874 bp, Gossypium hirsutum
atcatcactcaaagattattttgttatgtgcttggcagctgcaaataagctgatattattttgatttggtttcctaaatcgttgggaggagggactgtaaaaaagcataggttcccaatgcagatcctcccgtttcgaggaggcgcacttgtgtgcttcattgcttccttgttatttgttgccagtttttgcaatgccgatgctaaaacagtcgaggttgtcggggctggtgagtgtgcagattgtgcagagaataacttggagattagccaggctttttcagggctacgagtaagcatagactgcaagcccgaaaatgggaagaactttaaaacacgaggatcaggggagcttgataaacaaggcaattttaaagtattcgttccagaggatttggttgaaaatggggaactgaaggaagaatgctatgcacagcttcacagtgtatcggcagcaccttgtcccgcccatgatggcttggagtcggccaagttagtgttgaagtccaggagtgatgggaaacacgagtttgggttaaaaggaaagctcagattctcacctctaacctgtgcttctgccttcttttggcctcactttaagtttcctcccttgcctaagtggaaccatccccctttgcccaagtttccacttcccccattcaaaggcttccaccaccattatccaataatccctcccatctacaagaaacctcttccgccaccgtccccggtgtacaagccccctccagttcccgtaaacccacctgttccaatctataaacctccaccagttccagtctataaacctcctccagttccagtaaaaccacttcctccacctgttccaatctacaaacctccaccagttgaaaaaccacatcctccacctgttccagtctataaacctccaccagttccagtatacaagaaaccatgtcctccaccagttccagtctataaatctcctccggttccagtatacaagaaaccgcatcctcctccagttccagtctataagaaaccacatccacctccagttccagtatacaagaaaccatgtcctcccccagttccagtctataaatctcctccagttccggaaccacatcctccgccagttccagtctataagaaaccacatccacctccagttccagtatacaagaaaccatgtcctcccccagttccagtctataaatctcctccagttccggaaccacatcctccgccagttccagtccataagcctcctccagttccggtatacaagaaacgagtccctcctccggttccaatctacaagccccctccagttcctgtatacaacaaaccactacctcccccggttccagtgtatacgaagccacttccaccacctgttccaacctacaaaccaaaacccctccctcccattccttacaagccactccctccacttcccaagatccctccattccctaagaagccatgccctccccttcctaagctacctcctcttcccaagattcctcccaagtatttccaccaccaccctccccttcctaagctacctcctctccctaagattcctcccaagtatttccaccaccatcccaagttcggaaaatggcctcctttgccaccctttgctccccatcatccttaagctatcttgcattgttttacgcatttaatgaaggtggttagtgtgaacaagttccccagcagtacctcatgcaataaatgtagcaacaaaagaagaagaagaaaattgttaaaattaagagaggaattgttaatttattatttatatgttttgttaattactttatgatatgaatgtgtgaatttctaattttctgttgcaataaataccagtacattaacttttctttt

SEQ ID NO: 16 - DNA, 883 bp, Gossypium hirsutum
ggaaaatctatctgggttttccttaaaatataatttctattgaatatctatacataattttcctttatatatctgagcccaactagaagaaccatttgaagtattttttatcttttatttttaatctttggtgagtttttttttttttggctgttttaagcttttaaggttttgcagcattttttttttaaaagtaggagatggtgagaggcaaaattcagatgaagcgaattgaaaatgcaacgagccggcaagtcaccttctctaagcgacgaaacgggttgttgaagaaggcttatgaactatatgttctatgcgatgctgaagtagctgtcatcatattttctcataaaggaaaactctacgagttctcaagttccgacaacatgcaaaacaccatagaacgataccgtcagtacaagaaagatgtccagagtaacatccctgaatttgacagatacacacagcaactaaggcttgaagcagaaaatatggccaagaagattgagttccttgaggtttctaaaaggagaatgttgggtcaaaatcttggttcttgttctatagatgaacttcaagaggttgaaaaccagcttgaacgcagcttaagaaacattagggcaagaaagggctatttattcaaggagcagatactgcaactaaaagctaaggaaagatatatgcaagaggagaatgccaagttatctgctaagaacaatggtacaacatgcagccagcagaacgcggaggtggagacagaactgttcctcgggttgcccgaaaaccgctgttcctagcaggtaggtctttggatatggaatgaaaatgatattccctattggaataatgcttgcttgtacgttatcgccattgctactggttg

SEQ ID NO: 17 - DNA, 1954 bp, Hordeum vulgare
atctcctcttgtggcagttccagttgagcgagcagatcatcctcacattgcgaggggcctgccgtcagcttcctcattgctgccctctgccctgccctccatggataggctcgtcgcagccggcattcttgccttcctactgatcgcgtcggtaggaagccatgcagctcgtgctccggggcaatactgggagtctgctcttcccaacactcccatgccaagctccctctctcaactcctcgacacgcaagccggaggcacgtcggtgaacgtcggctcgggcggcgtccatgtcgacgcgggccatgggatgcctgggggcacgacggtcgatgtgggcaagggtggcgtcggcgtcaacgtgaagcctggcagcgccaagcccggcgggactacggtcggcgtcggcaagggcggcgtgggtgtcaacgtcaagcctggctacggcaagcccgggggcacaacagttggcgttggcaagggcggcgtggacgtcaacgtcaaacctggcagcgccaagcccagcggcaccggcacgacggtcggcgttggcaaaggtggcgtggacgtcaacgtcaaacctggcagcggcaagcccagcggcaccggcacgacggtcggcgttggcaaaggtggcgtggacgtcaacgtcaagcctggctacggcaagcccggtggcagtggcaccacggttggggtagggaagggaggcgtcggcgtgaacgtgaggcctggcggcggcaccacggtcggcgtcgggaaaggtggcgtcggcgttaacgtgaaacctggctacggcaagccagctggtggcaccggcacgacggtcggcgtcgggaagggcggcgtcggcgtcaacgtcaagcctggctacggtaagccaggcggcacgacggtcggcgtcgggaagggcggcgtcggcgtcaacgtcaggcctggctacggtaagccaggcggcaaaccccggggtaagcctgtccacgtcaacgtctcacccttcatatacaactacgccgcaacggagacgcagctgcacgacgaccccagcgcggcgctcttcttcctggagaaggacctccacgccgggaagaagatgagcgtccatttcatggccaccccgggcgccggagggaagttcctgccgcggagcgaggccgacgccatccccttctcctctgagaaggcccccgagatcctcagccgcttctccgtggcgccggactccgccgaggcggcggagatgaagcagacgctgcgggagtgcgaggcggcggcgggcaagggggagaagaagtcgtgcgccacgtcgctggagtcgatggtggacttcgccacgtccagcctcgggaccagccacgtgagggccgtctccacggtcgtcgggaacgggaaggaggggtcgccggagcaggagtacaccatgaccggcgtgaagcgcgcggcgggggccgaccagctcgtggcctgccacgcggagccgtacgcgtacgccgtgttcgcgtgccacctgacgcaggcgaccagggcgtacacggtgtccatggtcggcagggacggcacggcggtggaggccgtcgcggtgtgccacgccgacacggccggctggaacccggggcacgtcgcgttccaggtgctcaaggtgaagcccggcggcgcgccggtgtgccacttcctgccgcaggaccacgtcgtctggacccgccgcggctgatgaagcccggtcgacccgcgccgttggtaagcaccatatacagttgtgctttgccctatattatggtatcttgcaccctagcatcgctatatacatttcccttgtttggtacctattgtgttttgatggcgtggcgttgccagtatcgccagcttgtacggagtggcacgtttgatgtatagtttagcacgttgatgatgatgcaataaacagactggtacttatttacctctctttcaccgt

SEQ ID NO: 18 - DNA, 1998 bp, Oryza sativa
tttcgcattccatcagctcgactgtttcgttgcgaaatcgtctgtgttgcgtaagcaaaccacgggataggatcataggaaggagaggtgacgacaaagcgccacaccgccgcggcggaccaaccaccagtccaacactactacgatctccgatccaccaccaaacagttttgttcatccatggatcccgcgaccgtcggcggcggcggcggcgagccggaggcggcagccgagtggcgcgcccgcgcggtgggcgggatggagtacggctggtaccgcgccgtgccgggcggaaccggcacgacgctgctcgcgctccgcctcgcgcgcggcgcagaggcggcggtggcggcggcgaccgtccaggcggcgctgcgggccatcctggacgctcaccccgtcctccgcgcgcgcctccgcgggtccgcttccggcagcccaaccctcgccttcccctccgccgccgcgccgcctccgcccccgctagcgctcgagctcctccccgtgcccgaatccgccaccgacttcccttccctcctcgagcacgagctcaaccgcaacccatggaccgccgccgccgcaaccgcaaccgcgtccgaacacgagcccgacgcgccaccggtgctcttcgccacgctctacgagctgccgccgccagcgggtggggggtcggcgctgttcgtccggatccacacggccgcgtgcgaccgcgcggcgtcggcctcgctggtgagggagctcctcgcgcagctggccggcgatggcgccgccgccgcggcagcgagcgaacccgaggacgcggcggtgcgcgcgtcgctggaggagaggataccgcagagggactcgtggaagccgttctgggcgcgggggctcgacatggtgggctactccatcaacggcctacgcacgtcgacgctgccgttcgaggtgaccggcacggagaggtccacgcagatgctgcgcctcggcttcgaccgcgacgagacgacgaggctgctcgatgcgtgcaagcagaacggagtgaagctttgtgcagccatggcggccgcgacgctgctcgctgcacggcagtcgaagctgcagctggcgagcaaccagcaggagacgtactccattgcgacccttatcaattgccgcaagtttctcgaaccggccctggatgatcacaacgttgggttctaccattctgctatcaccaacacgcacgcaatccatggcggagaagagctatgggagctggccaagaggtgccaagattcgtataccaacgccaagaacaacaagaagcacctcactgacattgccgacctcaacttcctcatgtgccgggcaatcgagaacccgcagctgacgacgggctctgcgctccggacggcggtcgtctccgtgttcgaggagccggtggtgtacgacctctccgatctgcagagcaaggccggcgtggaggaattcgtgtgctgcgccaccgtgcatggcgtcgggccatccatcggattgtttgactccatcagagatggtcagctggagttcgcgtgcatgtacccttgccctctccattccagaaagcagatgcaggagatcttgaacaaggtgaagcagatcttacacgaagggagcatcggagatgatgaaagctttgaagattgtacctgaaagatcgtcgaaccgtggtacgaggctatgacttatgatttatgaccattttcgcctttttgggtaaataaactatcggcatgttgtcccatgtagtaattgatgttgcacgttttggtgcaatatgtagtgtcctgaaattgaatagtacacgcgcatacgttttagtgatcagtccactattctactggaacagcgcttaaatggtttttctgttaactgctaagcaaagcagtgttcttccacgatcatttggcagagtaaacagacaatctgccaactgtccattgctaaattacagtattacaatatctgaattctgaagagcatgccagttcacctgct

SEQ ID NO: 19 - DNA, 1617 bp, Oryza sativa
aaaggcccatcacctgcatcgttccaagcgcagctcaatctttgcctcgtcaggttttgctcattggcgtctccatggataggctcctcgcctgcctccttggcttcctgttgatcgcttcagtaggaagccatgccgctcggactccggagcaatactggaaatcagctcttcccaactctcccatcccgagctcgctctctcagcttctcagcactgcaggcggaggcacgtcggtgaacgtcggcgggggcggcgtccatgtcgacgcggggcacggcaagcccggcggcacaaccgttgatgtaggcaagggtggcgtcggcgtgaacgtgaagcctggttacggcaagcccggcggcaccacggtcggcgtcgggaagggcggcgtgggagtcaacgtcaagcctggctatggcaagcccggaggcaccagcgtcggcgtcgggaaaggaggcgtgggcgtgaacgtgcagcctgggtacggcaagcccggcggcaccaccgtcggcgtcggtaagggcggcgtcggcgtgaacgtgcagccaggctacggcaagcccgggggcaccaccgtcggcgtcgggaagggcggcgtcggcgtcaacgtgaagccccggggcaagcctgtccacgtcaacgtcgcacctttcatctacaactacgccgcaacggagacgcagctgcacgacgaccccaacgtggcgctcttcttcttggagaaggacctccaccccgggaagacgatggccgtacatttcacggccaccaccgccggagagaagttcctccccaggagcgaggccgacgccatgccgttctcctccgagaaggtcccggagatcctcagccgcttctccgtgaagccgggctccgtcgaggcggcggagatggcgcagacgctgcgcgactgcgaggcgccgccggcgcagggcgagaggaaggcgtgcgccacgtcgctcgagtccatggtcgacttcgccacgtcgagcctcgggaccagccacgtgagggccgcgtcgaccgtggtcgggaaggaagggtcgccggagcaggagtacaccgtgacggcggtgaagcgcgcggcggccggcggcgaccaggaccagctcgtcgcctgccacgcggagccgtacgcgtacgccgtgttcgcgtgccacctgacgcgggcgacgcgggcgtacgcggtgtcgatggccggcagggacggcacgggcgtggaggccgtcgcggtgtgccacgccgacacggccgggtggaacccgaagcacgtcgcgttccaggtgctcaaggtgaagccaggcacggtgccggtctgccacttcctgccgcaggaccacgtcgtctggacacgcagcggctagctgatgatcggctgccaatcttggcgcctgatcgagttggttgcttatgctctagaatctagctaggctccatgcagatgctatactgtatggtgtcttactatcttacatatttgtatgcacgcaatttggttctttgttatttggatggtgttgccagcatcgccagcctgctagtagatgatacgggtgggcttgctgtttgatgtatagttttagtatgcgggtgcaataaacagacaagtatttactt

SEQ ID NO: 20 - DNA, 2019 bp, Zea mays
atcacacaccaccgccgctcaccaacaaccgagcaggagcagcctaccccatccacccaccccatcctctgcgctgcacggctgctgctggtgctggtccggccggtccggtccggtctcctctgttccagcgagctccctccgatccatcgggtaggacactccccatggcgtcgcacaacggcaccaagcacctggcgccgatggaggtgtcggtggaggccgggaacggcggcggcgccgagtggctggacgacgacgggcggccgcggcgcacgggcacgttctggacggccagcgcgcacatcatcacggccgtcatcggctcgggagtcctgtccctggcctgggccatcgcgcagctggggtgggtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtctcgcgggagctccgcgtggggcccctcgccctcagcgtgttccgcctcacgtggcggtcggcgttcgtgtgcgtcaccaccgtggtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggcctggcctgggtttggacgtatgtgcatgatgcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgttcctttctaactcttcttcttcttcttctcctcttcttctttatttacaattttcttttatgtgttttcgtctaattaaggttctggttttgtagttctaccgtgcaactcattgtaccggaaaagaatatatgaacaggaaatcccatatgatctttgccatcttt

SEQ ID NO: 21 - DNA, 729 bp, Arabidopsis thaliana
gtcttcttcttctacataaaattgattcgcctcgaaatttacacagacttgtcgctctctctttctctcttatttcacagagcccctaaacatttccaaaaatcttgcaaaggaagaaaaacaatggacaaattttggactttcctcactgctcttcattcaggcgctgggcctatcgtgatgttactttatccattgtacgcatcggtgatagcaatggagagcacaacaaaagtggacgatgaacagtggcttgcgtattggataatatattcgttcctctcactcacggaactgattctgcaatcgcttattgagtggattccgatttggtatacggtgaaacttgtgttcgtggcttggctagttcttcctcagtttcaaggcgcagcttttatctacaaccgtgttgttagagaacagttcaagaaacacggcgtcctccgctccacccactccaagcccaccaagcccaacatcctccactccattttcccccaccgggagggacacgaggctcacagtcactgaatcagaagggtggagcagacagaagaagcctgactagtattattgtaatggtcttggtggtggtcccatcatgtccctgtctaatctactttttactttatttttatttatcacaaaaaatgggtttaggaatgttgatgatgatgactgatgaggtgtgtaatcgtttttaaattagaaaatggcttcttctgcttg

SEQ ID NO: 22 - DNA, 926 bp, Solanum lycopersicum
gaagatgttaaaatagaacatcacagaacattagaacacactaacaaatcgagcccctaaatcaactgactgaaagagagagaggtatggcaggtgaggcaactcgggtgatggtagcggtgaacgagtcgacgatcaagggttatccacatgcttccattagcagtaaaggagcattcgagtggactcttaacaaaattgttcgttccaacacttctggtttcaaactcctcttcctccatgtccaagttcccgatgaagatggttttgaagatatggatagcatatttgcatcacctgatgatttcaagggcatgaaaaacaggaacaagattagagggctccatctggtggagtactttgttaaccgctgtcatgaaattggggttccttgtgaagcatggataaagaaaggcgatcccaaggaagtcatctgccacgaagtcaaacgtgtacagccagatcttcttgtggttggttgccgtggtcttggtccttttcagagggttttcgtgggaactgtaagtgagttctgtctgaagcatgctgaatgtcctgttgtcacaattaagcgcagtgcagctgagactcctcaggacccaatagatgactaattcatgtggtgtatttgactacttaatgcacttattgattgtcaacttgtgatggtgtggaaagattgtgggggattttcattctggtgcttctaatatagcctatatctgcctgcttgtgaggtttgtgttcgtacatgattgtagagtacatgtggctgagctttgagtgctcctcgttacgcttggtatagtgcttggtatattgtttgcatattttctcctctttctgatgaatatgtgttaaacattctgcatgtatggtacgctttgcaatcgtaaaagaatttccatccttgcacgtctgggaga

SEQ ID NO: 23 - DNA, 1255 bp, Solanum lycopersicum
gatgagtagtagtagtcagtagttttcttctcttctctcccgcttttgctttactttctggttaccctttttttactcactctctctgtttacttcaaagatacaattttgtgatgacccttttaaggaattgactaaaacaaagaggaaaattatggattgggaaaaacagcagcagcagccaccggtgtcggcgccgcagcagacggcggaggaattgaacggaacagtcagtggtgggatgtttgtgaaagtgatgacggatgagcaaatggaagttttaaggaagcaaatcgctgtttatgctactatttgtgaacagcttgttgatttgcataaatccatggcttcacaacacgatcttgctggagccaggctgggaaatctgtactgcgatccactggtgacatctgctggtcataaaatcactggtagacaacgctggactccaacacctatgcaacttcagattcttgagcgcatatttgaacaaggcaatggaactccaaccaaacagaagatcaaagagataacttctgaattatctcaacatggccaaatttctgaaacaaatgtgtataattggtttcaaaataggcgtgctcgatcaaaaaggaagcaacaggttgcagcaacaaacaacactgaatcagaggtggagacagaggttgagtcgcccaatgaaaagaaaacaaagccagaggatctgcagtcttctcacatgcctacttcaatggctgaagatcttggctatgagaaccctgacgtgagctctggaatgcattcactagatccacgaaccagtaaacccgagcctatgtttccatcagacggtagttcaaaacctgctgcaagttatggccaaatgtccttctatggaatgtctaatccaagaatggaccagctaatgggaaagatggaagtgcctgggagctatcatccatatatacatgcagacgactacaacatgaccggctaactaccaatttggaaactaagtttcagcaaattagaatgagactagaagccccaaaactctagccggagtttttgatcctactgtgcgttagccactgattgatgatattctattacaggatgattctgtgtgtgaaaaaatgtacttatggaccatgcttataggaactatatagtaaatagtattttcattttgatttctccatttgctttgtaatttttacttttggaatgaagattttgttaaagcatgatgcagggctgtgctctgaatttc

SEQ ID NO: 24 - DNA, 1668 bp, Solanum lycopersicum
aaactcataccaaatataccttgtttccaagaagattcaaaaagagcaagagaaaagattcaatcttgatttttttcttcttcttgttaatcaaatcttaaagttttgatttttaatatctggggtttgtgtagaagtttgattggattcttgattttgggataataagagtatggggtttaagaaagatgaagcaagttcatcttctcatgttttgagtatcccaagagaagatacaccacttcttggcaagattcaacatctttcttctccttccaagacttttgctaatgttttcatagccatagttggagctggagttcttggtcttccttacacctttaagagaactggatgggttatgggttctatcatgctcttctcagttgcctttcttacctactactgtatgatgcttttggtctattcaaggcgtaagattgaatcccacataaaagctgcaaaaatttcatcttttggtgatttggggtttgctgtgtgtggacctgttggtagattgtctgttgatcttatgattattctatctcaagctggtttttgcgttagctacttgatttttgtggctaatactttggcatatttgttcaattattcaattgcaaaacctgatcccaaaatcttgggactttcacccaaggcagcttatatatggggctgtttcccatttcagttgggattgaattcaatacctactctgacccttttagcccctttaagtatttttgctgatattgctgaattaggagctatgggtgtggtgatggttgaagatgtgatgatttaccttcagaacaggcctgttcttgaaatgtttggtgggttcaatgtgtttttctatggacttggtgtggctgtgtatgcttttgaagggattggtatggtcttacctctggaatcacagacaagagacaaggacaagtttgggaaaatcttgggattggcaatgggcttcatatcattgctgtttggtgcttttggagtattgggctactttgcatttggggaagacactaaagatataatcactacaaatcttgggcagggattgctcagcacctttgttcaacttggcctttgcataaacctgtttttctctttcccccttatgatgaatccagtctatgaagtaatggaaaggagattctgggaaggcaggtactgtgtgtggttgagatggcttgtggttttagcagtgacttttgttgcattggcggtgcccaattttgctgatttcttgtcacttgttgggagcagtgtgtgcattgttttgggatttgtgttgccttctttgtttcacttaattgcgttcaaagatgaattgagatggtatggttttgcttctgatgctgcattgattgtcatgggcacaatttttgccgtctatggaacctcttcttccctgatggagatctttgcaaaaaaagcttagtttcttttcctcatagcatttcataagatgtatattgaagagattgtttttattcataagcaaagggcaagtaagtccacactttgttcctactagtaattcatttgttaagctattatttttgagtatgttgaggggtgtgagggtcatgttcatgtacgattggaatttactacaagaagttataattacacaaaaatgatctatttggttaaaaa

SEQ ID NO: 25 - DNA, 1552 bp, Oryza sativa
cacgcgattcccccatctctccgacagcgagcttcgtcgtcggctgtgcgcggccgcggcggcggcgctggtcgtgtgcttcccaaattctctcattccccagcgagcgatcaccatggggctccacaaggaggcgagctcgtcgtcgtcgcggctcgacgcggcgccgctgctgccgcaccacggccacggcggcggcggcgcggggcaccacctgtcgtcgcagcccaagacgttcgccaacgtgttcatcgcggtggtcgggtcgggcgtgctggggctcccctacaccttctcccgcaccggctgggtggccgggtcggtcctcctcctcgccgtggccgcgctcaccttccactgcatgatgctgctcgtcgcctgccgccgccgcctcgcctacgaccaccccaagatcgcctccttcggggatctgggcgccgccgtgtgcggccccgcggggcggcacgtcgttgacgccatgctcgtgctcagccaggccagcttctgcgtcggctacctcatcttcatctccaacaccatggcgcacctttacccggttggggattcgtcgccctcgtcgccgctcctcaccgccaaggcgatcttcatctgggtcatgctgccgttccagctggggcttaactccatcaagacgctgacgctcctcgcgccgctcagcatcttcgccgacgtcgtcgatctcggcgccatgggcgtcgtcctcggccaggacgtgtccacctggctcgccaacaagccccccgtgttcgcctccgccggacccacggagatcctctacggcctcggcgtcgccgtctatgccttcgagggcatcggcatggtcctcccgctggaggccgaggccgccgacaagcgcaagttcggcggcacgctcgcgctgtccatggcgttcatcgccgtcatgtacgggctgttcggcgccatgggttacctcgcgttcggcgcggccacgcgggacatcatcaccaccaacctcggcaccgggtggctgtccgtcaccgtgcagctgggtctctgcatcaacctcttcttcaccatgccggtgatgatgaacccggtctacgaggtcgccgagcggctgctctgccgcaagcgctacgcctggtggctgcgctggctcctcgtcatggtcgtcgggctcatggccatgctcgtgcccaacttcgccgacttcctctccctcgtcgggagcagcgtctgcgtcctgctcgggttcgtgctgccggcggcgttccacctcaaggtgttcggcgctgaggtcgggtggcccgggctcgccggcgacgtcgccgtcatcgtcgtcgggaccgcgcttgcggtgtccgggacatggacatcgctcgcacaaatcttcagttcttccgatgtgtaagcggttgacagtaatgcagacaatgcgcaggcaacgcagctagtagctcatgtgtatacattgaatttagcagaaaagaacattcagctggcatgctgattttgggcacggttcacgtggttcaaattgaatactacataatactcctacttctatttc

SEQ ID NO: 26 - DNA, 1060 bp, Gossypium hirsutum
aaatcttctcccaagcaatagcaaacaaccagctaagtcaacatatatcataatgaaagggattcgctccattcttattgcttttggcctatttgcttttgcttgctcatcggcctcagcatatgaccccagtcctctccaggacttttgtgtagctatcaaggacatcaagaatggcgtgtttgtaaatggtaaattttgcaaagacccaaagcttgcagttgcagaagatttcttcttttcaggcctaaacaggccgaggaacacatcaaatccagatggatcaaatgtcactatgatcaatgtagatataataccaggacttaacactcttggtttaactctggttcgagtcgactatgcaccttatggtgtcaaccctcctcacactcaccctcggggatccgagatcctacttgttgtcgaaggcacactttatgccggcttcgttacggcggacccagacaaccgtctcttcactaaaatcctaaaccctggagatgcttttgttttcccctttggtttgattcatttccagttcaacataggaaaaactgcggcggttgcctttgctgttctcagcagccaaaatgctgggcgtatcaccatagctgacgcagtgtttggctcaaacccaccgatcaacccagatgttttggccaaggcgttccagttgaacaagaatgtggttaagtatcttcagtctcggttctaatgggattaacaactactttaagagtcaaatcaaaaccccaaaagtttgtttgcttgtttgaaacaatgtttgcatgcacttttctaaatcaagtcatactattctgctaagtatcatgtaataaacagagaggtttaaatttacttctccagtctcctctcttgacattatcctttcagatataagaccagaatttgtagtgctctcggatttaaattacgaccacaatcaagggcaccaatgcatatgtagttcatgttgttattgttgtatttatgtcatgctagccctacttgcttgtattccttgttagttggacttgaatgcaaatgttggaatttcttc

SEQ ID NO: 27 - DNA, 1501 bp, Oryza sativa
atcctctcgagggatgaaatgactttccccatctatccctagattggcatagtgtcttctaataatcaaccgacaggccgcatcgagcagaacacgaaagatgatcatgttgtggctgcccgccgccgtctcgctcctcctctcgtcgtcgctgcatgtcgccggtgacgccggcggcggcgtcgcctccctctccgtccggcgctacgacgccatcttcagcttcggcgactccttggccgacaccggcaacaaccccgtcgtcttcgactggtactccatcttcgaccccgtcacccgccctccctacggctccaccttcttcggccgccccaccggccgcaactgcgacggccgcctcgtcctcgacttcgtcgccgaacgcctgggcctgccgttggtgccgccgttcttggcttacaacgggagcttccggcacggcgccaacttcgccgtcggcgccgccaccgcactcgactccagcttcttccacggcgccggcgatcccccgggcgccagcccgttccctctcaacaccagcctaagcgtgcagctgagctggttcgattcactcaagccctcactctgcagcacaactcaagaatgcaaggatttcttcggcagatcgctcttcttcgtcggcgaattcggcatcaacgactaccactcctccttcgggaggaggagcatgcaagaaatcagatcgttcgtcccggacatcatccgtaccatctccatggccgtcgagaagctgattggcgacggggcgaccacggtggtggttccgggcatgatcccgtcgggatgctcgccgccggtgctcgtcaccttcgccgacgccggcgcggcggagtacgacgcgagcaccggctgcctgagggagcccaacgaggtagcgacgctgcacaactcgctgcttctggacgccgtcgaggagctccgggagaagcacccggatgtcgccatcatgcacaccgatttgttcagacacgtctcggagatggtccagaatcctgacaagtttgggtttcaaaaggatgttctcagcgtttgctgtggaggtcccggaaaataccactacaacaccaggataatctgcggcgatgaaggtgcgaccacctgtgtggatccatccaagagcttgtactgggacggcgtccacttaaccgaggcagcttaccactacatcgccgatgattggcttcatgccataaccttatctgcaagagctacctcctaaaattgatatggcacgaacgtcggatacacacatgtaatgctagttttttttttaaaaagaactacatgtaatgttagttgttggtcgattttccttcgtgaaggaacatcagccttgcagatgatccgagtaaaattgtggagaaaaaactcctctattcaattaaattggcggtctcatcgattcgttcaaaaaaaattatgaaaaaaactgctgaacggatggatatttgaataaaattcgttcttgttgtgtaccgaa

SEQ ID NO: 28 - DNA, 1720 bp, Arabidopsis thaliana
tcacgaagggaagtatcattagttcattaccatgggagactataacatgaatgaatttgcttatggtaatctttacgatgatgatgatggcgatgttggtggatcgtctaaagaaggaaacaattcgattcagaaagtttcaatgttaccactcgttttcctcatattctacgaagtctcaggaggtcctttcggtgctgaaggtagtgtgaatgcagcaggaccattgttagctcttttagggtttgtgatcttccctttcatttggtgtatccctgaggcactaatcactgcggagatgagtacaatgtttccaataaacggcggttttgttgtttgggtctcctctgctttgggaaccttttgggggtttcaagtaggttggatgaaatggctttgcggtgttattgataacgctttgtatcctgttcttttcctcgattatttgaagtccgcggtcccggctttagctactggtttgccaagagttgcatcgatcttgatcttgactctattgcttacttacttaaactatagaggactaaccattgttggttggaccgctgtgtttatgggagttttctctatgcttccgtttgctgtaatgagtctggtttctattccgcagctcgagccttcgagatggcttgtgatggatttaggaaatgtcaactggaacttgtatctcaacacgcttttatggaatctgaactactgggattcggttagtacactggccggtgaagtggcaaatccgaagaaaacacttcctaaggctttgtgttacggtgttatctttgtcgctctttcgaacttcctccctcttttgtctggaaccggggctataccgttggatcgtgagttatggacagatggatatctagctgaggttgctaaagccatcggtggaggatggttacaattgtgggttcaagcggctgcagctacatcaaacatgggaatgtttttagccgaaatgagtagtgattcctttcagctacttggaatggctgaactcggtatacttcccgagatctttgcgcaaagatctcgctacgggacacctttactagggattctgttttcagcctcaggtgttttactcttgtcaggattaagctttcaagagattatagctgcagagaatttgctttactgtggtggaatgattttggagtttatagcatttgttagactgaggaagaaacatccggctgcatcgagaccgtataagatacctgttggaaccgttggttcgattctgatatgtgtccctccgattgtactgatatgtttggttattgttctatctactattaaagtggctcttgtgagctttgtgatggtggtcattggtttcttgatgaaaccttgtttaaatcatatggatggaaagaaatgggtcaaattctcagtctgttctgatttggcagagtttcagaaggagaatttggattgtgaagagtctttgttacgttagggatacaaaggtaaaaaagcttggaacctatagtcaaactcaaacaaactgtatatctttctgctcgttttttactttttgttcaaattctttgttctctgtttaagatcataagcacaagaagatatgtgtaaatgttgtatcattcagtttttcttttgaaatgaaacccattggtgatagcccaatacgtttatggaggcccatgagagcccaataagtaatacaaaattcatttgt

SEQ ID NO: 29 - DNA, 725 bp, Oryza sativa
ctttccttggctgtcctttgccagttaatttgatagttgccccttaacaactaaatagcgaacctctgagcagatggccttaatatctatctactgaagcttggcttcgacgaccttatcatcgaattagcgtggcagtttagctcggaagacaggcagagcaagaggtagcacatcctctccgaagggaagatatgagcgaccagagctcgtaccctaaccctgctcaagggtactaccagggtcccccagcctcggcggcggccggccaagataacacggcggccggcggtggcaagtccaacgcagccaagaaagaccaaccgagcttcatggataacctccttgcttgcctcccctgtgcccgcccagccgaagccaagaacgacgcgagctaactaaccttgctccatcaggcagcctagcacgggaaggaaggctgcaaagctactgcatgattatgcccagtgtttgtttgattattcagcatctaagtaagcacgtcgttaattagttcaatccggattgctcatttgcgttttgtgtactagtgaacgatttatgtatttgtcgggggcgcatgtaatttaatttattcccctttggattcattattcagtttatcttgtcatgattttgtgaggaaagaatctgttttacgcatggttaaattgtactactactacttcacacaattctttaaaaaattctcgaggttaaaagtt

SEQ ID NO: 30 - DNA, 1100 bp, Oryza sativa
gcagaatgctgtgttaggcaaggtagagtacactagtcacaaggctcgctctcttgcttaagcttgtgagcttggaaaagagtagtatattgagctgttgcttcgcttgctttagtttgcttgcttaccaggagaaagatatgaggaaggaaattgtcatcaggctgcagagctctgagaagggccacaagaaagctatcaaggttgctgctgcagtctccggtgtggaatccgtgacgctcgccggcgaggacaagaacctgctgctggtgatcggcttcggggtggactccaacgacctcaccgagaagctgcggaggaaggtcggccacgccgaggtggtggagctgcgcaccgtcgacgccgacgagctcatgcgcgtcgccgccgccaaccagtacccgtaccgctactaccccggcgcgccgcccccggccccgtactacggcaacggcgggtaccctcctcctcaccagcgcggcggcggcggcggcggcagcggcggtggctactacacgccgatgacgatggccacgggtggctactacggcggcggcggcggcgggtacccgcagtacgggcagtcgtcgtcgtacccgcagtacgggcagtcgtcgtcgtactacccgccggcggcggcggcgacgacgaacacgcacaccgtcgtgcaccaccagtacgccaacaacgacccggacagctgcgccatcatgtagctgcaccagctagtgtacgatcgatgctgcttctgctcgcgcgcgagcatgccggccgtcgtcgtctcgatcgtcacgatgatcggatgatcggaggacatattgcgaccgaatctagtagctgattgtcccaatcgataactggcccaaagtacgtagatataccttgaattttctgtgtgatgatgaggccgatttgattccgtgtgattactgaacaacagacaggtacgtacctgttgtctgaaactctgaagtctgaacgttatatgtgcagtagtatatgtgtagtagctgctcccggcctccaagtgtatacggtgtgcaagtgtaaattaggtgtactagggagatatatataaggtgcaagcgactttatagttc

SEQ ID NO: 31 - DNA, 620 bp, Oryza sativa
gtactactactataaataggggggcatatctgaactgagttcatatcaagctttcaatctctcatttcatccaactatacaagttcaagagtttacaagagacccagacgatcaagatgtcgtgcggtggaagttgcaactgcggttcctgcggatgcggcggtggctgcggaaagatgtaccctgacctggctgagaagatcaccaccaccaccactactgcaaccactgtcctaggtgttgcacctgagaaggggcactctgagggggttggcaaggcagctgaatctggcgaggctgcccatggctgcagctgtggctccagctgcaggtgcaacccctgcaactgctaaggccaaggcgatctatgactgaattgccaatgcaccagcctgtctacatgatgaataaataaagagtccatccagtgtgatggctcatgcctgtgtgagtgtgactgaatccatcagtgtgtgtgtgtgtttgtgtcaaccatgtgtgaatcaggtgtcaaaaatcgtggctggaaatccatgtggtttctagctttatgtaaatgttgtttgtgaaatataaatattgttttgtgtatgtgaattttactctctcatttttctctt

SEQ ID NO: 32 - DNA, 1203 bp, Oryza sativa
aagcaccaaccaaaaccaaagcagagaagaggcaagaacaactagctgcatggcaatggcgggagagagtaggaggaggaggagggcggcggcggaggcggtggcgtggtgcttggcgctgggcgtggtggcgctgctgctggtggggtcggtggagaaggaggaggaggtggtggtggtgcgcggggcgcggctggcggcggcgcggccgtgcgaggagatatacgtggtggaggaaggggagacgctgcacagcatcagcgacaggtgcggcgacccgtacatcctggagcagaacccgcacgtccacgaccccgacgacgtcttccccggcctcgtcatcaagatcacgccgcgccccggccgccgcaactgaactgaacttgctgatcgatcaacgcgttgatctatctctgatcgatcgagagatcgatcaacctgtacagtggacaccgatcgacgcgaatgtatggcggaatgcagagatggttcttgtttgtttgtgttttttcttgctttgaagtttgaaagattctgaccaaagaagggcgccgtatccgggagtttgtttcgtcgtcgtttgcttcgtttgacgatgatgaaccagaaccacacgtactggaacagaggacgctgcgagtggctactggctagtaagtggctagtagtgtagtggtagtagttaggcaggcaaccttgcctggtgtgtgtgtgctttgttcattccgttatactagaggctagttgtcagttggttacctgaagtgaactgatgcagtggttggtaaaagaaaaaactgagactgatgtttgttagatgcgtaagcaagcttgccgtaattgtggcgtgttgataaaagtgcggctaagaaatagttaagtgtaatatagttaagctttcaattgaagaatttaccatttgtcactctaccaaaatactagtgctcaaatgccactctcccaaatattcattcctaaatgtcacccggacctcaccacttatgtttgaatgaaaagtgaggctgacatgtgcgttcggatggcatttgggaatgaaaatttaggagagtggtatttgagtgctatcattttggtagttgcaaatagtaaattctccccctattttctatgacactaaactcagcccaatactataaattggactaaaatatattttgaaacggaggtagtagtataacatat

SEQ ID NO: 33 - DNA, 2278 bp, Oryza sativa
tcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccagctcggggacttcggcgggggagaggaagctaatgccgacgatagaagatgagctggacaggaggcagatgctctacagcctcctcatgcccgtcatgaacttgtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgaccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgttcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctacc

SEQ ID NO: 34 - DNA, 1707 bp, Zea mays
cagcacagctcccaggcttccatcgtatcccctctcattaattccagctccaacatctctctcctagctacatctctccactgtctgtttgcctgtcgaggccgggcgccagcagcaacaatggcgaggatgatcagccggccggccgtcctcctctcccccctggccatgatcgtcgtggccgccgccgtcatggcgctggcaccggcgccggtggccgcgaccaagtacaacatcaccaagattctggcgccctacaaggagtactccaagttcaacgacatgctgtccaagacgcgcctcgcgtacgacatcaaccggcgccagaccatcaccgtgctggccgtcgacaactccgccatgtcggcgctcgaccactactcgctgcagaccatccgccacatcctcgagctgcacgttctcgtcgactactacggcgacaagaagctcaagaagctcgcccatggctccaccgcttcctcctccatgttccaggctaccgggtcggcgtctggcatgtcggggtacgtgaacatcacccggaaggacggcaaggttagcttcatgacggaggacgccgacgacaccgcgaagccgtcccggtacgtcaagtccgtcaaggagttcccctacgacatcgccgtgctccaggtgagctccatcatctcgtccgccgaggccgaggcgccggtgccgcccccggcgcccgtggacctcgaggagctcctatccaagaggtactgcaagtccttcgcgtccctgctctccgccaacgccgaggtgttccgcgccgtgaacgagaccaaggacaacgggctgacgctcttctgccccgtcgactcggccgtcgcggccttcgcggccacgtacaagaacctcacggccaaggccaaggcggccatcctcctctaccacgccgtgccggactacttctcgctgcagctgctcaagtccaacaacggcatggtcaccacgctggccaccgccagcgacaagaagatggactacagctacgacgtcaagaacaaaggcgagacggtcacgctgcagaccagggtcgtcacgtccagcgtcaccgccaccgttggcgacatggagccgttggccgtgtatgccgtgaacaagttcctgcagcccaaggagctcttcaaggtcgtcgaggcgcccgcgcccgcgccggagccgtccaagaagaagaaggctggtcgcggcgggagtgacgacgattcctcggacgattcgggagattcgaccgccgatgctgagaagggcgacgcagcaccggctctgctcgtgcgatggctagtcaccgcggtcgcgacagcgggagttgcatatgccctgatgggataaacttctatcagtcacctgaattatattcggactttcatttgatttgagtattctttttctttcagtgttaaatttgttttcacttattataatggtgctctcgatcggttaaggtatataaactataagagtttattataagctttttatccaggccaatcatgcagaaacagatatatagttcaaacacattgcttccaacgcaaagacctgcttgtactttctgacctatgactcagagcgcgatgctccaaccgtgtccaaattatgaacctttattttgacgtcaagagcctgttctttttttaatgtaaatggcagaagaaaaatgagtaccgcagagacgatctttgt

SEQ ID NO: 35 - DNA, 1617 bp, Oryza sativa
ggaagcagcaatagcagctcaaaaccccgcaacaacccaaccctcgtgaccaacccatctccccaccaaccccggccgccgccatgaccggcgccgtctccaagctcgccgccccgaggccggcggccgccgcgccgctcccgccggcgtccgtccgctccgcgttcctcgcctccgccccctccccgcgccgcttctccgtctccatcgccgccggccgcgccaggagccccatcattgcgatggcttctgccaaggaaggaaatggtgccccaacgaagaggacaacccttcatgatctctatgatctccagggtcagtccccgtggtacgacaacctctgccgtcctgtcaccgatttgctgccccttattggcagcggcgtccgtggagtcaccagcaacccatcaattttccagaaagccatctcgacttccaatgcatacgatgaccagttcaagcagcttatattagctggaaaggacgcagagagcgcttattgggaacttgtcatcaaggatatccaagatgcgtgcaaactttttgagcctatctacgaccagaccgatggggcagatgggtatgtttctgtggaggtctcccctaggctggcaaatgatacccagggaactgttgaagctgcaaaatggttgcacaaagtggtcgacaggcccaatgtctacataaagatccctgctaccgcagaatgtgttccttctatcaaggaagttattgctaatggcattagtgtcaacgtcacacttatcttctcgattgcaagatacgaggctgtgattgatgcttacattgatggacttgaggcctctggtttgagtgacctatcccgagtgaccagtgtagcgtccttctttgtcagccgagttgacacacttattgacaaaatgctcgagaagatcggaacacctgaggcacttgccctcagaggaaaggctgctgtagcacaggcaaagctagccaaccagctttaccagaagaaattctctggcccgaggtgggaggctttggtcaagaaaggtgccaagaagcagaggttgttgtgggcatctaccagtgtgaagaaccctgcatacccagacactctttacgtggatcctctcatcggacctgacaccgtttctaccatgcccgaccaagctctgctggcattcatcgaccacggcacagtttcgaggacaatcgacgcaaacgtttcggatgctgaaggtgtatacagtgccctggagaagctgggtatagattgggatgaggttggcaagcagctagagctggaaggtgtggactccttcaagaaggccttcgacagcctgcttgggagcttggaggagaagggcaattccctcaagaagaccgtgagcctgtaggtgcaaagatagctgaaatgttttgaacgctggcaatggcaagtgaacgattactaaataaatgctctaccttgctggctctctccctctctcaaactctcttgtgatgtgctgctctcgaatttctgggtcagcttttgtattctaggcgctcttggctgctatttgtgtaactgaggttgcgaactgctatgcattttctgataaattgttgggcaagttgatttcatgtgta

SEQ ID NO: 36 - DNA, 1379 bp, Oryza sativa
gcattgcagagttcagtgtaacaaagacactgaagctacagcctacagagagagagtatctggatacttaattgtgtgcttagcttgcggttaagcaatggcttattccaggcaaatcttcgtctgctctgccatggctgcgttgctcttctctgctgttgtttcggcgcagctctccactgatttctacgacgagacatgccccgacgcgctcgacatcatcgaatctgccgtcagagacgccgtttccaaggagtctcgcatgggagcttcgctgctgcgcctccatttccacgactgctttgtcaatgggtgtgacgggtcagtgctgctcgacgacacggcggccatcaccggcgagaagaacgcgaagccgaacaagaactccctccgcggcttcgaggtcgtcgacgacatcaagtcgcagctcgaggacgcctgcgagcaggtcgtctcctgcgccgacatcctcgccgtcgccgcccgcgactccgtcgtcgccctgggcgggccgacgtgggacgtcgagctgggccggcgagacgggacgacggcgagcctggacgcggcgaacaacgacctcccgccgccgacgtccgacctcgccgacctgatcaagtccttctccgacaagggcctgacggcgagcgacatgatcgcgctgtcgggcgcgcacaccatcgggcaagccaggtgcaccaactttcgcggccgcctctacaacgagaccaacctcgacgccaccctcgccacctcgctgaagccgagttgccccaaccccaccggcggcgacgacaacacggcgccgctcgacccggccacctcctacgtgttcgacaacttctactacaggaacctcctgaggaacaagggccttctgcactcggaccagcagctgttcagcggcggctccgccgacgcgcagaccaccgcctacgccaccgacatggccggcttcttcgacgacttccgtggcgccatggtgaagatgggcggcatcggcgtcgtcaccggctccggtggccaggtcagggttaactgcaggaaggtcaattaaagtggttgataccgtgatcagtgttaatgtggttggttagtgtcaggtttcttaataccgtgatcagtgttaatgtggtttgtacaagtgttcttctttccttcagcgatgtagtctgcttcgaacggttgtagcactactatacgcaaaaataatctgatgaaggaacaaagactggttcctactgaaaaatcgtgttgcacaagaccttgttttactggaattattatgtttgtaatcaaatagagataactagaaatgagatgacacagttgcatgggaatgggaatcactaattagtactgtcaaaattgcagattac

SEQ ID NO: 37 - DNA, 2063 bp, Oryza sativa
gctttgcctcccttcctacccaacacgaggcagagaggagaagctccccccgctcaactcaccaaaaccctcctcccctcgaaatccttcccaagacgccgcacgcttctccatttcatataagattcccgagagacgccgccgcccgagaggcgtgggccgcgcgcgccgaaacatatcccgccggggcgccgccatggccggcgaggtggccatcgactccggcgagaagcgcctcaacgagctcgggtacaagcaggagctccgcagggagatgactctgttcaagacgctggccatctccttctcgacgatgacgctgttcaccgggatcacgccgctgtacgggagcagcctgcggtacacggggccggccagcctcgtctggggctgggtcgtcgtctccttcttcacctggttcgtcggcttcgccatggccgagatctgctcttccttccccaccactggttctctgtacttttgggctgctcatctggctggcccagtctggggcccgttggcatcttggtgctgtgcttggttagaggccataggtcttattgccggaattggtacacaggcattcgcgggatctcaagttctgcagagcataatcctgctatgcaccggcacgaacaaaggcggcggctacctgacccctcgctggctgttcctcctcatgtacatcggcctaaccttcatctgggccgtgctcaacaccttcgcgctggaagtcatcgccttcctcgacctgatctcgatgtggtggcaggtgatcggtggcacggtgatagtgatcgtgctgccgctggtggcgaagacgacgcagccggcgtcgtacgtgttcacgcacttcgagacggcgccggaggcgaccgggatacggagcagcgcctacgccaccatcctgtccctcctggtgagccagtactccctgtacggctacgacgcggcggcgcacctcaccgaggagaccaagggcgccgacaagaacgggcccatcgccatcctctccagcatcggcatcatcaccgtcttcggctgggcctacatcctcgccctcaccttcagcatccaggacttcagctacctgttcgacccgagcaacgagacggccggcacgttcgtgccggcgcagatcctgttcgacgcgttccacggccggtacggctcctccgcgggcgccatcgccctcctcttcgtcatctggggctccttcttcttcggcggcctctccatcaccaccagcgccgcgcgcgtcgtgtacgcgctgtcccgcgaccgcggcgtcccgctctcctccgtgtggcgccgcgtccacccgcgccaccgcgtccccgccaacgccgtctggctctgcgccgccgcgtgcgcgctgctgggcctccccatcctgtggatcaacgtcgtcttcacggccatcacgtcgatcgcaaccatcggctgggtcggcggctacgccgtgcccatcttcgcccgcatggtgatgcgggaggaggacttctcgccggggcccttctacctccggcgcgcgtcgcggccggtgtgcctcgtcgcgttcctgtggatctgctacacctgcaccgtgttcctcctcccgacggcgtacccgatcagcgccggcaacttcaactacgcccccgtcgcgctcggcgcctgcctcggcctcatcgggctctggtgggtgctcgacgccaggaggtggttcaagggacccgtcaggaacatcgacgatcctctgaaagatggtggtggtgatggcgtccataacaatggcaacaaggtctaagtatggtttaggttgttactggagtacttagtttgagcagatcattagctcaagccaaattgatcacattctcgatagagtttttttttccctctcttgtgttgtctcctactttgttgtgtacgtgtactattctgtgacactatcaatggggttagtttaggatgtggagaaaactttgtgccatatagaatgacttaaattagttacatgtatcacatacttagaacagagcacgcaagcattatgaagacacaaactaaattaaattgta

SEQ ID NO: 38 - DNA, 533 bp, Populus trichocarpa
cttgtgcactgcattgaaaaatggcgactccaatgaagtacatttgcttgtttatgtttcttgcaattctcagcattgctgggctcaatcaagttgacggggctggtgaatgtgggaaaaacaccactcctgacatggaggctttcaagatggctccttgtgcatcagcagcacaggatgagaattcttcagtttcgagccagtgctgcgctcgggtgaagaaaattggacagaacccagcgtgcctttgtgctgttatgctttccaacactgctaagagctctggaatcaagccagaaattgcaatgaccattcccaaacgatgcaacattgctgatcgtcccgtgggctacaagtgtggagcttatactttaccttgaagagtgaagaccatgaactgtgctcgccctgtaaagtactttctatcaacctgctggagttcacatcattgttgctagttcttctagctaacaaatgtagtgtaacatccagacatctgaataataaataactattggtgcttaatctcctct

SEQ ID NO: 39 - DNA, 1052 bp, Glycine max
gttcaatgtgggaaccaagtaattttggtcattgattaattctgcaattgagcagaggagccatggccaaaatcgcacttggaagcacccgagaggccactcagccagactgcattcaggccctcatcgttgaattcatagccaccttcctctttgtctttgttggcgttggttcttccatggtcgttgacaagcttggtggggatgcactagtgggattgtttgctgtggccgtggcacatgcacttgtggtggctgtaatgatctccgccgcccacatttccggtggccacctcaaccccgccgtcacccttggcctcctcgccggtggtcacatcactatctttcgttccatgctctattggattgatcaattagtagcagccgcaacagcttcttatctcctttactacctctcaggaggacaggcaactccagttcatacgctggccagtggagtggggtatggtcaaggagtagtttgggagattgtgttgacgttttctttgttgttcactgtgtatgcgaccatggtggatcccaagaagggagcacttgctgggcttgggccaacgctggttgggtttgtggttggggccaacatcctcgcaggtggggcttactctgctgcttctatgaacccagcaaggtcttttgggcctgccttggtcgctggaaactggaccgatcattgggtttactgggttgggcctctcattggtggtggccttgctggttacatctatgagactttcttcattgaccgatctcatgttccacttcctcgtgatgaagaaaactaaacaataggattgacaacttgcactttcatcccttcttaaaaaatgctgcattattgtagttaatttaatctaataataatctttttttttgcgtgttatgtatgtttgaaaaggtctatttatgtataatatatcgttaaatgatcttccccaaaataagatcaacgatttagttgagatctggcaccctgtgtagactttgtggacaggaatgaatgaataaatatatatttcaatggcttctgcttt

SEQ ID NO: 40 - DNA, 1332 bp, Oryza sativa
ggagacgaggagagataaacccccccgtattcgcaggctcatcgacttctcgtcttcctctcctctctctcgtttcgattcccccgcgagagattcgatccaaccaaacccacccgctaccagcgtcttctccttcgcgagcaagttttttgagagtttgcaatgggaggaagcgaatacgatgatgactgggagttgcctagcgctgacatcactgtagttctttgcggcaaacttggctgtggcaagagcgcaactggcaatagcatcgttggaagagaagcatttgtatcagagtactcccatgctagtgtgaccagtacttgtcaattggccagcaccgcgctaaaggatggccgtaccctcaatgttattgatacgccaggattatttgaaatgaccattacatctgaggatgccggtaaagaaattgttaagtgtatgagtatggccaaggatgggatacatgcagtgctgatggttttttctgccacatctcgttttactcgagaagattccagtaccattgagacaattaaagagtttttcggagagaagattgttgatcacatgatactagtatttacttatggagatttagttggtgaaaataaattgaagagcatgctgaataatgccccagagtatctgcagaaaactgttgagctatgcaaaaacagagttgttctctttgataatatgaccaaggaccgatggctccaagagaagcaacttgaaaatttgcttgatgttgttgactctgtgaatacaaataatggaggaaagccattttcagatcaaatgctcgcttgcattaaggaagcacatgccagagaacaggaggtgcatgatgctattggatatacagaagagcaaatatctgaattgaaaaaggagatccagagaactcgggatgaacagcttgcaaacattaccaacatggtggaggaaaagctgaatatcactgttgacaagctgcaacagcaactcatggaagaacagaatgcaaggctagaagcagagaggttggcagctgaagctaggctccgatcagatgaggagatccgcaagctcaaaaagcgcctcgagaaggcccaacaagaaaatgaggaattccgaaagatggcttctcaacacaagtgttctattctatgagtagctttctcctaggatcaagctgctgccatggttgaatgctccgtgcattgttaatagagttcagaacagtgctctaggctatgtggttgacataaaacttttgctactgggctatctcatatctgtaaatatacaggtatttggatttttaatgtccaaggattttgactatca

SEQ ID NO: 41 - DNA, 844 bp, Populus trichocarpa
accatcaaactattttagaaggatctgtttaatttgagacagaaaacatgaaatcctcctacactttcttcattcttttctcactcttttcgtttgctaacgtgatcggtgctagaaaagacactggagagtattggagagctgtcatgaaagatcagcccatgccagaagcaatacatggccttattcgcgaaaccacattgtcatcagtctccaatgagaaagccgattgccacacaaccgagtccaatgaaaagaataattttgtcaaggattttggcccacagcctactgttacatcttatgacaacggtataaaaccagcaaaagataagtccttctcgaaagatttccacccaaacactcagttgttcctttacaatgatggtgtcgttaaaggagagagatcctttgctgaggatgttgagccgaggcctaatgtgtccgtttaccacgacgacgctactcttaaaggagaaaaatcttttccggaggacttcgaaccaggacctaacgtatcagtttatgatgatggtgtcgggcttaaaggaaaaaaatcgttttcggatgaatttgaaccaagaccaagtgttacagcttatagcaactaattagcgagacaaagttgctagttgatatgctcaaggtctcttaattacgatggagcagaagtgattttagctaagcccgctatggtttgtgacatacttaaataaatgtttcccttaattaggggcttataagcgagctagcgtgtttaattaagcaatgtaagatgttttttcttcatgtaatattactataagaagtttgtgagaatttcctcgttttaatgtgtttctta

SEQ ID NO: 42 - DNA, 861 bp, Populus trichocarpa
ttctatataaagcctgtccaacctagctcttttacccagtcattattttctttgagagtgcatagatttgtgttgatatagaaaacaatggcactacatggaaagattgagacaacattagaactcaagtcctccgcagagaagttctacaaagtgtggaggagccagtccttccatgttcccaaacatgcttccaagcatatccaaggagttgatatacatgcaggtgactgggagactgtgggctctatcaggatttggcagtacacaatcggaggaaaagccggggtctttaaagaggaggtttccttcgacgatgagaacaagatcataactcttaatggcttggaaggagatgtcatgaaaatttacaaggtctataggcccatctggcagcttacaccaaaaggctcgggctgcttggcaaaactgaccattgaatacgagaaactccgtcctgaagtccccgttccagagatttatgttgattttatggttcatatgaccaaagacatcgacgaatcccttagcacggaggaatagaaggggtgatcgatctcggacaataagcatcacatgtctgtgatcatgccagtacctgtttaatatatttctaagctttcgtgcaacgagtttcagtactgcatcaatgggtgtgatttgtggggagatcttgtgttgtatttcctttgtgtaatctataaaactattaaataaaagtagaagctaaagctgcggctgcttcctcgtttgtaatgttatttcatctctctttttgtctcgctcaaatagtttcgtgtatggtcactatatatattcagacccgatggaacccgatgggactgtaatttggtattgtta

SEQ ID NO: 43 - DNA, 1016 bp, Solanum lycopersicum
gggggccttgtatagtggtggactcgctttctctctctaaaaatcaagagagagaaaaagggcacaaggatatagaggagtccattagtctacactttttctcacctttgaattcttctttgtttgcttgctaagcgaaatcgaagaaaacccacaaaaccagatcggcgatccaccgaaaagcaagaaatcggttgtaaatgggtcaacagaaggctttgatctatgcgtttgtcggtcgtgggaatgttatattggctgaatacacagatttcagtggtaacttcaactccatagcttatcagtgtcttcagaagctacctgcttccaataacaagttcacctataattgtgatggtcataccttcaactaccttgttgataatggattcacgtactgcgtggttgctgaggagtctgttggaagacaaattccaatagcgtttttggagcgcattaaggatgatttcatgtcaaaatatgggagtgggaaggctgcgacagctcctcctaatagcctgaacaaggaatttggccctaagttgaaggagcatatgcagtattgtgctgaacaccctgaggaaattagcaaacttgccaaggtgaaagcacaggtttcagaagttaagggtgttatgatggaaaacattgagaaggttcttgatcgtggagagaagatagagcttcttgttgataagacagagaaccttcatcaccaggcacaggacttcaggaacacgggaacccaaatacggaggaagatgtggctgcaaaacatgaaaatcaagctgatagtgttaggtatcctgatagctttgatcctcatcattgttctctcagtttgcaagggattcaattgtggaaagtgagggaggatgtttctattgtgatgctatagttgtatgaaaagctttgtcctatatcagcatttacatttctgtgagaatagagacgatgtatgttctgtatgtattagcctacttactttttttctgtttgttgaagcagaatggatc

SEQ ID NO: 44 - DNA, 1439 bp, Solanum lycopersicum
ggtttagaacatttaataagattattcctaaaattattttgttatcagcaaagacattcatacagttagtagctgacatatttttctataaatttggaggttattctgactttgcctagcacacaaagtaagagaagagagagactttgaagatggaagcaaactctaactctgctgtgcccctctgtactccttacaaactggggagattcaaactcactcatagaatagtttttccagcacttacgaggaacagatcacaaaataatactccacagccacatttaactgaatactattctcaaagagctactaatggagggcttatcatttctgaagcagctgctgcatctgatatttctaaggagtgccctaacttgcctggaatatggaatgaggagcaagtggaagcatggaaaccagtagtgaatggtgttcatgagaaaggaggcgtcttcttttgtcaaatttggcattcaggccgcttatctgtcccgactgttagtgcattatttttctcgatcggcattggctggtccacaagacctgatgataaagtgtatgcgaaaccaacacctcttcctctggagtctgataaaattccttgcattgtaaatgatttcaggattgcagcccgtaacgcgattaaagctggatttgatggaattgagatcaacgcttcaagtggcggctacctgattgatgaattcatgaatgatcaagtccatggttggactgatgaatatgatgaaagtattaaggaccgttgtcgtcttgccctggaaattgtagaagcagtggcaaatgaaattggagctgataaaattggtataaaattatctccttttgatggcaaaaaggactcaaattcagaagcactagcaacttacatggcaaatgaactaagcaagcttggcgttctctatcttcatgtgatggagcccagagaaacagttaatagaagtcttcttcccattaggaaggcttttaaggggacacttattgcttctggtggttatggtaaatctgatggagagaaagccatcgacgagaattatgcagatttgatctcatttggacgtatgttcttggctaatccagatttaccaaagcgttttgaggttaatgctccacttaacaagtataataggagcactttctacaccaatgatccaattattggctacactgattatccatttcttgaagttgcttcctaattattcacatgtatatctcgcaggagttgtgtctactctaattaaatgcaattaataaatgatcatgttggtgttgtgtctatgatgagaactctgttgtattataaaataagttcacatggttatgtaaagaatcatgtagagttgtgtgtacatttgatgaaaacactgtatggttggtttgcttgtgttgaaattgaaggtttatttgtaagtttt

SEQ ID NO: 45 - DNA, 1041 bp, Glycine max
tgatagtggtgcaaatttatagataaaatcataggacttctatgtgaagcataatcaatcaatcatttacgtgctgtgtcaggtattcttagcttagcagcgagcttatccagtagactgatgggaagtgttccattggcctccgctgctgctcttgccagaaggctagaagggaaggtggcactgataactggtggagcaagtggtataggtgagtgcacagcaagacttttctccaagcatggagccaaagtggtgattgctgatatccaagacgagttaggccactcaatttgcaaagacttggattcatcttcagctacttacattcattgtgatgtcacaaaagaagaaaacatcgaacacgccgtgaacacgaccgtttccaagtacggtaaactagacatcatgcacagcagcgcaggtatagttggcgcatggaaccccagcatattgcacaacaagaagtctcactttgagcaagttatcagtgtcaacctggtgggcacattcctgggaatcaagcacgccgcgagggtgatgatcccttctgggcgtggcagcatagttgcaatggctagcatttgtggaagaattggtggcgtggcttcgcatgcctatacgagctcgaagcacggcatcgtgggactggtgcgaaacactgccgtggagcttggaaccttagggatcagagtgaatagtgtgtctccttatgcggtccctacgcccatgagtaaaactttcctcaacactgatgatgaggggattgctgcactgtattccaatcttaaagggactgttcttaagccccaggatgtggctgaagctgttctttacttgggaagtgacgagtccaagtatgttagtggccatgaccttgttgtagatgggggtttcactgtcgtaaaccctggtttgtgtgtgtttgggcaatccgtgtaggtttttaatttgtactttaagtcgtttcaagtgttttgaattacatcagccaaataatgaccaaataataaaacttttgatatattgtttggacctgtt

SEQ ID NO: 46 - DNA, 1074 bp, Oryza sativa
acctcctcctcctcccctctcgccgggttaaacaacgaggaaaacctaacctaatcgggaaaaaatatcggaggaatccagaagcggggggctcccaccttgttggcgacgatgctgcgcgcgggagggaggcggctcttggcccccgggctccggcgggtcctcggcggcggggcggccgctccggtggccgtgggcggggcgaaggcgtaccacgagcgggtggtggaccactacgagaacccgcggaacgtggggtcgttcgagaacgacgaccccagcgtcgggacggggctggtgggggcgccggcctgcggcgacgtgatgaagctgcagatccgcgtcgacgagagctccggcaagatcgtcgacgcatgcttcaagacctttgggtgcggatccgccatcgcgtcctcctccgtcgctactgaatgggtaaagggcaagcaaatggaggaagtagtgactataaaaaacactgagattgccaagcacttgtcacttccaccagtaaagctccattgtagcatgcttgctgaggatgcaattaaagctgccgtgaaagactatgaagcaaagaaggcgaagctagcacaaaagggtgaagagaaggctgccgaagcatgagtgccagaggttctgtcatgaagaatgttgcagtgccctgcgtactcgtagtaaagaacctgtcatgaagaagtctctgctctgcttcttgctggcgggaaatagtgtgtaacgctcacaaactctatgcagcatgtatcataaggatgaaggcaaacatttttgaataaatgtgctgtcatcttgaaagaaaaaaaaaaggtgtatgcgtgtgtatggcctagtaatgaacatatggtacggaattacggtcgcgagataaggcacattgtttctctttggttgtttcaattagtcttaggttgagttggtagatgctcatgaacttgagttgcctggtcacttgcatcatttttctttttttttaaaaaaataactgtttagtagttctccgtgtttctccatccaacaggaatgcagaatagttattgttttgagagttctcct

SEQ ID NO: 47 - DNA, 1953 bp, Vitis vinifera
ctctcctcttccttccatggataactctgtagctccaatggtgattactgatgatggtcttcaagagaccgccatctcctccaagacaaatccctccaaaggtcgatggagagctgccattttcatcatctttgttgaaatggcagagaggtttgcttactacggggtggccggaaacctcttcacctacctcaccaatgtcctcggtgagcacaccgccaccgccgccaaaaatgtaaacacctgggtcggcgtctccgccatcttcccgttgctcggaggctttatcgctgattcctaccttggtcgcttcaagaccattatagcatcctctgttatttacctcgccggactactcttgatgactttgtcggtatcagtgcaatcactccgacatcaccgcgcagtgtttttcacggcgctgtacatactatccataggagaaggagggcacaaaccatgcgtgcagacctttgcagccgaccaattcgatgaagacaccgtggaggagaagaaggacaagagctccttcttcaattggtggtacgtggggatagtggtcggctccaccaccgccatcctcgtggtgatttatgtgcaggacaatgtggggtgggggctcggctttggaatgctggcggcggccgtagcagcagctctgctattattcctaattggaattagaagttaccggcgccagcgcccagtgggcagccctctgactagggtgatgcaagtgttggtggccaccgccaggaagctgcgcgtgaacgagacgcgctatggccgaggtgtttgtttggaggatgagggcgatgatggggtggaggagggtggcaggcgaggcaggagtttggctcctacaaatcaattcagatttttggataaggcaaccatcattgacgatattgatgcctcaaccaaggtgagaaaccactggaggctatgcccagcgacccaagtggaggaagtgaaacttctcttcagcctgtttcctatttggttgagttgcttgacatttgccactgtgatagcacaaatgagcacctacttcaccaagcaaggcagcactctggagagatcaattggctcccacttctccatacccccagcttcacttcaagtctgcactggcctcactatccttgtttccgtcggactatatgatcgggtccttgtcccggttgctagaaaattcactggactcccctctggtataacaatgctccagaggataggcactggaatattcttttccatgcttaccatggttgtagcagctcttgtagagaccaaaaggatcagcgttgccatagaccatggcctcacggattctcccagaacaactctccccatgaaaatatggtggttgctcccacaatacatgctgacgggaatgtgtgatgtgttcaccattgttgggatgcaggagcttttctacgaccaaatgcctgaagagatgagaagcattggagctgccttgtacatcagcacagtgggcgtggggagcctcatgagcagtgcagctatatcaattgtgcaggctataacatcaagagctggaggaaaatggctgggagataatctgaatcgtgcccacctcaattacttctactcggtgttggcaggatgtagtgctttgaatttgattgtttacatctgggttgctaagcgctttgtgtacaaaaaaactggatatgatgatccgaaaggagaacagaaaaaagcagcagagcttgcataggtactttgatcatgagaagagattgactaaaatggaggtttatgcttgagaagtctttgcagatgtagaagtaataatttgagtctcacgttctcattctgtatgtgaatatataatatcactcaattcatggggacttgagtcatacccttaatgcaatcatgtattcctgttggtgatccaatcaaaatcttgatcaggtttgaaaa

SEQ ID NO: 48 - DNA, 1656 bp, Zea mays
caacaacggccgcggcagccgcagagagacaaggtggacacgacaggactacaggacaccgccccgaagcggcacctgcaaggcggccgagaaaagcgcagccctgcgcccctgccacgactcggccacctctccctctggtctcctcctccacttgctcctgctcctccagacctccactccacccctccaaaaggtctagtaaaatagaaggaagccgcccccaatcgttcggtcgttcctagcccggcgcacggcgcacgaaggggttcgatcggatcggcgccggcggaggcgagatgtgggagtcggtggcgctgacgctggcgggcaccgccggcaataacatcggcaaggtcctgcagaagaagggcaccctcatcctccctccactctccctcaagctcaaggtggtcaaggcgtacgcgtcgaaccagctctggatcagcggtttccttatggacatgtgcggtgccgcgctcatgctcaccgcgctctctcaggcgccggtctccgtcgttcagcccattgctggttgcggtctcgcaatactctgcgttttctcccatttttacctcaaggaggttatgaacggcctcgattggattgccatcacgctagctggtctcggcaccataggtgtaggtgttggaggtgaggaacagaaagttgaccagatacctcttttaaatataccctggctagtgctctccattgtcatcttgtttgtactgctcaacacttggcttcatatgtataaaaagcaaaggcgtgagcaagagttgactggacctgaagtgattgaggagatcatatatggcttagaatcaggcattttgtttgggatttcttcagtgatctctaagatgggatttgtgatgtccgagatgggttttccaaagattgttgtgcctgctgccatatcttgtagtgtttgctgcagtgcagtgggatttgtgtatcagactcgaggcctcaagcatgggagggcaattgttgtatctacatgtacatcagtggcatctatagtgtccggtgttgttgctggcatgattgcacttgatgaacatctgcctaaagctcccacagctcgatttttcctcttactgggatggttcttcatcatcacaggagtaatactgcttgttagttcaacccgattgattgcgcgtctacctaggcctgttcagaagtttttgaagagcaacatagagcgcacccacagcatcaggaggcctggttcagcacgagggaaggatcccatcccaacaacaacgatccatacgtcgtcactgcacttgcttgcttctccaacaaaggagaaggcctagaaaaatgttggcactagagcaacttcgtttcggcgcctcacgtttgccatgtcattgattgattgaatggttccgtgaacgtagtctagagtagcatcttaaaagcttgggtttggttattcaccatactgccctttataggtctaacagagacttggggaaaaattgctgagtttttatcaggtctcgttttttttgtttggttgctgagtgcaaaatccgaagctgttactctctgacccttcttaactctcgtcatggaaagtatgttggtcaaacttaaagactagatttatagataaatattattaatgtttgtgttttt

SEQ ID NO: 49 - DNA, 2030 bp, Oryza sativa
agctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggcgcggcggggttcgtcggcacgcactgctcgctggcgctgagggcgcgcggcgacggcgtgctggggctcgacaacttcaacgcctactacgacccggagctgaagcgcgcgcggcagaggctcctcgccggccgcggcgtgctcgtgctcgacgccgacatcaacgacgcgctcctgctcgagaagctgttcgacctggtgccgttcacccacgtgctgcacctcgccgcgcaggccggcgtgcgctacgccatggaggcgccgcagacgtacgtggcgtccaacgtggccgggctcgtgaccgtcctcgaggtcgccgccaagcacgccgacccgcagccggcgatcgtctgggcgtcgtcgtcgtcggtgtacggcctcaacaccgacgcacccttctccgaggagcaccgcaccgaccggccggcgtcgctgtacgcggcgaccaagaaggccggcgaggccatcgcgcacacgtacaaccacatctacggcctctccatcaccggcctccgcttcttcaccgtgtacgggccatggggccgccccgacatggcctacttcttcttcgccaagagcatcgtctccggcgagcccatcacgctgttccgcgccgccgacggcgccgacgcgcgccgcgatttcacctacatcgacgacgtcgtcaagggctgcctcggcgcgctcgacacctccggcaagagcaccggctcctccaagtccggcaagaagtccggcccggcgccgctccgcgtctacaacctcggcaacacctcgccggtgccggtcacccgcatggtcgccatcctcgagaagctcctcggcaagaaggccaacaagcgcatcgtcgccatgcccagcaatggcgacgtgcccttcacccacgccaacgtcacccacgccgcccacgacttcggctaccgccccaccacctccctcgacgccggcctccgccacttcgtcgactggttcgccgactactacaagctcaagctcgacgtccccaagatcgccgccaaggtcgccggcgccggcaagccctcctcctcgtcggcctccaagaagaagaagaaggccgcggcgatgtcggcgtcatcatgatcgagcagcacaacaccatgagacaccatgcaagtgtgtattccatagctagttcttggaggctcttgtctgtataacattgtaagtgcttattgtttaagcccctattaatttcttttcttcttcttcttgaggtgtttaatttttagtgattagaaacaagggaataatggtggagaaataacactgttgttggtagataaatatgagaggggtatagagatgatgataaagatcaaaaacacttggaagccaggacagaaagaaagatgaagtcactggcttccttcgaatcaaaatgtctcttttttttcttgttcttttcttttacagtgtcatcacttgttctgttcttgttccacctgatgatgtaagccatatcaacatgctgttgctgatggaatccaatccaatccaatccacatcatgaagct

SEQ ID NO: 50 - DNA, 1795 bp, Oryza sativa
ggggtaccgcactgtggcagccatggagtccggtgggctaatcgcgccatccgagacatgttcgtccgacggtcgtggcggcggcggcggcggctggcgcgccgcgcgcttcctcatcgccgtcgggttcctggagcgcatcgggttcaacggcgtgcagggcaatctggtgatgtacctgaccgggccgatgggcatgtcgacggcggcggcggccgccggcgccaacgcctggggcgggaccgtgctggtgctgacgctcgtcggcgcgctcgccgccgactcgcgcctcgggcggtaccgcgccatcgtggccgccggcgtgctccatctcctgagtttgggaatgctgacgatctcatcagtgatgcaaccaaatcatcctcacccggcgagctgccatgacgcagccgccgcctgctcgccgtcgccgccgccgccgccatctctcgcccgcctcgtcttcttccacgccgcgctctacctgctagcgctggcgcagggcttccacaacccgtgctccgaagccttcggcgccgaccagttcgcggcgagcgaccccggcgcgcgcgcgtcccggagctcctacttcaactggtaccagttcttcaattccttcggctatggcatctccaacaccgcgctcagctacgtcgaggacagcgtcagctgcaccgtcgggttcgccgtgtgcttggccacgacggcggtgtacctccccatcttcttgctcggcacgcgggcgtaccgcgccgagcaacccgtcgacggcgccctgctcgcgcgcctcgccaagacgtcctcctcggcggcgcgtgcgtggacggcgagggtgtttcgccggaaggatacctcttgcacagaacggcttctggcgagggaagaggtaggcgagaaggggttccttgccaagttgcttccgatctgggtgaccagcatagtgttcgccatcgtcagcgcgcaagaggtcaccctgttcatcaagcagggcagcacaatggaccggcgcatcggcgcgcgcgggggcctcgtcgtgccgcccgctgctctgcagtccattgtcagcgtcatcttcctcaccttcgtgccggtctacgaccgcgccctcgtgccgctcgcgaggcgcttcacggggcaccccgcgggcatcaccacgctccagcgcgtcggcgtcggcatggccatgtcctgcctcgccatggccgtggcggcgctcgtcgaggccaaacggctccgcgccgcgagcgacgccggcctgatcgaccggccggacgcgacggtgccgatgggcgtgtggtggctggtgccgcagtacgccctcgtcggcctatcgaaggtgttcggcatcatcgggctcgacgagttcttctacgaccaggtgcccgacgacctgcgcagcgtcgggctcgccatgtccctgagcgtgcgcggcgtcgggagctacgctagcggcgtgctcgtgtcggcgatcgactgcgcgacgaggagcgggggagagagctggttctccgacaacctcaaccgcgcgcacctcgactacttctactggatcctcgccgcgctcgccgctttggaggtcgccgtgttcgtctacatcgcgaagcgatacgtctacaagaacaaaggcgagccatgattcttccgagttcggattagagtgtgtaataagtctgaaaaatggtccacatgctcaaagatgtgtactctttcccgtttcataattcttacattttacataaggttaaggttaaacttttataactttaattatcaataactttaaagtatttagttt

SEQ ID NO: 51 - DNA, 2053 bp, Sorghum bicolor
agcggcaccagtatatggtgatgtgatcgccgcggcctgtcgcctcgttctactccagtacaccacaccgtacacgcagctgcggcgtaccggggcagcacggcaatggacgccaacacccttctcctgccctgctccgacggcgccgtcgccggcgcggtggacttccgcgggcggcccgcgtcccggtccggcaccggccgatggtccgccgcgatgttcgtcctcggggtggagatagcggagaggttcgcgtaccacggggtgtcggcgaacctgatcagctacctgacggggccgctgggggagtcgaccgcgggcgcggcggccgcgatcaacgcgtggagcggggtggcgaccatgctgcccttgctcatggcgtgcgtggccgacgcctggctcgggcgctaccgcaccatcgtcctcgcctccctcctcttcgtcgtgagcatgggcatgctgaccgtctcggcgctcccggcgttccaccacgacggctgcagcagctacgcctccagctcgctggcctgctccccgtcccccgcgcaagtgggcgtcttctacgtctcgctgtacctggtggcgctcgccgaggccgggcacaagccctgcgcgcaggcgttcggcgcggaccagttcgaccagaacgaccccaaggagtccgtgtccaggagctccttcttcaactggtggtacttcggcatgtgctccggcaccgccgtcacgaccatggtgtccagctacatccaggacaacgtcggctggggcctcggcttcggcatcccctgcctcgtcatggtcttcgcgctcctcatgttcctgctcggcaccaggaattaccgctactacacgtccaccgaatcgagcccctttgctcgcctcgcccgagctttcatcgcgctcatcaaaggctccaaatcgagccaatctgacggcactctcgcgagcgacgacgacgccgggcaccgggaagaagtgaaaggcgtgctgcgcctgttccccatctgggcgacgtgcatcatctacgccgtgatcttctcgcagtcgtccacgttcttcacgaagcaggccgcgacgctggaccgccggatcggtccgacgctgcgtgtgccgccggcggcgctgcagacgttcatcagcgtgaccatcatggtcttcatcccggtctacgaccgcgcgttcgtgcccctggcgcggcggctcacgcgcctgtcgtcgggcatcaccatgctgcagcggatcggcacggggctcgtcctggccctggtcgccatggtcgtggcggcgctggtggagatgcggcggctcggcgtggcgagggacgccgggctcgtggaccagcccaaggcggcgctgccgatgagcctgtggtggatggtgccgcagtacgtgctgttcgggctctcggacgtgttcgccatgatcggcctgcaggagttcttctacgaccaggtccccgacgcgctgcgcagcctcgggctggcactcttcctcagcatcttcggcgtgggccacttgttcagcagcttcatcatctccgccatcgacggagccaccaagaagagcggggcgagctggttctccaacaacctcaaccgcgcgcacctcgactacttctactggctgctcgccggcctctgcgccgtggagttggccgcgttcgtcatcgtctcgcgcgtttacgtgtataagaagagggtgtctcacgacaataatgatgctgtcatgtagatcagtagacgtactctatgcttagtgcttacggtgctgcgaatggtgatacctgatatatatgattgaggtaatgaggtgtaaacgttcggtacgctaaaccttggtatgatactatacttgcacagtactaataaatagtgtcggtagcacccgtaatagcgtctgctatagtggtagcggtcctctatgctctattgcgctaccactacaaaagatacaaaacttagcggacgctatagcacctagaattcgctattgttgttctgttttttttttaaggtcaacggggggaattgctccccacctgatttttatttct

SEQ ID NO: 52 - DNA, 2371 bp, Arabidopsis thaliana
acgcaaacacaagtccttgtccttccttcctcaatcaaacaacaccttctttaatccagaacaaaaaaaaacaaacagaagaaaaaaaaaaaaaaaaactacaaaaaaaaaatctctgcccgcttctccgttctcggggttgcgtcaaaattgcaccaaattaatcaaaacctacccagaaatcatttttggtcacaggggataggcgggcagatttaaattttcttcttttgttcttctgtttgaatttgtattgattcgtgaaattgtgtttgtttgatggggtttttggtggatacgcaaaaggaaggaggtggacattcatggggttacgttagaagtttggttagaaggaaacaagtcgactctgctaatggccaatctcatggtcaccaacttgctagagccctcactgttcctcatctcgttgcaattggtgttggagcaacaataggagctggagtttatattcttgtaggaacagttgcgagagagcattcaggaccttctcttgctttgtcttttcttattgctggaattgctgctggtctttctgcgttttgttatgctgaactctctagtcgttgcccttcagctgggagtgcgtatcactattcttacatttgtgttggtgaaggtgttgcgtggataatcggttgggcgttgattctggagtataccattggtggctcagctgttgcccgtggcatatcccctaatctggcactgatttttggtggtgaagatggtttgcctgcaattttagcgcgccaccagatcccaggccttgatattgttgttgatccatgtgctgctattcttgtgtttgttgtaactggccttttgtgcatgggaataaaggagagcacatttgctcagggaattgtaactgcagtcaatgtgtgtgtcctgttatttgtcatagtagctggcagttatctcggcttcaagacaggttggcctggttatgaacttccaacagggttctttccattcggagtagatggaatgtttgctggttctgctacagtcttttttgcattcattgggtttgattcggttgcaagtaccgcagaggaggtgagaaatccccaacgggatttaccgattggtattggtcttgctctcttgttatgttgttctctctacatgatggtctccatagttattgttggtttaattccttactatgcaatggatcccgacaccccgatatcctctgcattcgctagtcatgacatgcaatgggctgtatacttaataactttaggagctgtcatggcactctgctcagctttaatgggtgcccttctccctcagccacgaattctgatggcaatggctagggatggtctgctcccttctattttttcagacattaataaacgcacacaggttccggttaaagcaacagtggcaactgggttgtgtgctgcaaccttagcgttctttatggatgtttcacagcttgcagggatggtgagtgttgggacacttctggcatttacaatggtggcaatatcagtgttgatactaagatatgttcctccagatgagcaacctcttccgtcatctcttcaagagagaattgattctgtttcctttatatgtggtgaaacaacgtcatccggtcatgttggtacttccgatagcagtcaccagcctttaatagttaataatgatgctttggtcgatgtcccacttatcaagaatcaagaagctctagggtgtttggttctcagcgaggaaaccagaaggattgtcgctggatggagcattatgttcacatgtgttggggccttccttttaagttatgcggcatcaagcctgagcttcccagggcttattagatatccgttgtgtggtgttggtggatgtctcctccttgctggtttgattgctctgagttccatagatcaggatgatgcgagacacacttttggacattctggaggttacatgtgcccgtttgttcccctcctacctatcatctgcattctcatcaacatgtaccttttggttaaccttggatctgcgacatgggctcgtgtatcggtgtggctgcttataggagtgattgtgtatgttttctatggtcggaaaaacagttcgcttgccaatgcagtttacgtaactacagctcatgcggaggagatatatcgcgaacatgaaggttctttggcatagtctgagaaagcagcatctcttttgttatatatgtaacacaaatctgtattatctttatctggatgtaacagcaagagtggcactatctatttgtttgcaaaaagatctgtccacggcctttgtaaataatatatatcatcatcaattcataatcaggaaagactcacttttcagttctcaagaa

SEQ ID NO: 53 - DNA, 1435 bp, Oryza sativa
gcgctccctccctgcccccgcgacagcgacgccgagcgagcgagagcgcgcagctagccacagcctccagagctatagctacagcgcgatcgagagagaaggggggagacagtgaggccgagagcgagagggccagccacgcacgcacgcacgccaccgcgctccattggccaccccctcgccatcgccacgattaaactactctcttgctactccccctccatccatccacacactccaccatttcctcttcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgacgacgacgacgacggccaagttgatgccccacttcggcagcgacgacgtcgacgcggggctcttcctccggccgtcgtcgcagcatcatccgccgccgccgcacgccggtgccggcttcacgtcctccgagccggccgccgaccaccagtccttcaacttccactcgagctggccgtcgtccacggagcagacctgcagcagcacgccatggtgggaattcgagagcgagtgagcatccacactgttactactaggctactcatggatgatccatcgatcgccacagatcatgcatgccacgatcagaatttcaattcgccgcgaggacggatcaaacctgtactagatcggatcagagcaaacatagcagagaagatgatcaaaccaacagtgatgtgtacatagctttctgtagatcaaaaccccaggcagtctcctctccatccagccatcagcatgcgaaaattctctctctctttttttcccctccaagtcttactcgacttcgatgttgttatcacaacaccacatcatgtaatccagcaacacgccgagatgaaaaaaaggttaaaaagcttatagagttcgttcatttgatggatccaa

SEQ ID NO: 54 - DNA, 1492 bp, Zea mays
agaaaaaaaaaaaagaggcgccgcagcgaggtcgaggtgattattatttaggcacaaggggcgctgtccggaaattccccaaatcgacctgggctggacccagccgcgccccgtctgcctcctgcttctctctccgcttccgcttcctgcgcctccaggctccacttctccgctcggcagtcggcactggaaggacagcatgtcggtctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctccaccatttccagtgccaacctccaatagcgcttatattgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacatacttcaagatttctgatatcagtgaggtgcgagtagaaggattggaaactctggattacctagacaacttacaagatagagctcgttccactgaacaaggcgatgcaattgtttttgaatccgaactggacagaatatatctgggcacaccatcgaaaattgccattattgatcatgagaagaaaagaacatttgttgtgaggaaaggaggccttcctgatgctgttgtttggaacccctgggataaaaaagcaaaggctatgtcagattttggggatgatgaatataaacgaatggtatgcgtggaggcggctgctattgaaaagactgtcactctgaagcctggtgaagagtggactggaaagttggaactttctgctgtgccatctagctattacagtggtcagctagaccctgaccgtgtgattcaggattccactgtcccggaggactccatcagctagtccttattctatttttgcaggtagagcattgtatcattatgcataagagatgctggcaacaagggctgtccacatgtttcttccattctgttcaaatcttcggtgtttttttattccgaatgcatatccgaaccaaggaatgtgaaattggtttccgctttttgaggatctatgtagcataatggataagtcggtgtttcgtaccctatttagggatgcttgaagcaagaaacatcttcatgggttgtaaaataaaagaaaaattctctttatatttgatca

SEQ ID NO: 55 - DNA, 2236 bp, Oryza sativa
aagatccatacctaccaaccaaacttgaattggtttagtagtgttgcctccagcctcctcctcctccaacctctctcccaacaaaagcatttcatagcctaattcaatcattatagagggaaaagcagcaagaattaaggtgtagcaacctgcaaaaatgcgcgccaaagtggagctagccgtcctcctcttggtcctcgtcggcgtcgccgccgggacccggccgccgtcggcgccgccgccggtgacggaggacacacttcagaaggtggccggctcgctggaaatgtacgtcgacgagctccctcagatgcccaagatctacggcttctccatgagacacggtcacccctctcccattcgtctcaccatcggcatgtaccagaagaaatggaaattccaccgcgacctgccggcgagcaccgtgttcgtgttcgggacgtcggcggcgacggccacgttcccggggcccaccatcgaggcagcgcagggggtcccactgtcagtgacgtggcagaactacctccccgcgcgccacatcctcccgtgggaccccaccgtgcccaccgccatcccgcgccgcggcggcgtccccaccgtcgtccacctccacggcggcgcccacccgccgcagtccgatggcagcgccttcgcctggttcaccgccggcttcggcgagaccggcccggcgtggtcgacgccgacgtacacctaccccaacgcgcagtcccccggcgtgctctggtaccacgaccacgccctcggcctcacccgcgccaacctcctcgccggactcctcggcgcctacgtcatccgcaacccggcggtggaggcgccgctcggcctcccctgcggcgacgagttcgaccgcgtcctcatgctcgccgaccggagcttctacgccgacggctccatctatatgaactacaccggcatcatccccaacatccacccgcagtggcagccggagtacttcggcgaggccatcaccgtcaacggcaaggcatggccgttcctcgccgtcgcccgccgccgctaccgcttccgcatcatcaacaccagcaacgcgcgctacttcaacctctccctcaccaacggcctccccttcaccgtcgtcggctccgacaccaactacctctccaagccggtcaccgcggcgagcctcctcgtctccgtcgccgagacgttcgacgtcgtcgtcgacttctcccagtccaccagctccgaggcggagctggtcaacacggcgccgtacccgtaccccgacggccaagcgcccaacgacctcaacggcaaggtgatgaagttcgtgatctcgccggcgaaggcgaaggacacctccagggtgccggcgaagctgctcgactacgtcgctgtcgccgaggaagaggcagtgcagaggcggtacatcgtgatgtacgagtacgaggacgccgccaccggcaacccgacgcacctgtacatcaacgggaagaggctggaggacccggcgacggagacgccgcggccggggacgacggaggtgtgggaggtgatcaacctgacgccggacaaccacccgctccacctccacctcgcgacgttccaggcgacgcgcgtccgcgggctcgtcgacgaggacgcgttcaagggctgcatgacgaagctcaacgacgcggtgaggtgcaacgtgagccggcacgccgtcggcgaggaggtggcggtgccggagcacgagaaggggtggaagaacgtggtcaagatcgcgccggggtacatgacgacgatcgtcgtcaagttcttcatggtcgacagcggcaagccgtacccgttcgacgccacggccgagcccggctacgtctatcactgccacattctggatcatgaggacaacgccatgattcgcccgctaaagctgatcaaatgaagacatttttaaggaaatgatgatcagagtacaagaagcaatccagtaccaagtgtaaatgggatccctgaacagagaaaagcaatgagattataatttattttagaaattgtttaagatgttgtatcacaataacttaataagctgtaggccatgtgtttgtactttgtaggtaaagtaagcatttgttttaggagacagaaagcaaaaaactatgtctcctaaatttgtcatagttgtccttcctttttcactctgttcttcatgtattcttgactctgctaaatgccaaataatgaaagttattctctccaactttcagtctttttc

SEQ ID NO: 56 - DNA, 1127 bp, Triticum aestivum
tatacggcgacccacgcgtccgcgactggagcacgaggacactgacatggactgaaggagtagaaaaccccttgatcgatcacacatcaaacccctccacacgctcgcccgcgcgcgccacggacgcagcaatggccgccctcaccgcctccatcgccacctccagcgccttcgccgcgaagccgcgcctggcccgcccgccggcgcgcctctccgtctcctgctccgcgtccagcggcgacaacaacaccccctcgctctccgcctccatcaagaccttctcggccgcgctggcgctctcgtccgtgctcctctcctccgccgccacctccccgccgccggcggccgccgacatcgccggcctgaccccgtgcaaggagtccaaggcgttcgccaagcgggagaagcagtcggtgaagaagctcaactcgtcgctcaagaagtacgcgcccgactcggcccccgcgctcgccatccaggccaccatcgagaagaccaagcgccggttcgagaactacggcaagttcggcctgctctgcggctccgacggcctgccccacctcatcgtcagcggcgaccagcggcactggggcgagttcatcacccccggcgtgctcttcctctacatcgccggctggatcgggtgggtcggccgcagctacctcatcgccgtcagcggcgagaagaagcccgccatgcgggagatcatcatcgacgtcgagctcgccgccaggatcatccccaggggcttcatctggcccgtcgccgcctaccgcgagctcatcaacggcgacctcgtcgtcgacgacgccgacatcggctactaagtagctgccatgcgtgcgtggttggctagtcagtcccaactcagatgggcagcggaggattgagggcttgtggtgtcgatctgcgtgggcttggtgtaggagctgataggatcctggagaaatggaagctcgtctcttgtatttaagaaactgaacccaatcttgtataactattgtgttctctcttcacatgtgtgtattttacaattgttcaaattgttgagaaccatttcatgatgcacagcataccatgagtgaaaatgtgccaacatgcataggaaactcaactttaaaaaaggt

SEQ ID NO: 57 - DNA, 1222 bp, Oryza sativa
gtactactctgcccattgataggctgctggtgatcacaagctacacaacacatcacacaagcaataggcatctctctcttctttctctttctcctccttgcttcatttggagtactagagattaatttcttgaaggagagaaatgacaagtgtctggaagaccaaggttctcactggactcaacaagctctttgacaaggatggaaagaaggctgctgctgctgagttcttgaaatcattcaacaaggaggagattggcaaggagattgatgacaagaagacagagctagagcccaaggttgtggaggttgttgagtcatctcctcctgagattaaggctttgttgaaggacaaaaaaacagccagcaaaatcaagaagaacggtcctgcagtcactaagttccttgaggaattggctaagattgatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactccagaagcaagcaaagctaagctagcttagctaagcttagctgatggtaattaaaatcaagattaaggttaatgtgatcacactactctctctcagtctctgcacaaaaagtaagtaaaaatcaagatacacacacttggcatgcaagaacatttgttattgaattctttcaccctttgatcctttcatctctctcctatatatatatatggtcgcctcatcggttgtaaattaatttatgtggggtttcttgttttttgggggtgattaaacatgtgtaattatattcatatgtttgttggtcatgatcataaggagcttgtgtatattatccatatctttttttttcttttgtttacaaattttcggcttgaggtgtgatgaagatagacatatatatgcaccctctccaattgtaatacaaattaatggctgtggatatatgttcatatggtac

SEQ ID NO: 58 - DNA, 896 bp, Arabidopsis thaliana
aaaaacctgtataaaaccaaagactccctcacgactaattcttcttcttcattagcagattaaacaaatctcaacattcgaatttttaaaaattcttcaaaatctcttcttcaatggcgacgggaaagagttactacgctaggcctagctatcgatttctcggcaccgatcagccgtcttacttcaccgcttccgattcaggtctcgaattcgacgaatccgatctcttcaatccaatccactccgattcaccagatttttgccgtaaaatctcttcatcagtcagatccggtaaaaaatcgtcgaatcgtccctccgccgcttcctccgccgcagcagcgtcgtcgcttcctgttaacgtgccggactggtccaagattctccgcggagaataccgcgataaccgacggagaagcatcgaggataacgacgacgatgacgatgataacgaagacggtggcgattggttaccgccgcatgagtttctggcgaagacgagaatggcttcgttctcggttcatgaaggagtagggaggacattgaaaggaagagatctgagtagggttcgaaatgcaatttttgaaaaatttgggttccaagattaaatatttggaaacttttggagttttcctttaatttttggcttacttcaatcattttctcaagtaactgtcagagaagagagagagcatgtaatatttctagaaatgccctccatttatcgttatattccgaaaatcttaccctatgtaattgtttttttaacttttgagatttttatcacattttgcgtaatgagtaatagataatgttttctttttttggaagagtgtttgttttgtttattaagcagttgattttatgggaattaaaatctgaacattctgatttttggg

SEQ ID NO: 59 - DNA, 1574 bp, Oryza sativa
caaggtaggcaaggcacgcgagccctagccgccagccgactcgaccagcgcccggaggcggagcacccgccgccgccgccctcgccatcgtcggcttcacccctcatcggcaacctagtgcaggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactagatgatgatgataagcagtggggaactatggacatattaggtgctttcggatgctgttgcgtttaaataaatttaacgtatggacaccgtttacatgttattaggcgtcaggtgaggtttctgagtgtgtaaatcggtggcagatgcttatgccttttttgttgggggatcgagcaagacgagttttcctagttgaaaacatgccaaattattgtctgtgaaagcgtttcttgagattgttattgatgtggttcctagtcgattatatagattatcactccattgtagc

SEQ ID NO: 60 - DNA, 1325 bp, Gossypium hirsutum
atcagttcaatatttcctggtaaacaggaaggcattgcagtaggaaggacttttgctgctcttaagaattataaagtggatggtaacaaggaaatgatggctattgggctgatgaacatggttggctcctccacttcttgctacattacaactggcgccttctctcgatcagcggttaatcacaatgcaggagcgaaaagtgcagtgtctaacatagtaatgtcgattacggttatggtgacccttctctttctcatgcctttattccagtacaccccaaacgtggtgttgggagctatcattgtgtcagctgtagttggccttatagacattccagcagcctgtcaaatttggaagatcgacaaattcgatttcattgtgatgttgtgtgctttcttcggtgttattttcatctcggtccaagatggtcttgccatggcagttgggatgtctattttcaagatcctccagcaaattactaggccaaaaacagtgatgttggggaacattcccgggacagatattttccgggatcttcaccactacaaagaatcgatgaagatcccgggtttccttatcctaagcattgaagctcctatcaacttcgctaactccacatatctgaatgagaggatcttgagatggattgaagaatatgaagccgaagatcataagaagcagtcaagccttcaatttgtggttttagtgatgtcagcggtgagtaccatagacacgagtggcgtatcaatctttaaagaactgaagaaaacagtggaaaagaaaggagctgagcttgtgttggtgaatcctttgggagaggtgatggaaaaattgcaaaaatcagatgaagcaggagatttcatgagaccagattgcttgttcttgacagtaggggaagctgttgcgacacttacagcaacaatcaaaagccaggtctccaatcatgtagtatgaacaaaaccaaaaatataactccacaaaagctatcatgttgtggtgttttacaatgagaatatcaaaagtatttcatattattaaaaaatatatatatcaagccgtttggttttccacatattttctccccgttcactatcttcctacttcccctcttgtcttactactgcaaaacataaattcaatgaccttgcaattggttttgcattccaataaaacataagataaaatgttatacattccctagacttttaggtttttttttttttaagtatcacattggctgcctccctcgctacactcgcgaattgcgttcttcgaatgttttcttcgatcttctgtgatggatctcttctctattcttctaattg

SEQ ID NO: 61 - DNA, 2369 bp, Zea mays
cattgggtacctcgaagctcgtctcttctggaaccgtccctcgctcgtcatctcttccgccttcgctacgcaattcctgatccacgctgcgggccacttgtgacgactggcggaagcccgtcagagaaagaacagaggccggcaggcgagcggcgatcggagatggcgccggagaagccccggaaggaacaggaggaggagttgatgctggaggatggaggcatcgaggagagcccgcgccgcagcttcgaggactgcggcgactccgaggaggaccgcggggagggcgatgacgaggaggagcgggacagcgaccgcgacggcgtcggttcgacgcgctccttcctgccccaaaagtggccgcagagctacagggaaacaactgatacttacacaatcgctgcatcaccgagctttggttacttgggcccttctacaagcaaatactcactcctcgatcttggtcgtagtggtctgggttctgacctgaagttgcctctaktgtcggacaaggctgacggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgctggtgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttatataccgagctatatacatattgtgtggaattcattattttggagggtgataacctcacawcaatttttcctaaagctggwtttgattggyttggsattcatgttgatgggaagcattttttcggagtgttaactgctattttagtcttgccaacagtatggctgcgagatcttcgagtgctctcttacctttcagcgggtggtgtgattgcaactcttctcgtattcctgtccgttggtttagtcggtgctaccgatggtataggcttccattcaactgggaaggcagtaaactggagtggcatgccttttgccattggtatttatggattttgctactccgggcattcggtatttccaaatatctaccagtcaatgtccgatagatctaagttccctaaggcactgttcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatttagttgtactgtagcaagttcctgtgctgccgattgttcctaggataagcttctgccttttacagttgaggcatctatatatacggcgacgactactgtacaatcagagtacaccttatgtacagtcaggatcagctagcactatattcttagaacttggtcgagtgcagcgaggatgcatgttcgttggccttttatggtgccmccatggtcgaagccatagcctgagcatgataatggcgccatgcactgttgtcttgtatcatatgcgctgttctatctcaagttctttttgaaggaagcaggcttgatttgtttgtagtgtgacgttttgtgtgtcaatgcaaaagaataatttggtga

SEQ ID NO: 62 - DNA, 1633 bp, Zea mays
tgtaggaataatcttctgtgatacaacaaccatgtagccaccgatcctaatgagtcatgcataatagcagacacaggcaacagtgccccgtgagcacatgcaggatcagcagtacgacctccgactccgagctactgctcaccctctcgggctctcggcccgcccgtatgccagtctgtctctggtacactccttcatttcatcgcctagctagctactatatagtacgacctgcctgccttgctcttgccctgtgagcagcggcgtgcgatcgatcgaggcagtcgtagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtcgatggcaacggccatgaccaacttgatccccgccatcaccttcgtcatggcggcatcagtcggcctagagagggtggaggccaggaggccgaggagcctggccaagatcttcggcacggccgtctgcgtgagcggcgccatggccatggctttcttcaagggcccgaagctgctcggcgacggcccgaacgctctccagctcctcctccacgcgggcggcggcggcaggtgggtggccggcgcgctcttcctcgtgggcagcagctcctgctggtcgctctggctcatcctgcaggtgcccatctgcaagtcgtacgtggagccgctggctctgtcggcgtggatgtgcgtcctgtccacgctccagtccgcgctgctcgtctccttcctcctgccggaccccagcgcctggaggatccactcgctcttcgagctctcctgctgcgtcttctcgggcgtgttcgggtccggcgtcacgttctacctgcagtcgtggtgcatctccgtgaggggcccgctctactccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaacaagggcggggtggagccagagcaccactcggacgatctggagaagacgtcatcagcgcggtcggatcccaattcgacggccggcgtcggcagtggcatcgccgagcccctcctggcgggcggcgatccaacggagaagtagatgggattttgctgctcttcaagtgttctgtgcgtgcgcgcgcggtgttttcagggtcggtatgctagtgctactgtaacagtgccgtcccagttttgtcatgtacactagtggcagcttcaaatgactccgtgctgccgatgtgtattatccgcacaattttgttaagcaacgcggcgtccccgtcc

SEQ ID NO: 63 - DNA, 1470 bp, Zea mays
gagttcgaaagaaagggagaaaatgttatgcttgcttgccttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgtctgcccccaccccgaatctgatgcttcatcgattggttctaatcctcactacctccatattcatgcacgagattgcgcgtgattaggagcagggaccaatcatattgaactcagatttggagcggagcaggagggggagccattgccggtgttctgattgctgctggaggtcgagggatggtaggggtgctgtcgaatcgcgtggatcgggacgacctcaaggccggggatcacatctacacttggcgggccgcctacatctacgcccaccacggaatatatgctggagatggcatggttatccattttacaagggcagctggacatgagattggaacaggaacattcttggactggttcctttatagctcctctccggcagcaactgagggtcctccctgccagaaatgtgggcacctagtcaagtccgatggggtcatcacctcttgcctcgattgcttcttagatgggggcagcctgtacctctttgactacgctgtgtcgcctgctttcttcctcgccaaagcacggggaggaacgtgcaccctggctgcctctgaccccagtgacgttgtgatccaccgtgcacggtacctcctggacaatgggtttggcatgtactccctgttcaagaacaactgcgaggacttcgccatatactgcaagactgggctgcttgtggagaccgctttcagtgttggccgtagcgggcaacttgcgtctctgactgctgccttcagcgccgtggcctcgtcccccttgcgtttcctgacaaccagtgctggtggcctggcaattgtgaccagcggcatgtactgtgtcgggcggtatgtgtcggatattggtgtccggcgtgatgttgtcaaggtccctgtcgaaaggcttgtggagcagaatgttacttggattcctcagtgtgtggctacagagacagatatcgcggcaggagcaccgcagcagcagttggaggttccttgtgcggttgccgaggaagcatccgttatacagcccgcggcaccgtgatccattgctgaaatgtcatcatgtaccaggtgttggcatgagacaggacaactggaactacgtacttgtgtggaagtacatgtaatgatgtatctggtggtgttatgcaatccattgctgctgctgctaatgttgcaagcaatgatgatgatgatggatgtggttccatgaccgctattattacagaattgagaagacctgtatttgcccttgatgattaatgatttctgttatacagttgcttatggatgcatctgattgtgc

SEQ ID NO: 64 - DNA, 737 bp, Arabidopsis thaliana
ataagatagatctctttcttctcgctctcgcatctatcagagggagaggatctctactccgatctcaatcgaagttttagatttcgtttttttgtttccggtttaccggatcagtgtatattttcgccttgtacgatttaataattctgattttgttttcgattatgtccgaaactttctcgctcttgcgagtcttcgatctcactctcctgacactattgacatcttcgctcttcttcacaatcctctttgtttccgccaatttgctcgaggaataatatattcatctttcccctattgctcatgatgtttgagcaaggattcaactacatcaacttaggtgtggccagtgatggagcttccccgaagttggcgttaatcggagagtttttgaagcagtttttctactcaaatccggaagaaacttggcgttgtgggctcaagcttagagatcgacatgaggaaagaggattcacatcgcctcaaagccgattgacggtggctgatcggaatttttgcggtgtcccggtgaacccgacaatgaggctcaacgtcatgacacgtggcttaaggacgacacgttcgttacacgtgttagacactaaatcaacttgcgtttcttgtttatctttattttaatttggtttggcctgggcttatatccatgtaatttttttgaaccttctgtatttcctgcctttgggctttaatcaaaggaaattgctggaaaaaaaaaa

SEQ ID NO: 65 - DNA, 2451 bp, Arabidopsis thaliana
attgatcatcatgatgttatattccattacaatcaaacatatatgtgacatataatcacaaattttcttataatttgttatgttatttactgagaaagagatctgatcgctttataagtccgcataaagagacaccacaactttctttcttcttcattcacttctatcaacgccaaatttgcagactttcccaggaccaaaattatattaaaaaaaagttccttttttctgatcaaattgtgaaattcgcttgcttgctttcttcacagtcaattaattctctaacaaaacattcttcgatcgttcgttttcatcttctatgcttctctgatcagacacaagaacacaaccaaagaaactcactatagcttgtctgtagattctgatgttcgaattcttgttgttgatgatgattgaattgatgatgatgatggtttgatgcagatgggttttcaaaaatctcatcttttttcttaacaaatcaaaaagcttagaacttgttgaacaatactagagactagagaatttgcagataatctgtttcaaaaatggatgctacgagtggaactccgagtttacagtatattaacttgccggaacaatctgtttcgactacttctcctcctgtgtcaccatttcagaggccaaaacgacattgctttggtgacacaactccaggagagtttcctttagcagctaacccttccattgtcctacatgttctcactgaatgtagattggatcctcgtgacctcgctaatctcgaggcaacatgctcgttctttagccagccagcaaactttgccccggacattaacctatcactatcggagctcgctgctctcgacatgtgtaataaaagggtgattttcaagccgatgaatgaagaagaacgtcaagagatgaaacgtaggtgcggaggatcatggaaattagtccttcggtttttgctggctggtgaagcgtgttgtcgaagagagaaatctcaagctgttgctggtcctggtcatagtgtagcagtcacatcgaaaggagaagtttatactttcggatataataactctggacagctaggacatggtcataccgaggacgaagctcgaattcaacctgttagatcattgcagggagttcgaatcatccaagcagctgctggtgctgctcggacaatgctaataagcgatgacggaaaagtttatgcgtgtggaaaagaatccttcggggaagctgaatacggagggcaagggactaaaccagttacaactcctcagcttgtaacatctttaaaaaacatatttgtagtgcaagcagctattgggaattactttaccgctgttctctcccgagaaggaaaggtttatacattctcgtggggcaatgacggtagactaggacaccaaactgaggctgcggatgtcgagcctcgtcctttgttaggcccactcgagaatgtacccgttgtgcagattgctgctggttattgctaccttcttgccttagcctgtcaaccaaatggcatgtctgtttactcagttggttgcggtttgggaggcaaacttggtcatgggtcaagaacagatgagaagtatcctcgggtcatcgagcagtttcagatattgaatcttcaacctagggtagttgcagcgggtgcttggcatgccgcggtggtaggtcaggatggaagagtgtgcacttggggttggggaagatatggatgtttaggtcacggtaacgaggagtgtgaatcagtccctaaggttgttgaaggtctaagccatgtcaaagcagttcatgtcgcaacaggagactacactacttttgtggtctcagacgatggtgatgtttactcgtttggctgcggcgaatccgctagtctcggtcaccatccatcctttgatgaacagggtaatcgacatgcaaacgtgctaagtccaacggtagtaacatcgctaaaacaagtgaacgagcggatggtccagataagtctaacgaactccatatactggaacgctcatacatttgcgctcacggaatcggggaagctattcgcgtttggtgcaggcgatcagggtcagcttggaacagagcttggtaagaaccaaaaagaaaggtgtgtaccggaaaaagtggatatcgatctcagctagctagctgacttatgtggtttggttggtaagaaactacgtttgacatcaaggaaacaaaaacgcaagaaaatttgcgtttgctttttatgttcataagacttggaagcttgtacaaaaaggggaataacataaacttgtctttaacatttcattgtatagggtttttagattattctaattgttcattggttaagttttaggttatgttgttaataattatcaaataatttcattaaatcaaattattgtcagattcaatttctaccaaatttttattttattttctgttttcatatttgttggg

SEQ ID NO: 66 - DNA, 1225 bp, Glycine max
aggagacaaagacgtcggtgcattgagaaatgtgaaaaaaaaatattatcacttgtgtggacttgtcaatgttcccgttaaatttccaactttgcaactacaagaagacagcattcacctacacagcaattgaaaatccacaccgaagattgacctttgtacaacggtgctagaaaccgcgtcactagtaataactattggattgagacatgcacttaacagtaaggcccccaactaatataaaaaccagttattgggtgtgttactcatcagcaactacaacgtgagaaacatggcttccttaagctccttagtgctgctccttgcagctctaattctatcccctcaagttcttgcaaactatgagaatcccccagtgtacaagcctcccactgagaaaccaccagtttataagcccccagttgagaagcctcctgtttacaaacctccagttgaaaaccccccaatttataagcctccagtagagaagccaccagtgtacaagcccccagttgagaaacccccagtgtacaagcccccagttgaaaaaccaccagtgtacaagcccccagttgagaaaccaccagtgtacaagcccccagttgaaaaacccccagtttacaagcccccagttgaaaaacccccagtgtacaagcccccagttgaaaaaccaccagtgtacaagcccccagttgagaagcccccagtttacaagcccccagttgagaagccaccagtttacaagcccccagttgagaagccaccagtatacaagccaccagttgagaagcctccagtgtacaagccaccagtagagaagcctccagtttacaagccaccagtagagaaacctccagtttacaagcccccagtggagaaacctcctatttacaagccacctgttgagaagcctccggtctacaagccaccatatggaaagccaccatacccaaagtaccctccaactgatgacacccatttctgaaggatgtcaagaggtgtattgagtatatgctaaataagaggtgctcaaaatgtagttatagattacaaattattgcaagggttgctcttagcttcttcatttcaagcttttgtttacactttgcagtgctatggcaaagataagagtatcatggatggaaaaaggggggggaaaaatgttgctttgtactccaaattatgaataatagaactttatattatttatcagattattaatcct

SEQ ID NO: 67 - DNA, 1028 bp, Arabidopsis thaliana
gacaagatacaatgagaatgttagttcttcgcactcccaccggacctgtctccgccgtcagattcatcaccaaatccaaaccttctcctttctcttctcccgattcatggctcctccctgcaccaaacactcaccggagtcgtccccgcgtcgtcctcgctctctctaaccccgacggaagcgtcaactcaaaaccctcaacctcagcttctcaaatcccttcttcaggagatgaaacagttttcgtgggtcaagataatgttcctctcgagggcgtgattcaattcgataaaccgtcatctacttcatcttctaacattaccaaatggggtcgtgtggctttacttgcgggtggtgatgttttagctctgcttatcttctctgccattgggagatttagccatggtttccctgttttttctcttgatactctccacacagctgaccctttcattgcgggatggtttctgagtgcttatttcttggggggttatgcggaggaaggacgaggaatgaagggaaagtctaaagctgtggttgcagctgcgaaatcttggattgtcggaactccgcttggaattatcattaggtcagcttcatcaggtcacattccggcatatagctttgtgttggtgacaatgggaagtactgctgttttacttataggatggagagcattgttattcagtgtgcttcctacagagtccaagaagaaagatgatacgtatcggaagggtagtgcattcgagctatttgagttgcttacttcattgataagacgatggtgaaggagcatccatgaatattcggtcggttggaggttgagatttaagtatgcacaacaaaaatgtaaatgtactttgtcacaagtcacaaccgctaacagatcatataaatatgtgtgttgagaagttccaggaccaagtgtaatatcgatatagttgcagtggccagtggaggaggaaagcaatgatgagagatgatttgtctcaagtcaaacaataaacagaggaagtaaactccagtac

SEQ ID NO: 68 - DNA, 1469 bp, Arabidopsis thaliana
gttttaaaagtgttaaagacgatcattcatcatcaacactaacactttttcaaattgtcgtctaaagtctctaaaaccaccatcgaagtcttgacagagagaattcgaatcggacagagaatttcttccgtagtttttcttgtaagcgaaaaagaagtttagttagctcgtgtgagagaagggtgtaatgagctgttttggttggtgtgggagtgaggattttcgcaacgctactgacactggcccaaggccagcgcataacccagcaggttacaatggaggccactaccaaagagctgatccacccatgaaccagcctgttattcccatgcagcctatttctgtaccagccattccagtggatgagctgagagatataactgataactatggttcaaagaccttgatcggcgagggttcttatggaagagtgttttatggtgttcttaaaagcggtggtgcagctgccatcaagaaacttgactctagtaagcagccagatcaagaatttctttcccagatatcaatggtttcgagattgcgacatgacaatgttactgcacttatgggctattgtgttgatggccctctccgtgttcttgcttatgaatttgctcctaaaggatctcttcatgatactcttcatggcaaaaaaggtgccaaaggagcacttagaggtcctgttatgacgtggcaacagagagtcaaaatcgccgttggtgcggccagaggacttgagtacttgcatgagaaggtgagccctcaggttatccaccgagacatcaaatccagcaacgtacttctgtttgatgatgatgttgccaaaattggtgattttgatctgtctgatcaagcccctgacatggctgctcgccttcactcaactcgtgtgctaggaacctttggctaccacgctccagaatatgcaatgacaggaacgttgagctcaaagagcgatgtgtacagttttggcgttgttctgctggagctcctaactggtcgtaaaccagtcgatcataccttaccgcgtggacaacaaagtctagtgacatgggcaacccctaaactaagtgaagacaaagtgaagcaatgcgttgatgcaagactactcggagagtaccctcccaaagctgttggcaagctagctgcagtggctgcactctgtgtgcaatatgaggcaaatttcagaccaaacatgagcattgtggtgaaggcacttcaacctcttttaaaccctcctcgttctgctccgcagactccacataggaacccctactgatcaaatattcaatcccccatatctcatcttctgatcatgatgattcatcaaatgtgtattattcattttggttctgtattgtgtaaatttatgggaccttatctcattaactcttcattctcaagtcccacttttcaagacatgtgtatgtctctcctctatatcaatatattttatgttttcctgtgaa

SEQ ID NO: 69 - DNA, 1207 bp, Triticum aestivum
ccacgcgtcagcagcagtttatcttagcaaactactagctaggagacatcgaattaagatggccaaggttaacgccggcgccgccctgttgtctctgtgcctgttgctggcctgttctgccggaggcacacaggccgcctacgtggacgtggagggcaccgtgaggacagaagtagagaaggccatcaagagcaaccccggcatcggtgccgccctcgtccgtctggtgttccacgactgctgggttaatggttgcgatggatcggtgctcttggacaagacgacatccggtggcaataccgagaagaaggcgatcaacaatatcggcctggacggcttcaacctgatcgacaccatcaagtacaaactgggcaacagcgtctcgtgcgctgacatcgtcgtcttcgccgcgcgtgacgcggccagatacctgagcggcggcaaaatcacctactccgttccctcagggcgcaaggacggcatcgtctcgtctgccgctgccgcagacgccatcctcccgcaatccaccttcgagttccaacagctcgtggacaacttcgccaagaagaacttcacccaggaggagctcgtcatcctctccggcgcgcactccatcggcgtctcccacctctcgtccttccaggaccgcctcaacgattcaaccgcgaccccgatcgacgacaactacaagcaggctcttgtcgcagacgtcgaggcccagaagaagagccaaaatacgccggatccgattgagaagaacaacatccgcgacatgagctcgagcttccagaccaccgccgggtacgaccccacaggtgtgaacaccgcggcaaagggcgctctggacaacagctactaccacgccaacctccagaacagggtgctcttcaagtccgactgggttatgcgcacggacagcaaagccggggacgacatggccgagtacatgaacaatgccaccaagtggaacaacgacttcgccgctgccatggtcaagctcagcaagctgccggccgagggtagtactcgttacgagataaggaagaactgcagagtcaccaaccagaactactattactagaagcaacggcatcacctacaggctacaggtgccatggatgcaatgatttgtattttgaaggctctgttccatccctaatttgtataaccacaatactcactgcaaaataaaacgacaataaaagaa

SEQ ID NO: 70 - DNA, 1414 bp, Oryza sativa
acccacccaccggcgagcagctgctccgacaagcgctctctctctctctcaactccggcgaggctcacgcgcgctccgaagcttcggatagcggcagtagtcagtgcattgatggcgaccgacgtggcagcgactgagcccgaggtggcggcggaggaggctgcggccgccgcgcctgagaccacggccaccgccggggattccaagccggcgaaggaggccaaggccaagaaggccgccgcgccgaggaaggcacgctccaccgccacccacccgccgtacgccgagatgatctcggaggcgatcgcgacgctgaaggagaggaccgggtcgagccagtacgcgatcggcaagttcctcgaggacaagcacaaggaccacctgccatccaacttccgcaagcagctgctcgtccagatcaagaagctcgtcgccgccggcaagctgaccaaggtcaagaactcctacaagttgccgccgacgcgcgcgccggccgcggccaagcccaaggcgaagcccgccgccgccgcaaagccgaagccgaagccgaaggccgcagctaagcccaaggcggctgccaagccgaaggccaaggctccagccaagtccaaggccgccgcgaagcctaaggcggctgccaagccagccgcgaagccgaaggcggcggctaagcccaagtctccggctaagccagccgccaagcccaaggctgcccccaaggctaaagccaagccggccgcgaagccgaaagccaaggcggctcccaagccgaaggcggcagccgtgacgaagacgaaggcgacctcggctcccgcccggaggccggcgaaggcggcgaagacgtcagccaaggacacgcccagcaagaaggcggcgccggcggccaagaagcccgccgccgcggcgaagaaggcgcccgccaagaaggccgcgccggcgaagaaggcggccgctccggcgaggaaggtgcccgcccggaaggcgaagaagtagagctctctctccggcgagcgagcaatctagggcttcatggttgttttcttagctgtttttttttctcttctctttgttgttagttgcgaggaggggtcaggggtactagcttgtaaatttgatatcgcggcgggggtacactggtcatttcgtacccaggtggtggtgcgcgacgatgatgacgacgacgacgagacagtttgtttttagggcaatgtatttctgagtagattggtggagtttttattgtggtaacaatcttgtgatatttgtcgaaatcactttagctaagtaattaattatgcagtaattttacttactgtattggcttgaccacaccctgtattcctctgaattttcagatctggaaattgaaatgaaatataggatttgtgacttggcgtgtgatttgggttcaaaa

SEQ ID NO: 71 - DNA, 1299 bp, Oryza sativa
ttgctgctactagccgccagccaaaagcagcggcagcgacgcctcacctcgcctcgccctcgtctccggccgcgccgcttgctgggagctagctttggaggaggaggaggaggaggggcgcgagccatggcggagaaggaggagtcaacgtcgatcccgctcagccaggcggcggaggcggttgacccggaggacccggccaagtcgccgccgcggcccagctcgcccaccacctccacccgcaaggcatgctgcgctgttcttcaaagttgggtgtcaagaaaatttatgactggatgcgtcgttctgtttcctgttgctgtcacgttcttcatcacatggtggtttattcaatttgttgatggctttttcagcccactatatgcaaaacttgggatcgacatatttggtcttggttttctgacttctctggtattcatttttctggttggaatatttgtttcctcatgggtgggttcaaccatcttttgggttggagaatggtttataaagaaaatgccatttgttcggcacatatactctgcatcaaagcaagtcagcactgccatttcaccagatcaaaacacaacagcttttaaagaagttgcgataattcgtcatccacgtattggtgaatatgcatttggatttataacatcaactgttgttcttcagactgacaaaggcgacgaagaactgtgcagcgtttatgtgccaacaaatcatctttacattggtgacatatttctggtgaactctgaggagataataagaccaaatttatccattcgagaaggaatcgaaataattgtttctggaggaatgactatgccacaggtgatcgcgtcccttgaacccaccccaaggaagagccagaatatccgtctaaatagaataatgacataatgtcatacgagagctcaagtgctcaacacgatcgtgttatgtgtggaatcggtgtgactctggtgctctgaccattgctctgttcatcttcgtttctgttgtgtcaaaatgtggaggctggagaggagaacacggcgtgagattgatcgagccatcttaggctcgtggcattacagaaggtggcggaagcaccatatcgatgctcaggaatagtattggttgtgtgtcacatgccgcgctactctttggttgctgactggtctgaaatgttaacgtccctagtgcaagtgcaactgattaaattcatttgtaacaatatcatgtataacatcatgtcgacctcgtattacgtagagttgattataccatgtgagagcatttctttgttttatc

SEQ ID NO: 72 - DNA, 1576 bp, Sorghum bicolor
aaagcacgctcgtggtggtggcgtcgtcgtgtctccccgatcccctctcgtctcctcccctcgtcgtctcatcaattcaagatccaatctttgctgctgccactcggcgatccgatcgttctcgagcaaggtcggtggccatggctcgctgccgccgccacctcctcctccttgctctctttctcgccttggctgctgctgctccggggcaggcgcagagtcatggcgaagcctccgccgtcttcatcgacgccgcgtcgcaccgctacctgcgggaccagcaagccgacggccaggacgcttcaatgtcgttaaatgaagtttctgcggctgtttctgtcttgcttggttttgcagcgccaacctccctaccagcgatttcatcgtcgaagttgaacaaagtgcttcttcccaatccatttgatagaccgcgtgctgttttccttatgcaaattgctgggaccgatgcctcagcccctagcttcgtatctgaaggcagcaacattttcaagaccaggattgaaggtgcaaacagcgctgatacagggctttcagatacagatgatttaattgtcattcattcagatgaatctctagatctttctcgatcagattatcttgataatgaactttccagcttggcaaactggttggagggatcttatcagaagtctagcagcaaactagtcattcccttggagagtggaaacagtctcactttgctacttgataaggaagcagacatggaatttgtgtccagcttggcttcccttcttaagactatcgagagggcgatccaggttcacgaagatttctcaggtgtcatgaaccccgcagagctactagaatgccacttcacaggaataaaggctctggagaatgaatatggttccactgaaattgttaagcaggcaactgaagtagttcagagagctgtcaccaaatcattccagtccctacatgaagcatacaaagggaaaattgttgggctggtaatatccacaaaggaggcttcatcatccttaggatccataattgacgcaccttcttcactgcacatttcaagacgactagaagaagcaagcaagactaaagaagcctctgtggcacttgttcgaaagagtttggcatggattacagggatcatcctgcttgtttcaactctcataggggtttgcttgcttatgaacatgccacttaccagggacaccctcttgtactcgaacgtcaagattgattagtactcgaacgtcaagattgattagtttgaagggtgttcgcggaggccacagttggggttcaactttggcctgtgtagttatgggatggatttcggacggtagagatgtattcttatgctgtttacaaaaccggtgtacaatgggatactaggtgctacgtgctttttttgaatctgtgctgcgctgctgcctgtatgggttgttttgttgttgggttccggtaaataatccagagtggaacaaacgattaattgttgcagaatgctactgccttttccgaataaatctgtgacgattgtaatcgaattttcaacttgaataatagtgtagatgct

SEQ ID NO: 73 - DNA, 1224 bp, Sorghum bicolor
acattgttgtattgagctgacctgccggaggaggcagaggaggatagggaggcgatgacgacggcgaggaaggcagcgtgcgtgctggcggcgtgggtgctcgtcgccgcggctctgtccgacctgggctccgcccgcgcacccctgggcagcaagccgcagcgggagttcgactacttcgcgctctccctgcagtggcccggcaccatctgcgcctccacccgccactgctgcgccagcaacggctgctgccgctcggagccgctccagacgttcacgatccacgggctatggccggactacgacgacgggacctggccgtcgtgctgccgccgcacccaattcgagctggacaagatattgccactgatggaggtgcttaataagtactggccgtccctctactgctccaaatctggaacttgcttcagcggcaagggactcttctgggctcacgagtgggagaagcatggaacctgctctgcccctgtggttcaggatgaactacagtatttcaccattgcccttgacctctacttcaagtataacgttacagaaatgctgtcaagtggaggaatacaagtttcaaatggtaaggaatatgcactgagcgatgtcatcgataccatcaaacatgcttttgggggatcaccacaaattgtttgcaagaatggttcagtccaagaacttaggttatgcttcgacaaagaattgaagcctcgtgattgtcttactacttctttgacgaatggaagtgtatcaaaaagcaagcactgcccacggtacatcaccttgccaacatatgatccccttgtgcttgccaattcaactgtagaaatcatgtcacagttcgatgaatttgtggtgcctactgctctttatacagcctaaggtgcaattatgatagcagaaggtgcttgcgtgagcacctagatccagggaaattggtccctggaatattcaaccatttgtacatgcacacttgaaagagaattgtacttttttaacctggaaatttataagctttatgtaaccttgaaggttggatattgtcaatgtatacacaaaatctgtagctggagggtgccattgttttaaggtctccggtgtcagttttttgatgtacaatattctaaatggcgctgtcttcagggctcaatgtccaaattgtgtcttgaggtaggattttcaagtaataacaatagagatgtaagaaaacttaac

SEQ ID NO: 74 - DNA, 1662 bp, Sorghum bicolor
agcccacccagctcatcacggtgctcatcgaagccaccacctccacctccacccaacaaattccatagacgccggccattctcaccatccccacgaagccaaacccaagagcaccaccagagcagagagcatcgtcgtcgtcggcggcggtcgggcaggcaagcaagcatggcggggttcaaggtgacgcggatctcggagggtccggtgaagccggcgtcatcgacgcccgaggagacgctgccgctggcgtgggtggaccggtacccgacgcaccgtgggctggtggagtcgatgcacatcttccggtccggcgcggacgctgccccggccgtgatccgcgccgcgctgggcaaggcgctggccttcttctacccgctggcggggcgcatcgtggaaggggaccagcccgggtgccccgccatccggtgcaccgccgacggcgtctacttcgcggaggccgtggcggactgcagcctcgaggacgtgcggttcctggagcggcccctcctgctccccaaggaggacctcgtcccttaccccggcgacgaccgctggaccgtcgagccgcacaacaccatcatgatgatgcagatcaccaagttcacctgcggcgggttcgtgatgggtctgcggttcaaccacgcgtcggcggacggcatgggcgcggcgcagttcatcaacgccgtgggcgacatggcgcgggggctgacggagcccaaggtgctgcccgtgtggcaccgggagaagttccccaacccgaacatcaagcccggaccgctcccggagctccccgtgctggcgctggactacgtcgtgctcgacttccccacgccctacatcgacgacctcaagaggcagtacaaggcgcacagcggcaagttctgctcgggcttcgacgtgctcacggccaagctctggcagtgccgcacccgggcgctcgccctggaccctgccaccgaggtcaagctctgcttcttcgccagtgtccgccacctgctcaagctcgacagggggtactatggcaactccatcttccccgtgaagatgtccgcgccggctgagaaggtgctcgcctcctccatcttggaggtcgtcgacatgatccgggaggccaaggacaggatggccgtcgagttcttccgcttcgccaaggaggagacggaccaggacccgttccagatgaccttcaactacgagtccatctatgtctccgactggagcaagctcggcttctccgacgtggactacggctttggcccgcccatgttcgccggcccgcttgtcaacaatgacttcattgcctccgtcgtcatcctcaaggcgccgctcccgctggacggcaccaggatgctcgccagctgcgtcaccaaggagcactccgacgagttcgcccgtggcatgaaggaagacctgccctgaataacactttgatgttgcttatcatacagctgatccatgatgagacggggaaactgagatgaatggtgacataaagatgcttctgtttggttaatgttgttgttaattttggttgtatttatttgtcactttatatcttggtcaatacagtactactttagacagcaaattcgatcttaatttgtaccatttgatatgagacagagacaataaaaagggtatactgtccatttttcggtt

SEQ ID NO: 75 - DNA, 1321 bp, Sorghum bicolor
atcaccctcaatctcaatttcttctgctccccaaaaacacagatccgtagcctagccgcgtgcttgccagaaagatcgagcggaaggcgggcaggccggcggtaggcgcatagatgcaggggtgagggcacgggcggcagcgcttgacgggcgacgagtaaaccctaacgtttcgatcgcgggcggaagcgtctgagccagtccccgagtcgatccgccgccatgcctgtcaatcctcctcccccgccgcctcctgggtcgtcgtcttcggctccggcggggcccagctacttccctctccctttccatctgcagcagcaccagccgccgccgcagatgccgccgcctatggcggcgaacagctaccagcagtaccagcaacagctgcatcaggcgcatcagctcttccagcgggacgcgcagaccatcacccccgaggcgctgcagagtgtcaaggctgccatcgccaccagcgacgtcctcgaccccgccgccgccgctaacgccaggccctccgatccctctaccagcaagaagcccattccacgccgcgctgccggacaatcctgggaggatcctaccctcactgactggcccgaaaacgactaccggctcttctgtggagatctaggcaacgaagttaatgatgatgttctctccaaagcattctcacggtttccatccttcaacatggcaagggttgttagagataagaggactggcaaaactaaaggttatggatttgtgagcttttcaaaccctactgacctggctgcagcaataaaagagatgaatggaaagtatgttgggaaccgccctattaaattgcgtaagagtaactggaaggagaggacagatgttgaggctctagaaagacaaaagaatcatgtccataggaagcctaaaattctgaagaagagtattcttcacaagtagagatatagagggtgaaggccagctcatggtcatgtgctgctgtggtgctgccttcgaaagatgctacttctggaatctggaatctcttcactctctgcactactcggggtggaatcacacaagggctgttgtttcatggaaattggcaacgagctgcagctgccttttggtcgatggggttgtgggcttgtgaacatagcgttaagtgccacccgaggcaacttgtgctccgttttactgttccccctagtaccttcacatggtgctcatttgagatgttggagttgtgtcatggctactgactaacgaggcggagctgaacaagaaccaaatgggaatttcaatttgggtttcaacaagtaataacatgacgtgttggactatc

SEQ ID NO: 76 - DNA, 1809 bp, Oryza sativa
ctctcccctaccataccatcagctagctagcttctactcgatcctcttctcctctcctctcctctggagcacatcacatccacctcttcgtctatatcaaccccgccttcctctagctacctcttcactcgctcacactctgatcagctctctaatcacatatatatcgtatcgatcaacgacgacgacaatggcggccgtcgacaatgccccgccgtcgccagtggtcaccgtcacctccacccgcaccgtcgccccagccgccgccaagtgcgtcctcgccacattcgacctcccctacatcaccttctactacaaccagaagctgctcctctaccgcctccccaacggcgcctccgacttccccgacgccgtcgcccgcatgtccgcctccctctccgacgccctcgcctacttctacccgctcgccggccgcatccgccaggacgaccacgacggctccctctccatccacggccaacacggcgccgaggtcatcgaggcctccgccgaccatgtctccgtcgaccaactcgccggagaggagtgctcggaggaggcggagaaggtgatgcagctcctcgtcccctacaccggcgtcatgaacctcgagggcctgaaccgcccgctgctcgccgtccagttgacacgtctgcgggacggggtggcagtggggtgcgccttcaaccacgccgtcctcgacggcacctccacctggcacttcatgacgtcatgggcggagctctgccgggtcggcggcgcgccgtcgctgctgccggtgcacaaccgcggcatggcgcgctccgtccgcgtcaacctcccgctcccggcgtccgccgaggcgcacgagaagaccgaccccaatgggcccaaggtgcccctcgtggcccgcgtcttctccttcccgccctccgccgtggcccgcgccaaggccgccgccaacgccgccctgccccccggcgccaagcccttctcctccttccagtcgctcgccgcccacatctggcgcgccgtctcccgcgcccgcgccctcggcccctccgacatcaccgtcttcgccgtcttcgccgactgccgcgcccgcctcagcccgcccctcccgcccgcctacttcggcaacctcatccaggccgtcttcaccggcgtgcccgcggggatgctcctcgctggcccgcccgagctcgccgcggggctgctgcagaaggccatcgacgaccacgacgccgccgccatcacccggaggctggaggagtacgaggcggcgcccaagctgttccactacagcgacgccggccccaactgcgtcgccgtcggcagctcgccgcgcttcagggtgtacgacgtcgacttcggcttcggccgcccggagcgggtgcgaagcggcgccaacaacaagttcgacgggatggtctacctctacccgggccgcggcggcgacggcggcatcgacgtcgagctctcgctgcagccggagccgatgcagaggttggacaaggaccaagacttcctccaaatgcgagccccttaattcttttttttttcttttatactcctatatattatgatgattcatcagctgcatgttactccctagtagtcttgttcctcctaaattgcaacttctcctactactcctttatgtttagttggatgcatgcatggattccttgttgcttgctactatttatatatagtggagtactatgttgtgtactatgttgcttgcaagctacatttatatgtggatttgcatatattgaattggtccattacttaaataaggatcggatatggaattaattagcagct

SEQ ID NO: 77 - DNA, 1734 bp, Zea mays
gtctacttctgtgatttcccccggcggcgttgggcgctggtttaggagacgaaaaggcggcgcgcggcggaaaaccctagcttagctcctctccggcgtcaagtgctctccggtttgagggcgcgatgagggtgaaggtgatttcgcgttccaccgacgactacacgcgcgagcgcagccaggacctgcagaaagtattccgcaactatgatccagcgcttcgtagtcaagagaaagctgttgagtatactcgggcactcaatgctgccaagttagagaagatatttgctaagccatttatcggagctatggatgggcatattgacgcggtatcgtgcatggccaaaaaccccaatcatttgaaagcaatattttctggttcaatggatggagatgttcgcctttgggatattgctgcgaggaagacagtttgtcagttccccgggcaccagggtgctgtaagaggtttaacaacatccacagatggtgatcttcttgtatcatgtggcgttgactgcactgttcgactctggaaagttccgatgcttaaaatggtggatactagtgagcgtgctggagataattcccagccatcagcagtttacacctggaagcatgcattctggggtgctgatcaccagtgggacggcaatcttttcgcaactgttggtgctcaagttgatatatgggatcctgacaggtcagagccaataaatagcttcgaatggggtaaagatacggttctttctgtgcgatttgatcctggagactctaatattttgattacgtcgggcagtgatcggagtctgacactctatgacttgcgtatgtcatctccagctagaaagctaataatgaagacaaggtgcaattcagtatgctggaaccctagagagcctatgaacttcactgctgcaaatgaagacacaaactgttactcctttgatgctagaaaattagatgaagcaaaaattgttcacaaaggccatgtttcagcagtgatggatattgactactcaccaacagggcgtgaatttgtcactggttcatatgatagaacagtaaggatttttaattatcttggagaccacagcagagagatttaccacaccaagaggatgcaaagggtgttttgtgtgaagtacacctatgatgggacctatttagtctctggcagtgatgatacaaatcttcgtctgtggaagtccaaagcttcagaacaacttggagttcttcttccacgggagcgcaaaaagcaagagtaccaggatgctttgaaggagcggtacaagcatctcccagaagtcaagcggattgtaaggcatagacatctaccgaagccaatctacaaggcagccaacctacggcgtacgatgatcgaagctgaaagccgtaaagaggaaaggaggcgaaagcacagtgctcccgggagcatgcctgtgcagcccttcaggaagcggagaatcatcagagaagttgagtagacatgcggtttgcattgcatggtcgtggtacacgtttgtgtttctgaggcgatggagttgagagaatacatgatgtttcctttgggagttgagctccagttttgcctttcgtactacatatatgtgctccatcaatcagtttgtttgactagttattattgtgtatttgaaataccacacaaaatattcatatcgtgccattgcattgcaagaccgtgagcaatccgaattgaaggtaggacgttttctc

SEQ ID NO: 78 - DNA, 1919 bp, Glycine max
tccccttctgtcctcgaatttccgatcaattccgatttcaacaacagctagggtttcgaaatcgaccacaccttctcctccctctttccccaacacacacgatcgcgatgcacctctagggtttctccctctccctggttcgaaatttcgattcccgtacatgccatcggtggaggaagaagatgtatagcaatttcaaggagcaagcgatagaatacgtgaagcaggccgtgcaggaagacaatgccggaaactacgcgaaagcgttccctctctacatgaacgccttggagtacttcaagacgcatctcaagtacgaaaagaaccctaagatcaaggaagccatcacgcagaagttcaccgagtacctgcgccgggccgaggagattcgggccgtgctcgacgacggcggccccggtccggcctccaacggggacgcggctgtggctgcaaggcccaaaaccaagccaaaggacggtgaaggcggtggcgacggcgaggaccccgagcaggccaagctccgggccgggctcaactcggccatcataagggagaagcccaacgtgaagtggaacgacgtcgcagggttggagagcgccaaacaggccttgcaggaggctgtgattttgcctgtaaagttccctcagttctttactgggaaaagacgaccctggagagctttcttgttgtatggacctcctggaacgggaaaatcatatttagccaaggcagttgcaacggaagccgagtccacgtttttcagtgtttcttcatcagaccttgtttcaaagtggatgggtgaaagtgaaaagctggtttcaaaccttttcgaaatggctcgagaaagtgccccttctatcatatttattgacgaaattgattccctgtgtggtcagcgtggagaaggcaacgagagtgaagcttcaagacggattaaaacagagcttctggtgcagatgcagggtgtaggacacaatgatcagaaagttcttgttcttgcagcaacaaatacgccctatgccttagaccaggcaataaggcgtcgttttgataagcgcatatatattccgctaccagatttgaaggctcgccaacacatgttcaaggtgcatctaggagatactccccataacttgactgaaagtgattttgaatacttggctagcaggacagagggtttttctggttcagatatatctgtctgtgtaaaggatgttttatttgaacctgttcgcaaaacccaagatgcaatgttcttctttaagaatcctgagggtatgtggatcccatgtggacctaagcaacagggtgcagtacaaacctcaatgcaagagcttgctgcaaaaggacttgcttctaagatccttccgccccctattaggaggacagattttgagaaggtactcgctagacaaaggcctacagtaagcaaagccgaccttgatgttcacgagagattcacgaaggaatttggagaggaaggttaatactgatggaatttcactttgaaggtccacactggtttcaaatatattgttataatttgtaatttattagccgttggatgcaaatgaaatgcatctttttcatttttggggatgtaaaggccccttttgtaccgaggtggatttataaaggtcgatactcatttttcttcttctaaattgtgtataacagaatctgaaatgatttgaaaaaataacttgtgtgatgctggatttttacttttgtctgctatggatttaggatgccataaatttgggtgctttttattttcgagatggatcagatactcagcatgttgcactaagctacctgctgatgggacacaagagactcatcataaaatatgccacgcagattagggtattcaacttaacataaagtgtttactaaatgtgatgatagaatggtttttt

SEQ ID NO: 79 - DNA, 4820 bp, Sorghum bicolor
gtaagaaacgggggaaaaataattaggaaaataaatttcaaatcaaagtctcctacacccagcgacgaaaactctgcgacaattcaaatcaaatccatccgtgtcgaatcgtgccagcgcaaaccccgcggccgatcccctgtgctctcgccgcccgcctcccccgattctgcagcctctcgctgcgaatctgggcgcgatttcgaggctagggtttgggaggctccggatcgcagggccgtgcggaggcaagggtttggattcggaggttgctgctgcgggtcgggggtgctggattgagctactccgcgccggcttgtgatggtggtgagcggcggtggaagacgagttgacgtcggcggcggtggcggcggtggtgagtagggtttgttgattgagttggggccgagggcgcgccggccatggtgcggcttctcgggctgcggagcctgagcttcgggccggaggagtcgccgcgggagatcccctccaccgccgacgcggccccgcctgttggcagcagtggctggctcgtgcgcttcttcgactccgccttcttctgcgagtggatcgccgtcagctacctctacaagcacgaccatgccggagtgcgggactacctctgcaaccgcatgtacacgctccctctgccggggctcgaggcctacctcttccaggtctgctacatgctcgtccacaagcccagcccttcccttgaccgcttcgtcatcgacacctgcgccaagtcgctccgcatcgcgctcaaggtgcactggctccttgctgcagagcttgagctggaggatgctgacgatctggatgggatcgacaaggtgcaggagcagtgccaggttgcagcgaccgtgcagggcgagtggccacctctggtccggcctgctcctccatcccctgctgccagtccgcgaggtaaccccatgctcagcagaatacgatcgtccaagcagcggctattgtccctcgcatcatcgccgtcacttggactgagcccccctgctggtggtggggtcaatgttgccgaggatgctatgggtactggagggaagcagccagccacaccctcatcagaggataacaagttgcttaagagactgagcattggtccaaaaatgcgcgatgcattgctcttcagacgatcaggagagaaggatgaagaacaagaccgggatgggttttttaagaggcttcttagggacagcagagacaaggatgatgatgatggggacagagaaggatttttcaaaaggttacttaaggatagcagggagaaggataatgaggaggaagaaggtgatagagatggtttcttccgcagattgctcagggatagcaaggaggaggacatggaactgacaccaagctcagatggtctgttgaagagactcttccgtgataaggaggacaagcaaggtgaggatgatgagaaggaagggttttttcgcaggatgttcaaggataagaatgaggagaggagagatagcatccatgcaagacatggggatgaggaaagagtgggcaagagtgtggaagatgatgacaaagaaggtttcttccgcaaaattttcaaagataagaatgaggagaggaaagatgaagggcatcaaaagccggatgagagggaaaaggttggtgcgaatatagaagaggataagagagatgggtttttcaggcaactctttaaggataaaaatgatgagaaaaaggaaggcagcacaccaagcaagaaagaggaagatgatagaggccatagaaatgctgatgatgataatttcttccgcaggcttttcaaggataagaatgaagaaaagaaagggatcgctcatgacaggaatgaagatgacaagtgtgaggaaggtgataaagaaaacttcttccgcaaattttttaaggataagaatgaggagaggagaactgaggggcctgataaaaatgatgatgatggtaagggtactagtggtatcgaagaggaggataatccagagtttttgtcattccgtaggttgtttagagtgcacccagaagattctaagagtggggtcatagaaagcagtcaatctaacaatctttctgaggggagcccaggatcagaaagcttttttaagaggctattccgtgatagagaccgctcacttgaagactctgagattttcggctcaaaaatagcaaaagaggcaaggatctgcacaggaatcaatgagaagcaaagtggaaaaccaccattaccaattaatgcagtagcagagcttcgaaaaggttcttactatgcttcgttggaacttgttcaggctttatgtgatacatcttatggcctggtagatatatttcctattgaggatcgtaagattgccctccgggagtctcttacagagatcaatagtcagattgcttctgccgaaaaaaatggaggagtatgctttccgatgggaaagggcatatatcgagtggttcatatacctgaagatgagtctgttcttctgaattctagggagaaagctccttaccttatatgtgttgaagttttaaaagcagaagctcctagccactctaaaggatcatccgatgggcacaaattatcaaaaggtgggataccattggctaatggagatgtgcaactaccaaaaccaccaccatgggcttatcctttgtggagcaggcacgacacacaaaactatgaaacagacagaatgctgaagtctacttctcaggttattgaccaagcaatggctcaactctgggagacaaaagtaaaatttgtaaatgttagtttctctattgagaaacttggtcgctcaaggagcattgcactttctgaaacggggcgtaggctgcgacatgatgctatagattctcatgagccacctggagattcgcaaacagttgctgatcagcctattgaatgggtgaaggttacattgtctgcagttccaggagttaacatggaagatgtagatgataatgaaccaacacgaaagaaggaccatcgccgcattcctagtacaattgccattgaggaagtaaaggctgcagcattaaaaggagaagctccacctggtcttcctctaaaaggagttgggcagagcacccaaaatttagatcctaaggctactgatggtggggatccaaaaccaaccgatgctttggctggtgagctttgggctgtcaaacgagagagaattcgacggtcttcggttcatggaaaatcacctggctgggacttgcgctctattattgtcaagagtggtgatgactgccgtcaagaacacttggccgtacagcttgttgcacatttctatgacatatatcaagaagctggtttaccactatggctgcggccttatgaagtgattgttacttctgcttatacagcactaattgagactatccctgatacggcatcaatccattccgtcaaaagtaggtttcccaatatttcaagtctccgagactactatgtagccaagtatgaagagaattctccaaatttcaaacttgcacagagaaactttgttgaaagtatggctggatattcaattctgtgctacctacttcaggtgaaagatcgccacaatgggaatcttctaatagatgaggaaggacatattattcatattgattttggtttcatactatctaactctcctggaggggtaaacttcgagagtgcaccatttaaactaacaagggaactccttgaagtgatggattctgatgcagagggaactcccagcgagttctttgattacttcaaggtcctatgcattcaaggtttcctgacttgtcggaagcatgcagagcgtattatacttcttgtggaaatgttgcaggattctggctttccatgtttcaaaggtggccctcgcactatacagaacttgaggaagaggttccacttgagtctaactgaagagcaatgcgtatccctggtgctctcactgatcagtagcagcatggatgcttggcgcactcggcaatatgattactaccagagagtattgaatggaattttatgattttccccacaagagtcacggattcattcagaaaccaaacttcttgtatccttggagcaaaccatgggattgcataggtcagtttggggctgatctatactgggtaattgagcactgtgttttcatgtggcattgcacatttttggtcaactagggaaacagattggtgcctgcattctactttcatgtgatcccccctctgacagagttaagtgtacagtcatcggcagttatctagttagtgctttgtgctaggaggttgcgactagtggagctctatttggcatattggaatttggaacccgagctgcattgttgtacagacctttggttgacgtagcttggacaggatgtaggagaggactgggccatactttgaagcaaacaagtgtaaattataggcatatgggagctggggataatccgaggacaagaacagatatgccgttcgaagtgtcactgtactgatgtcctgtggtatccctatagcgccaaagtagatggagatgtgctttgctgcatttgtaaattaccaatactgtacagggaccatactataggagctttccgttttttagttgttaagatattaattccttttgttgtggctgtctggcctacgaagatctaggtgatagcttgttcactagcagtatgatcagtgtttggtattttttgctattttttcctgtggccctagcaaattgcaatgtggatacaaaaaatacatttccttgtgtcatgaagaaaaacactgcaatatttttagtacattttgctgtaccatgagag

SEQ ID NO: 80 - DNA, 1512 bp, Zea mays
caccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccactccccaaccctaacctcccccctgtagcacaccccacctccagctttgtaggtcctactatacttgcaacctctcccgccgactcgcttcgatctacccgccctcgcgtcaccatggggtacgcgcagctcgtcatcggccccgctgggagcggcaagtcaacttattgctccagtttatacgaccattgccagaccgtgggaaggacaattcatattgtcaatcttgatccagctgctgagcacttcgactatcctgtagatatggatatcagagagctgatttcattggatgatgttatggaggagattgggttggggccaaatggcggtctcatctactgcatggagcaccttgaagacagcttggatgattggtttgatgaacagctagagaactacctagatgatgattatcttgtgtttgattgccctggccagattgaactcttcacacatgttccagttctgcggaactttgtcgagcacctgaaacgaaaaaatttcaacgtttgcgctgtttaccttcttgattcacagtttgtcagcgatgtaacaaaatacatcagtggttgcatggcttctctatctgctatgattcagcttgaacttcctcatatcaacatcctttcaaagatggatctggtctccaacaaaaaagatgtagaagagtacctggacccgaatgcacaggttcttctttcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacatgtatccagtatggggaagatgcagacgtgaaggtcagggacttcgaagaagacgaagactaaccactggatgctgtgggaggtgcaaactggttgctagcagtcgtgtagtgcggagtgagactttgggactgtgtatggcgcaggcatgcaaaaacgtcgtaggatgctgatggcagctatgtggtctatgtaagacgaactaaaccagatactccatttggcaagtcctagtaaaacgtgtgcgcgccttgatggtcctgttctccctcgatgctccgttggtattttatcaaaatcaattcaacggttgccgt

SEQ ID NO: 81 - DNA, 737 bp, Hordeum vulgare
gctgcaggaattcggcacgaggagcgagtgagcgagtgttgcacaaacaacatgtctgcctgtgtcatggcatctttggctctgaaaccatcttcctctcctctgttacaacgatccaagcttggaggcgtgcgaccatcggcgaggccgtcgttggtcatagtggccaagaaggcgaagaaggtccagactgcccaaccctacgggcctggtggtggagtggcgttcaaggaaggcgtcgatgcgtctggaagggtagccaaggggaagggtgtttaccagtttgccgacaagtatggagcaaatgttgatgggtacagccctatatacacaccagaagagtggtctccaagtggcgacgtttatgttggaggaaagacggggctgtttctctgggcagtgactcttgctggaattctgctgggcggtgctcttcttgtctacagtactagcgccttggcttcctgaagcctatgtgcagcaaaccaagctatgcaccaaacgatgtgtataatagtgcggattataaccgtcaggacatatgtaatggatacaaatatcactacccgcaaatcagtaaatatccttaattaattactaatgttctaagcaacatgctgcaagcgtgattaagttttcagtgctaagctctctcacaattgttatcaacttctacaattggaattccttttttaaagaggaggcaatcatcataagagttgaacagactttaattc

SEQ ID NO: 82 - DNA, 1301 bp, Sorghum bicolor
gggcagcaggggcgcagcaaaccacgcaccagagggccggccaccagtataaagccggcaccacctgtccgtgcatcgccgcacagcagagcagcacaccaccacccaactccactgaacaacacgaccattcttcattttccaggaagctctagagcgcaggtgcagagtgctgtgcagacaccatggcgcggcggtctctggcccttctgctcgcgtcgtcgctggccctcgtgatgatggcggccgtcgcgtcggcggactcgtggctctacgagaagttcagcacggacggcaccgtccgcaccaactacgacgagtccggcgcgcaggtggcgatgctcaacctcgaccgcagctccggcgccggcttcaactccaaggagcagtacctctacggccagttcagcgtccagatgaagctcatccccggcaactccgccggcaccgtctcctgcttctacctttcttctggcgacggcgacgggcatgacgagatcgacatggagttcatgggcaacgccacggggcagccggtggtgctcaacacaaacgtgtgggccaacggcgacggcaagaaggagcaccagttcgacctgtggttcgacccggccgccgactaccacacctacaccatcatctggaacccgaccaacatcctcttcaaggtggacgacaacgtgatccgcgtcttcaagcgctacgccgacctggcctacccgagctccaagcccatgacgctgcacgccacgctgtgggacggcagctactgggccaccgagaagggcaaggtgcccatcgactggtccggcgcgcccttcgtcgtctcctacaaaggctactccgccgacgcctgcgtcagcggcggcgcctgcgccgccggcagcggcgcgtggatgaacaagcagcctgacagcgccgagtggggcaccgtcaagtgggccgagagcaactacatgcgctacaactactgcgacgacggctggaggttcccgcaggggctgccggcggagtgcagccgcagctgattcaattcgatcgttcgccggcgtctcccatcctttcagactcagttcaggcgtccattattgccaaagttcttgatttatttttgctggatatatatatatatctatgattcttgttctgttgttgtgaatttttgtcattgaaaagcagccccgcagcaacgcgagggcgggaatatattactgtagttttgcttgtgtaaagaaaagaagctttgtttctactttttggataaaggaataaaatacttgtgacatgcatatataaacatg

SEQ ID NO: 83 - DNA, 922 bp, Oryza sativa
aaccaaacccaaaaacccaaaccaaacgcgcgacgcctcagctttctcctgctcctcctgccactcaccaacccaacgcaaagcatcgcggccgcgaggtcgtcgacctcgtcgtcgtcgtcgatggaggtggaggcgttcccgatacggttcacgaggggaatacggtcgcactgggggaggcgcaagtaccagcggctggaggcggcgaacggcggcgggaagacgagggcgacgcagcagctgggcggcgcgcgccgcggcggtgcggggtgggggctgcggctgcggcggctgctccgcgtccgcgtgcgcgtggcgagggcgtggctgtcgtccccggcgcggctgctggcgcggatccgcgacgcgtacgtgggcggcatgctcgccgtgtcgaggaaggcgtcgggcatgtcgctgccgaacgcgcccgaggggctgtggcccaggcgcgtgccgcgccggaagcagctcccggcggcgcggccaggccagctcaccgacttcgagcagaggctcgtcgtcgagatatacaagtccatcgtcgcctccaaggagctcaccaccatgctccaccactccaccgcgcacctgccgcagcagcacaacacggcggcgccggcgtccagtggccagctgctagtcaattagcgtgctgtctgtatccaccatcgacatggaaactgaaccgcgagagctcctgcaagttcgtttgctcgatcgctgctcatgttgatgattattactactgctgtttcttccttgtaatttgtaagaagtattagttaggacaagatgatgatgtacacttcaatttctacctggtgcaaatcaccatgccgccgcgagtatgtttaatttcgtaaccaagaaatcgatcaagcaaagttcgtgcctccgcgcaccttgttcttgttct

SEQ ID NO: 84 - DNA, 4835 bp, Arabidopsis thaliana
ccctcctcgagaatttccgatcgtgctttcctcaaaagcatttctgtttctcgtcgtcggagcccgacgacagatctctgaatcgctggagaaacataatgattgagtttggcctctatctgtgaagggtatatgctccggctgtatctactttatattctgccaggaagattgtgagcattgaagtgccttgggctctggctgaagatttgagcagattaaatgggtcgcctaaagttgcattctggaatcaaggccattgaggaagaacctgaggactttgagtgtactgattcaagtaatacaaccactttagcatgcatgattgatacggaaattgctgctgttttagcggttatgagaagaaatgtaagatggggaggtcgatacatgtctggtgatgatcaactagaacactcgttgattcagtcacttaaagctcttagaaaacaggtgttctcatggaaccagccgtggcatacaattagtcccatgttgtatcttcagccctttcttgatgtgatacggtcagatgaaactggagcaccaataaccagcattgctttgtcatcagtttacaagatcttaaacctgaatgtaattgatcaaaatactgcgaatattgaagacgctatgcacttggtagttgattctgtgacaagctgtcgatttgaggtgacagatcctgcatcagaagaggttgtgctaatgaagatacttcaggttcttctagcatgtatgaaaaataaagcatcagttatgctaagcaatcagcatgtatgcactgtcgtcaacacttgttttcgtgttgtccaccaagcaggaatgaaaggtgagttattgcaacgagtagctcgccacacgatgcatgaattagtgaggtgtatcttctcgcatctcccagatgttgaaagaacagaaactacacttgtcaacagagctggtagcatcaaacaagagaaagctggagtagacagtgattatgccattgtgagtaaaccagtcgaggatggaaatgctaattccgagtatgatgttgaaaattctatggcaacttttgcaactggtgctcaaagtttgatggatgatggaccagttggccctggaagcagaaagccggcttctccatatgatttgcatataatgacagagccatacggagtcccaagtatggtggaaatttttcacttcttgtgctctttgttaaatgtggtcgaacatgttggtatgggatcccgatcaaacaccatagcatttgacgaagatgtgcctctgtttgcgttgaacttgatcaactcagccattgaattgggtggatcgtccatccgccatcacccaagattgttaagcctaattcaagatgagttatttcgtaacttgatgcagttcggattgtcgatgagccccctgattctttcgatggtttgcagcattgtgctcaatttgtatcaacatctacgaactgaactcaagttgcagcttgaggcattcttttcatgtgtgattctaaggcttgctcaaggaaaatatgggccctcgtatcagcagcaagaggttgctatggaggctcttgtgaatttttgtaggcagaagagttttatggttgaaatgtatgccaatctcgattgtgatataacttgcagcaacgtgtttgaggagctgtctaatcttctctcgaagagcacatttcctgtgaactgtcctttgtctgcaatgcacattcttgctctggatggcctaatcgctgttattcagggaatggccgagaggataagtaatggattgactggtttggatttgggtcctgtccatcttgatgagtacacgcctttctggatggttaagtgtgacaactatagtgatccaaatcactgggtttcatttgtccgcaggagaaaatatatcaagagaaggttaatgattggagcagatcattttaacagggatccaaagaaggggttagagtttctccaaggcacacatcttttgcctgacaaactcgatccccaaagtgttgcttgcttttttagatatactgctgggcttgataagaaccttgttggggattttcttggaaatcatgacgaattttgtgttcaagttctcaatgagtttgctgggactttcgatttccagtacatgaatctggatactgcactccgactcttcttggaaaccttcaggttgcctggagaatcccagaaaatacagagagtgcttgaggcgttctctgaaagatactatatgcaatctcctgagattctggccaacaaggatgctgctcttgtgttatcatactctattatcatgcttaacactgatcagcacaacgttcaagtaaagaaaaagatgacagaagaggatttcattcgcaataataggcatatcaatggaggaaatgatctacctcgagaattcttgtctgaactctttcactccatctgcaacaatgagatcaggactactccagaacaaggtgcaggctttcctgaaatgactcccagccgttggattgatttgatgcataaatcaaagaaaactgctccatatattctggctgattcaagggcttatcttgaccatgatatgtttgctatcatgtctggtccaaccattgctgccatatcagtcgtttttgaccatgcagaacatgaagacgtttaccagacatgcatcgatggattcttggctatagctaaaatttctgcctgtcatcatcttgaagatgtgcttgatgatctggttgtctctctctgcaaattcacaactctgttgaatccatcatctgttgatgaacccgttcttgcatttggtgatgacgcaaaagcaaggatggctactatcacaatttttaccattgcaaacaaatatggagattatatacgtacgggttggaggaacatattggactgtatcttacggctacataaacttggacttctgccagctcgtgtagccagtgatgcagctgatgaatcagaacattcatctgagcaagggcaaggaaagcccctcgcgaattccctatcttcagctcatctacagtcaatgggaactccgaggagatcttccggattgatgggaagatttagtcagcttctttcacttgatacagaagagccaagatcacagcctactgagcaacagcttgcagctcatcaacgaacacttcaaacaattcagaaatgtcacattgacagcatatttaccgaaagcaagtttctacaagctgaatctttgttgcagcttgcgcgtgctctcatttgggctgcaggtaggccacagaaaggaaccagttctccagaggatgaggatactgcggttttctgtctggaattgcttattgcaatcactctaaacaacagagacaggatcgttctcctatggcaaggcgtctatgaacatatagctacaattgctcagtcaacggtgatgccctgcaacttagtggataaagctatttttggtctacttcggatctgccagagactacttccttataaagaaagcctagctgatgagcttttgagatctcttcagcttgtgctgaaactggatgcacgtgttgcagatgcctattgtgagcaaattgcaattgaagtcagccgtcttgtgaaagccaatgctaatcacatcaggtctcaggcgggttggagaacaatcacatccttactctccatcacagcgcggcacccagaagcttctgaatcaggatttgatgccgtatcctttgttatgtctgaaggaactcacctgtatccagccaattatgtactctgtgttgatgctgcaagacagtttgctgaatcccgcgtgggacagtccgaacgctctatccgtgcccttgatctaatgggagattcattagaatttttggctaaatgggctctctcagctaaggaaaacatgggagaagaagatttcgggaagatgtcacaagatattggggaaatgtggttaaggcttgttcaaggactaagaaaagtgtgtttagaccagagggaggatgtccgaaaccacgctttacagtcattacagaagtgtttaggcggagtagacggaatcaacctagctcatagcatgtggtctcaatgctttgacaaagtaatcttcacggttttggatgacttacttgagatagctgctgggtcacagaaagactaccgaaacatggaaggcacattgcttctcgcaatcaaacttctctccaaagtgtttcttcagcaactccaagagctatctcagttatcaaccttctgcaagctatggctcggtgttctaactcgaatggagaaatacatgaaagtgaaagtaagaggcaaaaaaagcgacaagctacaagaatcagtaccagagcttctcaaaaacatattgctggtgatgaagacgaaaggcgtgctattgcaaagaagtgctcttggtggagatagcttatgggagctaacatggcttcatgtgaataacattgcaccgtctatgcgactggagctattccctgatcaagaatcctcacaacttggtgatgatgaaaccgtatcgaatggcttatcttctcctgaaaacacaactggttcgtgaccttacaagtgagatcattaggtgagtttctttcgaatatccatataagtactgtgaaagtgaaagcttcttatgtaacacctctctacgtttttttttgtaatatataagtctttctaattcagagactcgtattaattaagcaagtttcttaattacgactttgttaatcacggacctttggaacgaggtagaaggtcttgaacatgtgtggaacccaccaaaggaaaaatatcagtagattcaggagagttgtt

SEQ ID NO: 85 - DNA, 1619 bp, Arabidopsis thaliana
aatttagctcgttgatgatggaggcgcttctttatgtcatcactctcttctctctctcagccctaaccgttacattaggagaaagtataagcatcgactgtggatcaaccggatcttacgtggactccaacaatgtaacatgggtcggagataaaggcttcgtcaccaacggcgagcccatgaagattccggacgttgtcaaaaagccaatcaacactctccggtacttcccaactggtcaaaccaactgctacaccaacattccggtgacaaaaggccagaaaaccctcgtgaggacgaagttttactatgagaactacgacgcgaagttctcgccgccatcttttgatgtgatttatgacgggaaacaccgtgattctattgtaattaccgagtcgttgctaaatgatgaagaaacgttctatttctcggaggtgatatatgttccggagaataagaatatcagcgtctgtctcttacgtacgtctccgtccgacaacccatttatatcgtccattgaagtttatagtttggacactggcatgtacgacgatcttggtcctaacgaaggtctcattctccacgacagaattgcatacggtgccaaagagcttataagctacccgttagacccctacggtagggtatggttagcgttaggatcccaagactccacactgaccgatctaacgacctcagccccatcaatagacatcaccggggcgtcgaacaagccaccagagattgttatgtcaaaggcattatcaggagtcggcttagtactctcagaccagactctacccctaaccggagtaccagtatacttggttctttacttctcagagcctcaaagtctaggtcgaacccagagacgatcgttcaacgttttcttggacaacactcaagtgggttcgcgtcccatcgtaccggtttttgggaaagcaactcaattcattttgagagatgtagtggccacatcggcgtcccagatagtctttcagtcaacggatgactccgttttgccacccctcatcaacggattggagctgtactcgataagtaataccagtccagacagtggaggcggcggtggagaccaaggcggcggtagtacggatgattcggaaggttctggaggagcgaaacaagcaaaaaatttgggaaaaggtggggcaaaaagcagtggagggaagaagaataacaaattaccactcattcttggcgttacgttcgcctccgcctttgcagttctcgcgtcagcgtttgcagctatttggaaaaagcgtcaaaatgctaagtcacagtcgaacagtactgtaccaaatacgtccacagagcatggaacaggcacagggatgtcgcctctagttggacagcaatttgccagcgatatgactgattcatatgttgttgaagatggacatcattgacatggacactagttattgaagagctcaatccatgtgttattattcttcatgtttttttctttccaaacatttatgattcttttagtttgtaaaaaagttctattgtatttctatctgtatccgaccaagagtggaaagaataatttgaaaacgtgatgcatgataatgtgacagtaaatttagaattgg

SEQ ID NO: 86 - DNA, 1873 bp, Oryza sativa
atcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggagcgaacaacatggaggagaaatgcgacatgtcgatggggaagtgggtgagggagcccaagggcccggtgtacaccaacacgacgtgcccgacgctgccggacttcaagaactgccagaagcacggcaaggatcccggccacctctactggcggtggcagccccacggctgcgacctcccgcgcttctcgccggaccgcttcctcgccgccgtccgtggcaagcgcctcgccttcatcggcgactcgctggctcgcaaccagatggactcccttctctgcctcctctctcaggccgagacgccgacggaggtgtaccgcgacgcgcacgacaagttccagacgtggcggttcgcggcgcacgagttcacgctgatggtgatgtggacggagttctacgtgcacgcggagccggtggtgggcgccgacggcaagccgacgccgtcgttcgacatccacctcgacaggctgagcgccaactggacgcgccgcctgccggagctcgactacgcggtcatctccggcggcaactggttcaaccgccccaactacctctgggagggcggccgccgcgtcggctgcgtcaagtgcggcggcgcagccaacctcaccgacgttggcgtcccctacgccgtccgccgcgtggtgcgcgccgctgtcgagggcatcgcgcggtgcaccggctgcaaggccggcctcgtcgcgttcctccggaccttctcgccggaccacttcgagcacggcgcgtggttcagcggcggctactgcaaccgcacgcggccgctggaggaggacgaggtgagcccggacagcgccgcgtgggagctgaggagggtgcagcgagaggaggtgatgcgggtgaaggagacggcggcggcggcggccgcggcgagcgggaacgcgaggaggttcgaggtgctcgacgtgacgaaggccatgatgctgcgcgccgacggccaccccggcgcggccatcgacaagaggtggcagaagaacatcgtcagcgactgcctccactggtgcatgccgggccccgtcgacatgtggaacgagatgctgctccagaggctcaccgagatctccacgctggaccaggatgcttccatctttgaggcaccttaactttgtcacttacatgtaggtccggatcattaatgtatcactgcatacaatcatacggggaacgatgcatgactggtgatgctataggggaggtcttcctatccattgagaggacgtgcatatctctcaaatggttataaattttttgaaaaacaatctagatcaatatatgatgtatcactttataaatatgtaaattaaaacaaaacgaacaacaaacaagagactaccaatccatcagtt

SEQ ID NO: 87 - DNA, 1616 bp, Gossypium hirsutum
taaaaacacaacataacacaagccttgccttgtttcttctcttttgtctgctaaaagcctcctctcctgttacacacatacacacacagtgagaggtaggtttgcagttggcaaaagcttatgggaaagaagcttgctgcatttcttggacgaggcttcaagccttccaagttcaaatcactagtcactcttgccatttctcgtcttgctgttttcaagaaccagcgtcagattcgctgcaaccaagctcgttccgatgttgtacagctccttcaactttcccatcatgatcgggctcttcttagagttgaccaggtgatcaaggagcaaaacatgttggacgtctttgttatacttgaagggtattgtaatctcgttattgaacgactccatctcattgagcaggacagagtgtgccctgacgagctcaaggaggctataaccggcttgctctttgcatcttcaaggtgtggggattttcccgagcttctagagattcgtgctgtttttacatctcactacggcaaagaattcgctgctcgtgcaatcgagctgcgcaacaattgtggagtgaacgctaagattatacagaagctgtcaaccagacaaccagacttgcagagcagaaggaatgtgctcaaccagattgctgccgagtacggcattgctttacaactcgaggaaaccactgattccagcgagggaaatctggatgtaagcaagaagcaggagacatcagttaaggcaagtcatgatgcaggagatgatgatgagttctctgattcaataaaaacaaggagaaaatacagggatgtagctgatgcagctcaagcagcctttgagtcagctgcctatgcagcagcagctgcaagagcagctgtggaactctctcggtctgattcctatgatcctgatgatcagaacggtcccaatactcgacagaacacagtgtttgacaaacaagaagcaaattctaaagatatggaaaatcatggtagtcaagcagtggagttgaatcataccaagaaggcaccagaaatcaagatgtctagtccttcaagtgaaggatcagcagagggaatcatagaccttaggacaatgtcattcgacgaagtggacccactcaagctattggagaaggaagtggttatttatgagagtgatgatgataaatatgattcccgtggttcaagttttgatttgaatgcaaggaagcttaaaggcaaggtcctagatacagataatgatggtgagcactcagaaaagaaacttgactgatgtttccttcaagctttcctgttggcttgaaggtggagactcgacctgaaaacccactgcacacatggatgaaaggtaaatgacactttaccataaataaggtgctgttttcctcgaggacttggaccaagtgacaggatattgaggagcgcgaataaattaaatgtttgtaagttccatggagttgcaaatatagctttggttgagtgtataagttggttttggtctttgatatttcttttgttattttttatcagatgtaaacttaatgtagaatattttggaatgattctttttgtgaagcctaattattttgttatactataccaagttccttt

SEQ ID NO: 88 - DNA, 1611 bp, Gossypium hirsutum
gcggccgcgtcgaccttttgtttgttattgttcatctaagtccaaggagcggtagctgcaaggttatggggaagaagctagacgcgttgcttggaagagggttcaagccctacaagttgaaatcacttattagtgttgccctttctcgtctttccgttttcaagaatcggcgtcagattcgcagcaaccaagctcgctctgatgttgtggagctccttcagctcggccaccatgatcgtgctcttcttagagcggagcaggtggtgaaggagcaaaacatgttggacgtgtttgttatcctggaagggtattgtaatctcctcattgaaagactccatctcattgaggaagacagagaatgccctgatgagctgaaggaggcaatatgtggcttgctctttgcatcttcaaggtgtggagattttcccgagcttcaagagattcgtgcaatcttcacgtctcgctatggcaaagaattcgttgctcgtgccattgagttgcgcaacaattgtggagtcaacactaagattatacagaaactctcaaccaaacaaccagacttgcagagcagatggaatgtgctcaatgagattgctgctgagcatagcattgccctacaactccgtgaaacctctgtttccgctacccaggaaaatttggacggaagcaagaatcatagccagcccaagttaggcacaataggtaaggcaagtaaccatgcagtcctaggagatgacaacgagttctctgattcaacaaaagcaaggaaaaaatataaggatgtagctgatgccgctcaagcagcctttgagtctgctgcaaatgcggccacagcagcaagagcagccgtggaactctctcgttctgatttccatgatcctgatgatgatgatcatgatgatgatcaaaacagtcccaatagtcaaagaaaaagagtgcttgagagagaggaaccaaattctgaagataaagaaactcaacaaggcaatcaagcagaggacttgaaacagacaccagaaatcaagatttcgagcccttcttcaagtaaagattcatcacaaggaaacctggacattaggacagtgtcgttggatgacgtggaccctatcaagctattggaaaaggaagtagtaattcatgagagcgacgatgagaattatgattcccatgattccagttttcatatgaacacaagcatgtttaaagtcagggcccaagatgaagataagaattacgagtgcacagagaaaactgcactgatgtttcagaactcatttgataagcaaatcccctcaagccttcgtgctggcttgaaggtggaggctgtacctgaaaaccccacagaacatgtggctcaaagttctgggacgaaaggtaaacgaccctttaccattaataaggcgccgttttctgtaaggactagacaagttcgtggctactgaggagcatcagtatactgatttgattttgaagtttggcgagttgcattatagcatcagtcaggtctataagtttgtttgtttgtttccccttttttgtttattttcttgagatgtaaactggatgttaacatttttggaattattttcgaagaaaaatatgttggaaaac

SEQ ID NO: 89 - DNA, 1644 bp, Sorghum bicolor
cccctgtccctgcgattcccattccgtttccatcccgtcccggccggaacggcttcaaaacggccgcggcgcagatccacacgcacaggcaggcaggcaggcagacggacaggaccgccgccgcagttttcaaatcccggggcggatttccttccctgcacctgcagagagagagagagagagagagacggggcccagcaatagcaccaccgggatctcgccttctcgtcgtccgtccacctgtggcgccggtgaccgaagggtgagggcgctagctagagcctagaggctagagccatgtggaacagcatctaccggttcttgtgcggcctgtgcgcgccgtcgtcgtcggagcacgggctccacggcgcgcaccccgtcgccgcgctcggccgcgacatcctcagcttccagagcacctcgcaggttccggacgagctgagccggcacgtcgtctcctccaagaaagcgcaggcgaattggtacaagaagctgctggtggcatggaagaaagcccggccgcctccgaagacgcccgaggaagctgcggccttcgttgtgcagacgctcaagaaccatcagaaagcagatgtggagggcctgctgtctttctacggcctgccgcatccgaacgcggcagcaggcacacccgctgctccgccgccgcccaagaagccccagggcgccaagttcgagctgcacacgctccccattgatcccaagtctgtggccgacggcgacaccgtcaacgtgtacgtcgacacggcggacccccgggaggccggcagcgtgccccgcgaggtgcagaaggctgcggcggagcgggccaaggcgcgggccgccaagaactaccagaaggccgacgcgctgcagaagatcatagtcgacgcaggatacaggccggttcctaacgcgagaggcgaggaggtgctagcgaagaagtacaggatcaggctgagggggatcgatgcgcccgagagcgcgatgccgtatggcaaggaggccaaagaggcgctgctcaaacttgtccaggggaagagcttgaaggtctacgtgtacgacgaggaccggtatggtagatgcgtcggagacatctactgcgacggcgtatttgtgcaggagcaaatgctgaagaaaggttttgcctggcactacaccgcctatgatcaacgcccagagctggccaagtgggagaaacaagcacagactgggcggaagggcttgtgggcgtcgtcgaagccacagaaaccatgggagtggaggaaggacaagcgcaacgggacagcatgagcagacccccgaggttcagtatgtgccgtgtgtgttattattattagccatgaacacctgattgattgatttacctgcagactttttagggtggtatatcgatatttcggggctcagtggcggcgtagtatgattgtgtgtgtacactagacgattccttaaagttacagggctgtgaatcaggagggtagagattggtgtatcgcacagttgtatcaaatgcattgtagcaccatttatactgctgtaaagcagagtaactgagcctgtgaaatgtgttgtatgcaaagccacttctgacggtgggagctgttcaatgcagccgagcaaagtttgcaatcaaaatttgacacc

SEQ ID NO: 90 - DNA, 1350 bp, Sorghum bicolor
catttgagcaagtgcgttagagggtagtcccaactcccaagtcccaacccaacgtcgatggccctgcccgccctaatcagcaccctcctcgccgccgtcatctggtgcgccgcttacctcgccgccgccatctcctccgccttctgattcccactcccccaaccacaaactatcctgtagcacaccccacctccagctcttttaggtcctaatactatactcgcaatccctcccaccgactcgcttcgatccgccgccctcgcgccgccatggggtacgcgcagctcgtcatcggccccgctgggagcggcaagtcaacttattgctccagtttgtacgaccattgccagactgtgggcaggacaattcatattgtcaatctcgatccagctgctgagcactttgactatcctgtagatatggatatcagagagctgatttcattggatgatgttatggaggacattgggctggggccaaatggtggtctcatctactgcatggagcacctagaagacagcttggatgattggtttgatgaacagctagagaactacttggatgatgactatcttgtgtttgattgccctggccagattgaactcttcacgcatgttccagttttgcggaactttgttgagcacctgaaacgaaaaaatttcaatgtttgcgctgtttaccttcttgattcacagtttgtcagtgatgtaacgaaatacatcagtggttgcatggcttctctatcagctatgattcagcttgaacttcctcatatcaacatcctttcaaagatggatctagtctccaacaaaaaagaagtagaagagtacctggacccgaacgcacaggttcttctttcacagctgaatcgacagatggcacctcgatttggcaagttgaacaagtgtttagctgaactggttgatgattacagcatggttaatttcataccacttgatttgagaaaggaaagcagcatacaatatgtgctgtcgtatatcgacacctgtatccagtacggggaagatgctgatgtgaaggtcagggactttgagcccatcgaagacgaagactaaaattgcctcattggatgccgaaggagctgcaaactagttggtagtagtcttgtagtgaggtgtggcgtttgggaatattatatatgtatggcacagactgcaggcatgcaaaaaaaaaaaaaaaacgggcccataggatgctgatgacatctacctggtttatgtaagtttgaaactaaagcagagcactcatatctacaagttccagtaaaaatgattgtgccttgatggtcgtgttctctctcatcactccttggtttatcaaaatcgattc

SEQ ID NO: 91 - DNA, 1958 bp, Sorghum bicolor
atggaaagaaaaggaagggcctcctgtccacctctcatccctcctctccctagctagcaagctctagccttcctgtagcgcgtcggagatgggcgcctccaccaccacgtcgctggcggcggcggcggcagcgctgctgctgctcgtgtcgctcgccgcggcggcggacatgtcgatcatctcctacggggagcggagcgaggaggagacgcggcggatgtacgcggagtggatggcgacgcacggccggacctacaacgccatcggcgaggaggagaggcggtatcaggtgttcagggacaacctccgcatcatcgacgagcacaacgccgccgccgacgcgggcgtccactccttccgcctggggctcaaccgcttcgccgacctcaccaacgaagagtaccgcgccacctacctcggcgtcaggaccaagccgcagagggagaggaagctcagcgccaggtaccacgccgacgataacgaggacctgccggagtccgttgattggaggaccaagggcgccgtcgcggaggtcaaggaccagggcagctgcgggagttgctgggctttctcaacaatagcagctgtggaaggcatcaaccagattgttacgggcgacttgatctccttgtctgagcaggagcttgtcgactgtgacacttcatacaaccaggggtgcaatggaggtctgatggactatgcgtttgagttcatcatcaacaatggtggaatcgacacagagtctgattacccttacaagggcacagatggccggtgtgatgccaacaagaaaaacgcgaaggttgttactatcgacagctatgaagatgtaccagcgaacagtgagaagagtctgcagaaagcagttgcaaaccagcccgtcagtgttgctattgaggctggtggcaatgcatttcagctctacagctcgggtatcttcactggaaagtgtggaacagcgttggaccatggtgtcacggccgtcggctatggcacagagaatggaaaggactactggatcgttaagaactcatggggcagcagctggggcgagtccggttacatcaggatggagcgcaacatcaaggactccagcggcaagtgcggtatcgccgttgagccatcgtaccccctgaaggagggcgccaaccccccgaaccctggcccgactccgccgtcccccaccccagagcccagcgtctgcgacaactactactcgtgccctgagagcaccacctgctgctgcatctacgagtatggcaagtactgcttcgcctggggctgctgcccgctcgagggcgccacctgctgtgacgatcactacagctgctgcccccatgactaccccatctgcaacgtccagcagggaacctgcctcatgggcaaggacagcccactgtcagtgaaggctacgaagcgcaccctggccaagccgcactgggctttctctggcaacactgatggcatgaagagcagcgcttgagaaaacgcagcatggcattaaggccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggc

SEQ ID NO: 92 - DNA, 1464 bp, Brassica napus
gaaagaaaaaaaaaagagtaacactatcaagagacgatgaaggttgaaaccataaaaccatcttccacaaccccagatgatctccgaactctccaactctctatctatgatcacttcctccctcccatttacacagtcgcctatctcttctacaccaaagatgagttgatgatctcaccagaacacacttcccacaaactcaaaacttctctgtccgaaaccttgaccaaattctacccccttgccggaagaatcaacggagtcactgtcgactgtaacgacgaaggagctgttttcgtcgacgctcgtgtcgataactgttccctctctggttttctcgcatctccagatctcaatgccctccaacagttgcttcctctagacgccgtccagaacccatacgaggctgcttccacatggcctctgttgctcgtgaaggcgacttacttccaatgcggaggcatggccatcggagtctgcatcactcacaaaatcgccgacgcagcctccatgtcgactttcattcggacttggtctgctgaggctcgaggagaggccgggaacacggtgatggatcctaagttttccgcagcgaatttttacccaccagccaatgatacctataagcttccggtggacgaaaaagccaacaagagaagcagcatcacgaagagattcgtcttcggtgcatctaagttggaagagctcaggaccaaagccactagtccagaatccgcagacatacctacgcgcgtagagagcgtcactgcccttctctggaagtgcttcgtctttgcttcatccttagacacttgtggtcgcaaagttctgatccagctcgctgacttgcgctccaagctaccgtcccttctcccagaaagcctgatcgggaacgtcatgttctcctctgtggtattaagtactgctcaaggggaggaagtgaaaattgaagaggccactagagacttacgaaagaagagggaggacttgcaaactatgatccaagacgaggatggttcatcttcgatgatcggttctaaactggcgaatcttatgctcactaattatgcccggatgagctacgagacacacgagccctacacagtgagtagctggtgcagattaccactttacgaggctagctttggatggggataccctgtttgggttgttggaaatgtggctcccacgtttgaaaacattgccatgctgatcgattccaaggacggacatgggattgaagcttttgtcacgctgcctgaagagaacatgtcctcgctcgagcaaaactcggaacttctcgcctttgcttccttgaatccttgtgtcttggtctaaactctaaattatgtactcaaatcaaatctgctgtttcgttaataaagatttgaaacgagaacaatgtaaacctgttggaatatcatttacgctttcattttatctgaaattacattattacgcacg

SEQ ID NO: 93 - DNA, 2787 bp, Hordeum vulgare
gcacgaggatggctccggcatggccgctcccgatctcatcctagctggataacgccgtccttatcccaccaacccagtccgcctggtcttctactaatatttgtttgtttgttgatcagtcagcccacttcggcgctaccggctctccctccccgatccatccgactcctcccccttccgtcgccggccgtcgtacccgcagcagcagaaggggattcgcgcgggcgccgacgaggcggacaggtcaccggcagccatggtcgggcggagctctctcccggatggggccctcttcctcggactcgacagctccacccagtctgtgaaagctactgtgctcagcaatgagttaataatagtcgcttctgaaactgttaattttgactctgagttaccgcactacaaaaccgagggtggggtttacagagatcctacagatgacggccgtatttattcaccaaccataatgtgggtggaggctttggaattgctgcttgagaaactaaaaccgaagatcaacttcagtaaggttgtggccgtttctgggagtgggcaacaacatggcagcgtttactggaagaagggcagtcaagctgtgctgtcttccctggatcctggtaagagcttggtatcccagcttaaggatgccttttctaccatggactcgccaatatggatggacagtagcactaccaagcagtgcagagaaatagaaaatgctgttggaggagcattggagttatctaagctgacagggtctcgtgcgtatgagagattcactgggccccagatacgaaagatctaccaaacagcaccacatatttatgaaaataccgagagaatatctttggtgagctcattcatggcatctatccttgttggatgctatgcaagtattgatgaaactgatggcgctgggatgaacttgatggatataaacaagaggacctggtcaaaagttgttttagaggccactgctcctgatcttgaacagaagctgggaaatctggcaccggcatatgcagctgcaggtcgaatttcttcatattttgtagaaaggcatcagtttgacaagaactgtttggttattcagtggtcaggtgacaatcccaatagcctggcaggtttaacactgaatacacctggagatcttgcaatcagccttggtactagtgacacagtttttgggattactgccgaagctaaaccaagccttgaaggccatgtttttcccaaccctgttgaaccggatggttacatggtgatgctatgttacaaaaatggctcattgacccgggaagatgtgcggaatcagtgtgcagaaaaatcgtgggatattttcaacagctacctagagaaaacaccccctctgaatggtggtaggttaggattctactacaaagaccatgaaatcctgcctcctcttccagttggttttcaccggtacattgtcgagaatttcaacgacgcctcctctgaaaatctgacagagcgtgaggtgcaagaatttgatccacaatctgaggtccgtgccatcgtcgagggtcagatgctgtcgatgcgagggcatgctgagcggtttggcatgcccaatcccccgaagaggatcatagcaaccggtggggcatcctccaacgagagcatcctcaagttgatcgcacaaatctttggctgccctgtcttcacagttgagagaccggattcggcctcactgggtgcagccctgagagccgcccacggatggctgtgcaaggaggaaggaggctttgttcccatctcccgcatgtacgtgggcaacctggagaagacctcgctgggcgcaaagctggcggtcccggcgcccgaggaggagggcagggagctcctgaagaagtacaccgcgctcacgaggaagaggatggagatcgagagacggctggtggagaagatcgggcgtgcgtagagatactaggacacaccatacggcgcttgggaaatgggtatagggattattagtaggaggtaataatcattagttcaattgataatgtcgcgcgtgtcaaccgttgatggattatgtcgcggtcctgtgcacgaataatttcggatatgttcgttatggaaaactgtcacatgtctctacttcctgggttcttctaaaaaaaaaaaaaaaaaaaaaactcgagggggggcccggtacccaattcgccctatagggagtcgtattacccccgttcactggccgtcgtttaaacaaagttgtctttgcacctcctatggaaaggtaacctctacctccacacgaggtatgtgatcgcccacgggcacggggccgtccatcgaagagcgttgtgggcgattatcaggagttcctatgacagacgtccgtacatcctgggccattcttgtgcctcatgtgtcgacttgtggcggctatgactatctatctgattcattctcgcccttaggtatcctatgcccgccatctcacgtccgtgcgtatgcagtgagacacttatactgctcgccttgcacgagtacactcgcgatcgagcgctcttcacttacggagttcacgcctcgactccgttgttgttatctctgtgagttactatatactctgttctaacgtctatgtacgcgtatcggacgagcactgactcttcatgcatcatatagctgaccagctgtgcactatgtagagaatgcgtcattgcagtgctcgctactgcgaataattcgtcacgcgtgttcatgtcagatgttaaatactcgcactgttttgactatagtacttatctgtatccg

SEQ ID NO: 94 - DNA, 874 bp, Hordeum vulgare
tgcccctgaagcccactcttccccgcacctcctatatatccacccatctcaagctcacgactgcttcatccaagcaaccgagaccagctcacgaatccaccgatcaggaagcaggacacggaccgaacagctagctagcgcgcggcgatcgacaatggcggtcaagaagatcgggagcgagatgggcgtggtgctggggctggacgttgcgcggtacatggggcggtggtacgagatcgcgtccttccccaacttcttccagccgcgcgacgggcgcgacacgcgggcgacctacgagctcatggaggacggcgccacggtgcacgtgctcaacgagacgtggagcaaaggcaagcgcgactacatcgagggcaccgcctacaaggccgacccggccagcgacgaggccaagctcaaggtcaagttctacgtcccgccgttcctccccatcatccccgtcgtcggcgactactgggtcctctatgtcgacgacgactaccagtatgccctcgtcggtgagccccgccgaaaaagcctatggatcttgtgcaggaagacgcacatcgaggaggaggtgtacaaccagctgctggagaaggccaaggaggaaggctacgacgtggccaagctgcacaagacgccgcagagcgacccgccgccggagggcgatgctgcgcccaccgacagcaaaggggcctggtggttcaagtcgctctttggtaaatgataggttcatccgtctgtatatgaagtcggccggtactgtaacagccatgatgtgtgtttatctgtatcgatcttagtgtattagctaatctctacggtggcgaataaatgggattcagtgatatggtactaccgtttttcaggaaaa

SEQ ID NO: 95 - DNA, 1111 bp, Sorghum bicolor
ctctccgtctctagggtttgagattttagccgccgccgcagctcatctcacttccccgagaagtcgcagccgacgacgtactcctcgccgatacgatggccgtcttctccgacctccacaccgccgacggcctcaagaccctggaggcgcacctagcgggcaagacctatgtttcaggtgatgcgatcactaaggatgacattaaggtctttgctgcggtgccatcaaagcctggcgctgagtttcctaatgctgcccgctggtacgagaccatctctgcggctgtagcctcaagattccctggtaagcctgttggtgtaaatctgcctgcgggatcagctcctgcagcagctgctcctgctgctgaggctgaggatgatgatgaccttgatcttttcggggatgaaaccgaggaggacaagaaggctgctgatgagcgtgccgctgccaaggcctcttccaaaaagaaagaaagtggtaaatcctctgtccttatggatgtcaaaccatgggacgatgaaactgatatgaagaagctggaggaggctgttcgtagtgtccagatggagggtctcacttggggagcatcaaagcttgtgcctgttggatacggcatcaagaagatgactattatgttgacgattgtcgacgatcttgtgtccgtcgacagcctaattgaggaccaccttacggaagagcccatcaacgagtacgttcagagttgcgacattgtcgctttcaacaagatctagagttccaatcactgagattgggcaatggccggcagcgcttaaaagtttgtgctgggatgcgagactttatcccttctagttaccttgttatagaaatgttggttggagtttattgttgagtggtgccagatttttgaatacctgtttatcttaaaaacagcggaactgctgggcaatgttctatgtctaaagttaatgagttttcaatggttctgcatctaaagttaagttttctttgcaatgcttatttttgatcttctaatctataccagctgtgctaaatgtcgcggggttttaactaaaatggtgtttttcaacccgtcctgtactctgtatcgatattatatctatatttgata

SEQ ID NO: 96 - DNA, 1555 bp, Oryza sativa
cccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtgactacaaggaagggtattatataggtattgagataccagaagatgatccacaagcaaacagaccattctatggtccaaatcagtggccatccgatgaagtattgccaagatggaggaaggtgatggaacagtatcatagcgaggccctgagggtggcaaaatcaattgcaaggattattgcccttgctctaaacctagaagaggacttctttgataaaccagaaatgcttggcgagcccatagccacattaaggctcctgcattatgaaggtggacaaaaaacaggtaaagtatcaaatcctgcagagggagtttttggagcaggtgcccattctgattatggcctaatcactctactggcaaccgatgatgtagttggtctccaaatatgcaaggacaggaatgctcagcctcaagtatgggaatatgtagctcctgtaaaaggaggttttattgtcaatcttggcgatatgctcgaacggtggagtaactgtattttcaggtcaaccttacatcgagtggtcttagatggacgagaacgtcattctattgcgttctttgtggaaccaagccacgattgcgtagtcgagtgcctgccaacctgcaaatctgaatcaaatcctccaaagttccctccgatcacttgctcggcatacctatcgcagcggtacaaggatacgcatgccgatctgaccgcttacagcagcaacaaggcctagaaggccaagcgccattttgatctcatccaagctctcagctgtacttaagatgtacaacctgcaataataatcccttaggatggattgatggtgttctatactaattaaattaatcccagtgtacctgtaaccccagtctcatagtgatatagtagtatactagtgatagtacattgttcatgaagtgaggagtgagcagtggcatctgtttttgtactaccatatgtgtgggtgagctccagggctcatgcttttcgctgtcgatttcccatctgctttggggcagatatagctttcgagttggatgtgtggataatt

SEQ ID NO: 97 - DNA, 907 bp, Oryza sativa
cccttgagctagggttttatcgccgccgccgccgcttctccactctcccctgcccccgtcgccgtcgccaccgccgccgccatgtccgggaggaagaagacacgggagcccaaggaggagaacgtcaccctcggcccgaccgtgcgcgagggcgagtacgtcttcggcgtcgcccacatcttcgcctccttcaacgacaccttcatccatgtcaccgatctgtccgggagggagacgctcgtccgcatcactggtggcatgaaggttaaagctgatcgcgacgaatcttccccttatgctgctatgcttgcttcacaggatgttgctcaaagatgcaaggagcttggaataactgctttgcatatcaagctccgtgctactggtggtaacaagacaaaaacccctggtcctggtgctcagtccgcacttagagcacttgctcgatctggcatgaagattggtcgtattgaggatgttactccagtgccgactgatagcacacgcagaaagggtggtagaaggggtaggaggctgtaatcttcatgcggcctcaaaccgacaacactctgctctcctagatgttaccgtctgcattggactattttgtttctgtgcttttcattcggtggattatttaaaccagttttgaactctgtttctgcatcaattcatgctgtcctcaatgtaaccaacgttatctgcttcgaccggtgaacatactcctgttggattacttgagcatatgccactacaggccggacactgctttcgttgtttattcgggagagcatggcaaacttgggagatgaaaacctggaaaatggtgcgaggataatgggcataactgtaaaatagtgcgttttgtacgaaaactttatatatgaaagttgttttaaaatttcaggtt

SEQ ID NO: 98 - DNA, 962 bp, Oryza sativa
agcttcttcagttcttctccaaacccaacccccccaagaggccaaaaccctctcctatatagccacactcatccttgcaattagctcaactcagctcaagttggcaattcatatcaaacagataacatcagtagttcgcagctagatcgatcgtcacagcaacacaatcaccacgacgacgatggcggcggcggcggtggagaagaagagcgggagcgagatgacggtggtgcgggggctggacgtggcgaggtacatgggccggtggtacgagatcgcgtcgctgcccaacttcttccagccccgggacggccgggacacgcgggcgacgtacgcgctgcggcccgacggcgcgacggtggacgtgctgaacgagacgtggaccagcagcgggaagcgcgactacatcaagggcaccgcctacaaggccgacccggccagcgacgaggccaagctcaaggtcaagttctacctgccccccttcctccccgtcatccccgtcgtcggcgactactgggtgctctacgtcgacgacgactaccagtacgcgctcgtcggcgagccgcggcgcaaggacctgtggatcctgtgccggcagacgagcatggacgacgaggtgtacgggcggctgctggagaaggccaaggaggaagggtacgacgtcgagaagctgcgcaagacgccgcaggacgacccgccgccggagagcgacgccgcgcccaccgacaccaaggggacgtggtggttcaagtcgctcttcggcaaatgatcgagaaattctcagcggccgatggatggatcagaggacgacgatgtatagctatagtatgaatttgccttcagtagcagtggagaataaaatggacttttggtgtgagtgtgttcttgaggtgattgtgtgtttgtaatgctgtgctttacaggaattaatggaaatgaactcttacacgtgcttaatttta

SEQ ID NO: 99 - DNA, 1445 bp, Zea mays
ccatgtcccgcctccccctctcctccgccctcccagtccatctctccagtgatccagtcctaacactcccctccgcgccgacgcctctggtgtctggtcaggcggtcaccacttcaccaacaggcgccaccacaccaccgacccatttgccgcgttggtgttgccggatcttcaagcaggcagcacaccccacccggacccgagaacccgcgcgcgcgcgtattaataacggcaacctcgctcgcggctcgccgagggaatcgcacgcacccagcgatcagcgcagattccttccacgccccccctcctttccaggtcccctcgcccgcgctctcagatctcgcgcgcctcccacaagggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctaggcaccacataaacatatctgtgattatgatggaccctttaatatagaacaaaagttttggctcatttgagctaccagcgtaccagtaggcaattcgatttgttaccagcaacaagtgatctgattcccagtggtcctgctagagtaacattttttaccactgtctgttgtctatgtatcctttgatattgtgttgtaccaatgtgcaatttactctatggactgatggaacattgtgccatcccatccaccagatttattgtggcgttatggaaagcatagaaccgctgccatattctttaatttgtacgctgaaatatactcgttggcaccgaacttttggttgatgacttcgtgatataataaccctaccggcagtaaatatctacgctc

SEQ ID NO: 100 - DNA, 2013 bp, Arabidopsis thaliana
acatgtgaaaaaatctcacttttcttttcatgattccttcctctttgctcgttctctctctctctctctctctgcctagtctagtctttcttctgcacatcttctctctctctatttccgcagacatcaattcccctttttgactaaaattccgcgacttgggctttgatccattcccagtgaatctcactgcttttctcacagaaaaaaatcactcctttttcctggattttgttttctcgactgatttggggaaaagctatggtggtctgattaatctctgtctgtctttggtgagatgggtttggatgctgttaaagctaaagggaattggaaatcggagaaacctaaagagactgagaataagaatcacaagaagaagaatggtgatgataataaaagtagaaatgaagaagaagaagaaggagaagcaagtggttgctgggtcaaatttaggtttatgattggttgcataccttcaaaatcagaccttgatgcttcttcttcttctatctatggctctaactgcactgttacaacaatggaaagtaaatcggcaaatgagaaatcaaatgatcaaccagttggtcaagtttcctccacaacaacaactagcaatgcagaaagctcttcatctactccagtcatcagtgaagaacttaacatttcttctcacctccggaagtttactttcaatgatcttaagctatctactagaaatttcagacccgagagtcttcttggagaaggtggttttggttgtgtctttaaaggatggatcgaagaaaacggtactgctcctgttaaacctggtactggtcttacggttgcagtcaaaaccttaaatcctgatggacttcaaggtcacaaagaatggcttgctgagattaatttccttggtaaccttctccatccaaatctagttaagcttgttggttattgcattgaagatgatcaaaggttgcttgtgtatgagtttatgcctagaggaagtctggagaatcaccttttcagaaggtccttgcctcttccttggtctatccggatgaagattgcattaggtgctgcaaaaggtctcagtttcctccatgaagaagctttgaagcctgttatatatcgagatttcaaaacatcaaacattttacttgatgcagactacaatgcaaaactatcagattttggacttgccaaagatgctcctgatgaaggcaaaacccatgtttctactagggttatgggtacatatggctatgctgctcccgaatatgtaatgaccggtcacttgacatcaaagagcgatgtttatagttttggggtggttctacttgaaatgttgactggacgacgatctatggacaaaaaccgcccaaatggtgagcacaacttagtggaatgggcaagaccgcatcttcttgacaagagaaggttttaccggttacttgatccgaggcttgagggccatttttcaatcaaaggtgctcaaaaagtgactcagcttgctgcacaatgtcttagccgtgaccccaagattaggccaaagatgagtgatgttgtggaagcacttaaaccacttccgcatctgaaagacatggcaagctcttcttactacttccagacaatgcaagctgaacgtttgaaaaatgggtcaggtcgatcccaaggatttggatcaagaaacgggcaacaccaacccgtgtttcgaacactgtctagtcctcatggttcttcgccttatcgacatcagattccttcgccaaagcctaaaggagcaactacatagctcttacgtggtggaaataggccacaaacgaacagagctagaaggctcaagcttttatcgtcgtttttaagcaacaaggagatatttttaaacaacgttagggtaactctttaattgattaataatgtacgatggagaagggtaaatccaaatggaaaaaaaaaaaactgattttgtcttccattgctgaaagcatagaaaagttataaattgaaaacatttttgatgctctt

SEQ ID NO: 101 - DNA, 3207 bp, Arabidopsis thaliana
cgacgtttcttctaccaacgattcctgtttttgccggccgatctgtggactgtggatatagccggaaatgagtcacaggcgacgggagaggtatcggaaggagggagtaacggtacgaccagcgatatctacggcgacggaggcgataatgctcggatatttaaccgacggcttcttgagggatccactggtattatcaatggtttcctgacgtggacaaacaccaagaagcccgtggacgctgaaagctgtgtcgagaagctattactttatcttcggattttggtttgggaactgctctaacatgcgctgttaccatcaggcgcctggacaaacaagcagacatgatgccagattcccaggtttgtaaaacataagatatatcttccagagatttgataagattagaattattttccttaaacaagattgtgcttctgtggtgaacagatgatgtcataaggtatacaaggtcgactatattttaaaatgttgatgtagaatattatcttctgaccaaagcataactaaatagttttcttgactaactcatcggttctacaatggtccatggagggttgggacaccattaactagttaattaattgatatcaagtgttcacatgtcttgactagttcatatgtttattatgtctgcagtcattactttactttcatatatatacaaactagttaaataattggttttgaaagcattgactctgcaacctgtagcaatctctctgattttattccttgtagggccttgactagttcatgggcattttttttgttggcttagatgacttccatcatgctcccaaagatataaaagacaaaaacagaaactaagctcttagtttctaaaaccgtcgatcaaaaatcatgtctcgtacaatcggctcacgggtcattttcttgatccttgctctcttctgttgtactgaaaactcccgtggcaaactggttatgcagggatccgctggattttttaaaggttacaggacgttgacgagcaccaagaagcacgcatatggtcaagccttcgaggacgagatagtccctttcaagaattcggccaacgatacagttacttctttctctgtcacgttcttctttgctatcgcccctgaggataagcacaaaggcgctcatggtatggccttcgtgatctctcccacaagaggcattactggtgcctccgctgatcagtaccttggaatctttaacaaagcaaacaacggggatagctcaaatcatgtcatcgctgtggagctcgatataaataaagatgaggaatttggcgacattaacgataaccatgttggtatcaacataaacggaatgaggtctatcaaatttgctcctgctggttattatgatcaagaaggtcaatttaaagatctttctttgataagtggaagtctactccgagtcacgattttgtatagccagatggaaaaacagcttaatgtcaccttatcatcaccagaggaggcttattacccgaacaagcctcttctttcattgaaccaagatctatcaccctatattttggagaacatgtatgtgggcttctcagcctcaacggggtctgttagagcaatgcattacatgttgagttggtttgtacatggcggcgttgatgttccaaacctggacttgggaataccaacatttcctccatatcccaaggaaaaatctctggtttatcggattgttttggtgaccagcttggcattggttctctttgttgcgcttgttgcatcagctttaagtatctttttctacaggagacataaaaaggttaaagaggttctagaggaatgggagatccaatgtgggcctcataggtttgcttacaaagaactctttaaagccacaaaaggtttcaaacaacttctaggcaaaggagggtttggtcaggtctttaagggtacacttccaggttctgatgcagagattgccgttaaacgaatttcacatgattcaaaacaaggaatgcaggaattcttggctgagatatcgacaattggtcggcttagacaccagaacctagtcaggcttcagggttattgtaggtacaaggaggaactctacttggtttatgactttatgcccaatggaagtcttgacaagtacctctaccacagagcgaatcaagagcaactcacttggaatcaacgtttcaagatcatcaaagacatagcctctgcactctgctatttgcatcatgaatgggtacaagttgtaattcatcgagacatcaagccggcaaatgtcctgattgaccaccaaatgaatgcaaggctcggggattttgggttggctaagttgtacgatcagggttatgatcctcagacatctagagttgctgggacattctggtacattgcaccggagctcataagaagcggaagagcaaccacagggacagacgtctatgccttcgggctgtttatgctagaagtctcttgcggtaggaggctgatagagcgaagaacagcctccgacgaggtcgtcctagctgaatggacattaaagtgctgggaaaacggagatattctcgaggcagtcaatgatggaatccgtcacgaagacaatagagaacagctcgagcttgttttgaaattgggagtgttgtgttcgcaccaggctgtagcaattaggccagacatgtctaaggtggtccagatcttgggtggtgatctgcagcttccagataatctactcgatatagtcaaagcagagaaggtcagaatgtggtctgagacatctgagagtgtacttggtgttttgacatcacaagggtccattggtaccttgacgttaacggaaccttttacctcccggggacgctgagacgtgatgctgagttcggtcgtgaaatgatatatgacatgtttgtttgtaaatattttatgttttcgattgatgacaaaggagtcagaaaggacacttgaccatcacggaagcgatgacttccgtcggacggtaaaaagtgatggtcgaggtttggtgagaaatctaaaaatgtgacggtgtttgcttgataaatatctttattttggtgattgtattgaatgtatcgttttgatttctgtttatacttatatcggcggtggaataattacacatgacctgaaaagtatgcgtttgtgtttacttttatgttgtagtacttgttgtgtttttcagctatgaaaa

SEQ ID NO: 102 - DNA, 1309 bp, Arabidopsis thaliana
cactcagttctaaactctacaaaagagagaaagagagaaagcgagttgtgacataaaatccatggctgaagcttgcagagttaggaggatgaagctaggaagccaaggccttgaggtatctgcgcaaggccttggctgcatggccctctccgctcgatacggtgctcccaagccggaaactgacgccatcgctctcctccaccatgctattaactccggtgttactttctttgacacctctgacatgtatggtcctgaaaccaacgagttgctcctcggaaaggctctgaaagatggggtgaaggagaaagtggagcttgcgaccaaatttggattctttatagtagagggggaaatttctgaggtaagaggagatcctgagtatgtaagggcagcgtgtgaggctagtttaaagaggctagatattgcctgcattgatctttattatcagcatcgaatcgatactcgtgtccctatcgaaatcactatgagagaactgaagaagctagttgaagagggtaagataaagtatattggtctgtcagaagcttcagcttcaactatcagaagagcacatgctgttcacccgataactgcggtgcaaatagaatggtccttatggtcgagagacgcggaagaagatatcattcctatctgcagggaacttgggattggaatcgtagcttatagccctctaggaagaggcttcttagcagcaggacccaaacttgctgagaatctggaaaacgatgacttcagaaagactctaccaagattccaacaagaaaacgtagaccacaacaagattctctttgagaaagtttctgcaatggctgagaagaaagggtgcactccagcacaactagccttagcatgggttcatcaccagggagatgatgtttgccccattccaggaaccactaagattgaaaacctcaaccagaacattagagctttgtcagtaaaactcactcctgaagaaatatctgagctcgactcccttgccaaaccagagtctgtgaaaggagaaagatacatggcctcaatgtccaccttcaagaactccaacactccaccgttgtcttcctggaaagccacttaaaaccgcatgagagtttctctagctaaacctactaaaattaatatgctaagggcttgtgtaagcccacaaaaataatatgtaagagtttgtgttgatgttcagagtgttcaatgtataattttctatgcatttcatatactgcgaccaacctctaaatctaaaacatcaccttttcaaccatttagaaaaatttaatacatggaaaaa

SEQ ID NO: 103 - DNA, 865 bp, Arabidopsis thaliana
ggccgcaacggaaaacaaatccgccaatggaagcggctctgagcatcttcaagctctcgttccttctcacccttctctccggcggttcagaccttatcgactcgttgccgccgaattgtaaccgagccgagtgtccgagttatgaggttgtccacgccgggaatggctacgagattcatcgctacaacaccaccgtttggatttctaccgaaccaattcaagatatctctctcaacgaagcttctggcaacggttggaaccaattgtctgattacatgaacgggaacaacgattatcaccagaggatagagatagcacttccttatatcacccaagtctctcagaacttgagcaccttcatagtctctttcttcgttcccaaggcattccaacctgatccacctccgggaaacaacctccacgtacagagatgggactcgaggtacgtggcggtgaagcaaattagtggatatgttgcggatcataaaattggaaaacaagtggctgagctgaaggcgagcctacaaggtaccgtatgggccaaggcaattgagaaaagcagagaaaccggcggtgtcggatcggcttgggcttacacggtggcgcaatttagctggccgttccagtggagtcagcgggtcaatgagatttggtttccgtttgaaatggaagatgaagaaactgttagtatcgttactcagtgaacaaaaaaatgaacacttttttatctttttatggtgtagtgacaaagcaaagccattgagataagcctatctcctaaaagttgttaaataactgtccattgtcttactctggtcagcacattccctaaagaaaagaaaatcaaaagagtacttttttctga

SEQ ID NO: 104 - DNA, 2832 bp, Arabidopsis thaliana
aacgaaggagacaacacaacacacacacacacagagagcaagcaaaagaggcggctagggatcagagagtggttccttcactgaaagtttcttctttttcattctcttcttctccttcagattccttgcctcttcttcaagattctcctctcttccatgtgcgtttctgtgcttttgaagacgacgatgatgatgatgatgtctttatattgaaaccaaattcgtctccacgattgtttcttctgagttttgatttttcagatctcgcttcttttccgatttgttcaatcatcatggcttacctgatgtagtaattgggatcaaattcattcacaaagctcgagtttttattattagtggctactgttatctgtgtatagaagaagcttgtgtgtgtggttctctacgtttcatgatcggtttaggtatctgttatatccggctcgtgttggtttcagatttaggcactggtctagaaggtctttcttcggctactgcttcttctgttcaccaaaagaagccttttttggtttcttcttctgtttcatgtcgaggaacttagacagtcctgttcagacacaaatggcagtggcagttttcaagactcctcttactggagctagtaagatggaagggaagcagcatcataagcatcagcatttacagaggcaatcatcggggaggagagttttcgtgcagactgaaactggttgtgttttggggatggagttggatcgtagtgataatgttcatactgttaaaaggaggcttcagattgctcttaatttccctactgaagagagttctttgacttatggtgatatggtgttgacgaatgatttgagtgctgtgaggaacgattctccgcttctgctgaaacggaactttatgcatcgaagctcgtctactccttgtctttcgcctactgggagggatttgcaacagaaagatcgaagtggtcctattgagatactaggccattcggattgcttttcgattgttaaacatatggttaaggacattgttaaggcgatgaagatgggtgttgaaccgcttcctgttcatagcgggcttggaggtgcttactattttaggaacaaaaggggtgagagtgttgccattgtcaagccgacggatgaagagccgtttgcacctaacaaccctaaaggctttgttgggaaagcccttgggcaacctggattgaagtcttcggtgcgagttggggaaacggggtttagagaagttgctgcttatcttcttgattatggtcgctttgctaatgtccctccaactgctcttgtgaagataactcattctgtattcaatgtcaacgatggggtgaaggggaacaagcctcgggagaagaagctggttagtaagattgcttctttccagaagtttgtggctcatgatttcgatgcaagtgatcatggtacttcaagcttccctgtaacttctgtgcaccgcattggtattttggacataaggatcttcaacacagaccgtcatggtgggaatcttttggtgaagaagctcgatggagttggtatgtttggtcaagtggagcttattccaatagaccatggcctctgcctgccagaaacacttgaggatccttattttgagtggattcattggcctcaggcatcattaccattctctgatgaagaggttgactacatacaaagtcttgatccagtgaaagactgtgacatgcttagaagggaacttccaatgattagagaggcgtgtcttcgggttcttgttctctgtactattttccttaaagaagcttctgcatatggtctgtgtcttgccgagattggcgagatgatgactcgggaatttcgtcctggagaagaggagccaagtgaactggaggttgtgtgtattgaagccaagagatcagtcactgaacgagatgttttctctccaaggtcagatgtagtaggagaagcagagtttcagtttgatctagactgtgatgatttggagtcagtctacagttctaagatacaactaaccgatgactatttcaccaaaaaccctttttcaaatggacgttcttcgctcgggaagcttgaagaaagcatcaaggaagaagaagaagatgaagaagaagaagaggacaaaactgaaaatactgtccctatgatcattatgaaagacagtttttttagttcagctgcttttcatgacaaggctccatctctttcaaagctttccacttcaatgaagaacacacatcttagtgacacgacacgtaaaaacccaaaacccttaaccagaggcaaatccgagaacacatcgtctggtcacaaaagcgcaaacgaacagcttccagtgagtgcaagctttgtgaaagtagcagacatgaaagaagacgagtgggttctcttcctcgagaggttccaagagttacttggaccggctttcgcaaaacgcaaaaccgcaacgttgagtaagagacagagacttggcacttcatgccagttttgagagtcgtatagtaaaaagtaaaactcgagaagttaaaagagacagtatggagtaaaaaactgaagacttcttcttcagttctatggtagtaaaaaactagtagttacttttggaaggtttggcttatgacaagcgacgaggtgaagaaaaggggttttgtttgtttgtttttttaactgttttgtaaatatttcttttactactctttgtgatcttctttgtttgtttgtttggttttttttttgccccttttatcaccttctcttgtttttttctttggtatgtccttgtggcttggccttgtcccataaataatattagtcttctttcact

SEQ ID NO: 105 - DNA, 1624 bp, Arabidopsis thaliana
gcatcatcttccttcttctcttaagcacaaatggcgactctttatagtcaagttccttctgtatcagcagttttctctctttacacatctttttccgcaatcacgatgctttttcgaacaatcctcaacgagattgtgcctaaaagaatcagagagtacatagctatgaaagctgtagacttcttctcttcttactttcaatctgatttcacttttgtgatagagcaacgttgggagtttgttgagaatcagacgttccgtgctgctgaagtttacttacctacctgtctcgccggactttctacaggcaaacttcttgtgggttcaagtaatcttaagaatccagctgctgagccaaaacttggtatccctgtgaacactaagatcattgataactttgaagggattcatctagaatggactcttcactctgttgaaactaagaagtatctacccgaaaaacggtactttcatttgacatgtaagaaggagtttcgtgagaagataatgacggattacttcacttacttagcgaaatcagcggagaagataatgagccatcgcgagaatctcaagatctatacttataaccaagaccggtctaaatgggaatctgctatcttcgagcatcacacgacctttgagacgttagctgttgagccagacctaaagaagactttgattgacgatcttgatgctttctctaaaggaaaagacttcttcaagagcgtaggacgtgcttggaagcgaggatatcttctttacggtccaccgggaaccgggaagtcttctatggtagctgccattgctaatcatatgaagtatcatatctatgatcttcagattcaaagtgttagagatgatggtgagttgcgggagattcttacttcgaccaagaaccggtcgattcttcttattgaagatattgattgtggagctgatgcttctcgtagacgtcagagtaagaagaaggaagaagatggtggagaagatgatggtgagccacaaaagaggaagaagaagtttgaagttgggatatctttgtctggtctattgaactttgttgatggactttggtcaagttgtggagaagagaaaatcataattttcactactaatcacaaggagaagctcgacccggcgttgcttagaccaggacggatggatgttcatattctcatggacaattgtactccctttgtgttcaagaagcttgtggctttgtaccttaaaaccgatgagcatgtcttgtttgatcccattgagaagctcattcttgaagtgagttcgactcccgctgaagtcacgcagcagctcatggcgagtaagaacgctgatatcgcgcttaaaggccttgctgaattcttggagaacaagaagttgaaaaagggagaagattctagtgtggaggaagagggagagattgaagatgctgagactaaagaagcagaaacataagactttattagaagtaactctagtgtttcagctccttttggtaataaatatcattgctttagaccagatgaaacaaaatgtagctaaaactacatgttgatgtatgaacaattaggggacatagagtctcataaatatatctttcttttataaaattgtataaccc

SEQ ID NO: 106 - DNA, 1748 bp, Arabidopsis thaliana
aaagagaaagcaaagaagagaaactaaaacagagcttttttcacatgggaaaggataagactttgccgttgcttgaccctcgtgagccaccggaactcaccggaaccaagtcggcgtcaaaagtatgggccaaagagttcggcgaagagtcgaagcggctttgggagttagcaggaccagcgattttcactgccataagtcaatactctcttggtgctctcactcagactttctccggccgtctcggtgaacttgagctcgccgccgtctcagttgaaaactctgttatctccggtcttgccttcggtgtcatgttagggatggggagtgcattggagacgttgtgtggacaagcatatggcgcgggacagattaggatgatgggaatatatatgcaacgttcatgggtcattctctttactactgctttgtttttgcttcccgtctacatttgggctcctcctattctttccttcttcggcgaggctcctcacatctctaaagccgcggggaagttcgcattgtggatgatcccgcaactatttgcctatgcagccaacttcccgatacagaaattcttgcagtcacagaggaaagttcttgtgatggcttggatctctggagtggttttagttatacatgcagtttttagctggctcttcattctttactttaagtggggacttgtaggtgcagctatcactctcaatacctcgtggtggttgattgttattggtcagcttttgtatatcttaatcaccaaatcagacggtgcgtggactggattttctatgctagcgtttcgggacctctatggatttgtcaaactttccttagcctctgctcttatgctttgtttggagttttggtacttgatggttctggttgttgttaccggtctccttcctaacccgttgataccagtcgatgccatctccatttgcatgaatatagaagggtggactgccatgatttcgatcgggtttaacgctgcgattagtgtgagagtatcgaatgagctgggtgcaggaaacgcagcgttagccaaattctcagtgatagtcgtctccataacttcaactcttatcgggatagtgtgcatgattgttgtcttagccacaaaagacagcttcccttatcttttcacttcaagcgaagctgtggcagcagaaaccacgagaatagccgtcttgttgggcttcactgtcctcttgaacagcctccagcccgtcttgtcaggggttgcggttggagcggggtggcaggctctggttgcatacgtgaacattgcgtgttattacattatcggactacctgctggtcttgttcttggattcacactagacctcggcgttcagggaatatggggaggtatggtagctggaatatgcttgcagacacttatattgattggaatcatctacttcactaactggaacaaagaggctgagcaagcggagagtcgagttcagagatggggaggaacggcgcaggagtgatcaacaactcccttaggacgtggactatatcagttattgatctttttttgtcaatgttcaatgttgagaaaattgtttatcggagaacaacatcatctctttttgttttttgatatgcttaaagttaacgagtctctcagtgattgttagaggggtacggtttgttatgtgttagacttatgttagattctaggatggttgttgctaagccaaagttcttgattaattttaagtatgagatttaatctt

SEQ ID NO: 107 - DNA, 1740 bp, Arabidopsis thaliana
gaatgaaaaaaaaacagaagcagagagagaaaagagaagacagagtcaattcaatttctgaaaaaaagttcaaatttttctaataaattttgatttcccattagtcagaaacatcttctttctcgtgcccggagctcaatttttcaaatttcattgaaaaatcgaagctttcctggaaaatttttgcattctctattacatcgtcttcacctaattttccattaatgggtatctcaaaagacaggatcaaattcaacgttggtggacgactcttcgaaacgacggcgacgacgttagcaaacgcaggtcgtgattctttcttcggagcattgttcgacgacgaatggaatctttcaccacttgaagattccattcttttcgtagacagaaactcagattgcttcgcagttcttcttgatcttctccgtacgggagaccttaacgttccggccaacatccctgagcgtctccttcatagagaagcttctttctacggtttacttgaccatgtacggaccgctaaatggggtccgtttgatggtaaccgtcttcgtctatcggattctgttaaaggaattgctcccggagacggaaccgccatcagggcaggtcctgatggcggttgttgcgtcgcgcacgggagtgttgttcatgtttttgattggatgttggaagaacattctccgatcaaccttgattaccagagagtaaacgatgttggctggattgattcagacaacatcgtactctctgcttgtgagaaattgggaagaggagatggaggaatgggactgttcagttcatcttccggtgatcttcggtataagtttcaggtctgtcatgagaatcaggtgaagagttatacagctggagctttgagtttttcgccggattatgagatttttgcgagctgcaaaggtcggagtaatgagtatggaatcggagtttgggatcagataactggaaagcaaaccgatttcttctacgagagtcctggttggtcacttggtgatgctgacaagcttcaatggctgaatggtaagaactgtcttcttgtggctacattgtttccaagaaaggacaactgttacattagtttgttggattttcgggacaagaacatggtttggtcatggtcggatattgggtctcctatggcgatagacgagaagagagtgagagatgcaatagctatggaagatagcaattcgatttgtgtggtgaatgagtttgaggatttggggtttattgatctgaggatgtatggaggaagcgtgaggtggagttcgagaagtaaactgatgaagagtaagatgcctgatgagccttgttacccgaaactagctttgcatgaaggccagcttttctcatcaatgaatgattctatctctgtgttctgtggaccagactgggtcttaacttctaggctaagaagaagctatggtggctcaatctgtgatttctccattggtggcgaccgcctttttgcattgcatagcgaggagaatgtgtttgatgtctgggagactccgccttgtccgatcatataattcactaccttaatactctggtttgcttttgttcacgtttagtttgcttgttttaatagagtccttagaaaactacagagaaaagaatagcaatagacaaagacaactatagcaatagactgatgatcttagttttgttctatacaaagaaagtgttgcttcttactaagaaatgatatcgattttatac

SEQ ID NO: 108 - DNA, 1530 bp, Arabidopsis thaliana
ggagagaaatccatggagacgatgacgatgaaggttgaaaccattagtaaagaaatcataaagccatcttcgccaactccaaataatctccaaactctccaactctcaatttacgatcacatccttcctccagtttacacagtagcctttctcttctacaccaaaaatgatttgatctctcaagaacacacttcccacaaactcaagacttctctgtctgaaaccctgaccaagttctaccctcttgccggaagaatcaccggagtaaccgtcgattgtaccgatgaaggagctatctttgtcgatgctcgtgtcaataactgtcctctcactgaatttctcaagtgccctgatttcgacgccctccaacagttgcttcctctagatgttgtagacaacccatacgtggctgctgccacgtggcctttgctgctcgtgaaggcaacttacttcggatgcggaggcatggccataggaatctgcatcactcacaaaatcgcggacgcagcctccatctcgactttcattcggtcctgggccgccacggctcgaggagagaacgatgccgctgcgatggaaagtcctgtatttgctggtgcgaatttctacccaccagccaatgaggcttttaagctacctgcggacgaacaagccggcaagagaagcagcattacaaagagatttgtgttcgaagcttctaaggtggaagatctcaggaccaaagccgctagtgaagaaacagtagaccaacctacgcgggtggagagcgttactgcgctcatctggaaatgcttcgtcgcatcctcaaagacaactacttgtgatcacaaagtgctggtccagcttgctaacttgcggtccaagataccttcccttctgcaagaaagctctatcggaaatctcatgttctcttctgtggtcttgagtattggtcgaggaggggaagttaaaattgaagaggccgttagagacttacgaaaaaaaaaggaggagttaggaactgtgatcctagacgagggtgggtcatctgactcatcttccatgatcggttcgaaactagcaaatctgatgctcaccaactattctcggttgagctatgagactcatgaaccctataccgtgagtagctggtgtaagctacctctttacgaggctagctttggatgggattctccggtttgggttgttgggaatgtgtcccccgtgttaggcaacttggccatgttgatagattccaaggacggacaaggaattgaagcgttcgtcacactgcctgaagagaacatgtcgtccttcgagcagaacccagagttgctcgcctttgctaccatgaaccctagtgtcttggtttaaatcctgtactgaaatttgttgtttcctcaataaagatttggatacaccgaatctatatatatcttcaagatgtaatgcaagaaatgtaaactactggaatatcatttatgttttaacttttctgaatataattcctcagctggtatgacgtagttaattaccaataaaccgtcattt

SEQ ID NO: 109 - DNA, 2050 bp, Oryza sativa
acgtccacccctcgccgtcgtcaaagcgcggcgattaacggcggcgcgcgacggcaattccacccgaatccgatgtataaaaccaccccgcggctcccccaaatcaccaagaagaacacccacctcagattagtcccaaagattattcgcgattaagcttgtttttttttgttcctaatcgcagatacaaagaattcgctttgcgtttgccactcgagaaagattttgttttttttttttggttaacggataattaagcgccgcccctcctcgtcgtcgtcgccgccgcatggaggccgtcggcgtggctccggcccccgcgggggtgccggagaagaagctgctcgaagtgaaggagtcccggaaggcggcgccggcggcgccgtcgacgtcgatggcggccaagtgggcgatgaagaagaagctcgtcggcggcgacgccgggtacgtgctcgaggacgtgccccacctcacggactacctgcccgagcttccgacttacccgaatcctctgcaagacaacccggcttattcagtcgtcaagcaatacttcgtcaacactgacgacaccgtcacgcaaaagatcgttgttcataagaccagtgctaggggcacccatttccggcgagccgggccgcggcagcgggtgtacttccagtccgatgaggtcaacgcggccattgtcacctgcggtggcctctgccctggacttaacactgttatccgcgagcttgtgtgcggcttgtatgatatgtatggcgtcaccagcgtcgttggcatagagggtggatacaagggtttctattctagaaacaccgtcgcactgacaccgaaatcggtgaatgacatccacaagagaggtgggactgttcttggaacctccagaggaggccatgacaccggcaaaatagttgacagtattaaggatcgcggtattaaccaggtgtatattattggaggtgatggtacccagaaaggtgcttccgtaatttatgaggaagttcggaggcgaggcctcaaatgttctgtggttggtgtcccaaagaccatagataacgacattgcggtgatcgacaagtcctttggttttgacactgcggtggaggaggctcagagggccatcaatgctgctcatgttgaggctgagagtgcagagaatggcattggtgttgtgaaactaatggggcgcaacagtgggttcatcgcaatgtatgctactctggctagtcgcgatgtggattgttgcttaatcccagagtctccattctatctagaaggaaaaggtggactccttgaattcatcgagaaacggctcaaggacaatggccatatggtcattgtagtggctgagggtgctgggcaagatctcattgcgaaaagcatgaattttgtggatactcaagatgcttctggaaataagctacttctggatgttggcctttggctctcccagaagatcaaggatcatttcaagaagaagcgcaacttccccatcactctcaagtacatcgacccgacatacatgatccgtgccgtcaggtcaaacgcatccgacaacgtctactgcaccctgctagctcacagcgccctccacggcgccatggcggggtacaccggcttcaccgtcgcgccggtcaacggcaggcacgcgtatatcccgttctacagaatcacggagaagcagaacaaggtggtgatcacggacaggatgtgggcgagggtgctgtgctcgacgaaccagccatgcttcctgagccacgaggacgtcgagcacctcaagcacgacgacgacgagcaccacctgcacaacacgcagctcctcgaaggcgagagctcgccggtgaaggactcctccaagtgcaacgggacagcagcgccagtgtgagaaccaacgagaatatatatatatatatatatatatatatatatatatatatatataagcatgtaattgtagctttctttttgtcctttttttctgaaatgacattgtggggaagctactgtaatagaattaccgtgtaatatagcaaggctggtttcatcctcg

SEQ ID NO: 110 - DNA, 1890 bp, Oryza sativa
gggttgcactcaagagtcaagagtagtttatcttcgtctcgcctttgttttccccttcgcgcaccaaacaccaaacaccaaaccctcgccgccgccgccgccgccgccgccgccatgcggatccccacgacggagacggagacggggacggggacacgcagccacaggcggcgcaagggatcgtccgacggttcgcgggccgtacaccggaccgacgcatcccgtcgcggaccaacgccgaccaaggaaacggagattcccgggcggccgccgaagcgatcctccttaaccctatcgttggacgacgcgggcgcctccaatccagcctcaacctgggcgatcctgaatcggtacggcgcccggagggattccttccgcggcgacgaccgcgaccgcaccacgtcggcggtctcctacacctccggcggcgaccagatctccgtctccttcgagctcgtgaagccgccggagacctccctcctcaccctcgactggccgcaggggccccgcccgtcggcgggaaccacatcctacccatacgtcatcgccgcgcacgacaacgtcgtcctgttccagatcatctcccccgacaagtacgctcgcccttccgccatcgactacttcgtctacaatgccaacagcagcagcagcagcaaccaccacccctccttgacgcggctgcccgtctcctactggaggaggagagacacccttcgcccgcgcatcatgagcagggaaggcacatgtattctgtcctgcagcaacaattctccttcgttcgttgtggctgagctcgagagaagatcatgccaatcttccgaaaccaacatctacctctttgcttctggctccgatgactggagagtcttcaggaatgtgccgatccgccatggcgacggcctcgctcacctgtgctggtggacaactgatgcagtgttgtcgtaccacaatcgctacatgatctgggtggactacttggtagcagggatgatcgtcgccaaagtggcacatccaggaagggttgacccaccggagcctgttctatggtacgtgccgcttcctgtcgatccagttgatgggaacccttatgacattgaccgtgggcgaggatgccctcaagcctcccgtagtgtgtgtgccacccaccatggcatcaagttcgtcaatgttaaccaacatggcggcggcagcagcagcagcagcagcagcagcagaagcttcagcatcaccctgtggtcgtggcgcgaggaggatcaaacatggggagaagatgcaacattggatgctgaccaacttcgggacctcgattctgagaaccgccttccaaatatccaacctgaattccccgttgttgacatggaaaacccttacgccgtttgcttcttgttgaacgagcgctaccacactgctgaccccaatgccacaacgtggatgatcaaggtgcacatgaagaagaaggttctactagattgtaccggatattccaacaaaggaagcccttctactgccagaaggatgtctgaggggctctccttcatctccagcgaaatgccatcttacctgtctagaaaaaccatcaaaaggcaggaggttgataagctaggaatatgacaggagattcaggaatcgtcttaccagtttgaagattggatgcatcaaaacgaccaggatgtgagctcctgcatgttaggctaaattatagatgttcggaaagaaatttggcagactatgacacctcgtagttggcagactatgacacctcgtagttgtgttaaattatgtatttttgctcgtataatctaaaacaggattatggatggattgtatgctatattattttgtctcgcatgtccatattatttttatatttttgttgctgtggcactgctc

SEQ ID NO: 111 - DNA, 1376 bp, Oryza sativa
gtatatagtcctaaccaacagtcaggaacagcaacaaaagtaagccaagaatctctctgcctcccaccaacaaccacacacactcacagctttggtcatggaggtcacccccaaccacacgcagaccgtctccggctgggccgccatggacgagtccggcaagatcgtgcccttcgtcttcaagagaagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcgtggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctagactcatgctactatcatattgctacctagtaccaacctccatgcctttcttaatttaatttattggaggctctgcacgcagaatgggacagttcgagctgtcgttttctcgttggccacgtgaagtaactgtacgcactttgtacttattcgagaaatgatcagtgataaatcatcaatggccttattttattctt

SEQ ID NO: 112 - DNA, 1853 bp, Arabidopsis thaliana
gtaacgtctctctctctctgtgactctctcaattagtttgaaccagtcaactcgtaaagcccttgtttcctgtaattttccgaattgggtcttcccttaatttatcatttctcgccggaaaaactttgagaatttccttgtatttcacggcgatgctataatcctcctgaaagcgacttactgatatatattagtttattaggcaatgaatgtgaaatttaccgagtcaaacgtgtttaaacaatgtaaaagtgttgcaggcgattgttttgtttatcttgttttgggtttggttgtcttggatgggaggaagtagctctaaagagtcacctagaggaggtggaagtggtcgtaggtatgaacgtagtgtgtctgggagctcatcttattcgtctgcttgggaccagagcagctattatcagacaccaaaccatccatctgcgtctcctgtttcatcctataattctgggagacaaacaccgaagaatcttgagaggaagtattcacggattgctgataactaccgttccattgatgaggttaccgctgctctttcacatgccggtttggagtcctcgaatctcattgttggtatagatgtcaccaagagcaacgagtggacaggggcgagatcatttggtaggaagagtctgcatttcattggaactactccaaacccttatcaacaagctatttccatcattggaaagactttatcggtttttgatgaggataatttgatcccctgttatggatttggagatgctacaactcatgatcaggatgtcttcagtttcaatcccaatgatacatattgtaacgggtttgaagaagttctcatgtgttacagagagattgttccccagcttcgtctctcaggtccgacatcttttgcacctatcatcgaaagggccatgacaattgtggaagaaagtggtggccagtaccatgttcttctcattatcgctgatggacaggtgacaagaagtgttgatacagataacggtggattcagtccacaagagcagcagactattgatgccattgttagagcaagtgaatatcctttgtctatagttcttgttggtgttggagatggtccctgggacaccatgagacagtttgatgacaacatccccgctcgtgcctttgacaatttccagtttgtgaatttcacggatataatgtcaaagaacattgatccagcaagaaaagaggcagaattcgcgctttctgccttgatggagatcccgtctcagtataaagccaccctcgaactaggcttacttggacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccagcaacagttttgccccgtatgtctagtgagtgcaaagaacatggctttcaattgtggtcatcagacttgcgctggatgtggggaagacctccatgtgtgtcccatttgccggagctcaatctcggttcgtatcaagctttattaagataagtctctcaagaactgaaggaacccgaggtggtctgagatctttcacagccaacaccatcccaacttagatctcatttaccagtgtcctaacatttgtttttactttgaggggaataaccggttcctctcaaaggttttgtagataatctgttgtcaattttgcattctcattgcacatgaaaaaaccacagcagactctctcgtgaataaaggatcctttctctgcggttacacatttttactt

SEQ ID NO: 113 - DNA, 766 bp, Triticum aestivum
ggacaccagcggtccgtcatcgtcttggctaccatatcctcccattctcattctgcacggcacagcacagcacagcacagcggagaagaggaaggagagagagatgactgcgtccgtctcctacgggctgcgagctcttccgacgtggtccagctctgtgtccggtgacgaccactgctcggcgctggccatgtcggtgtcggcgcgggggccccggtcgacgcggccccttcggacgccggcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgatcaccgagttctgtaagaccatcggcgctgaccccaagcagaggcagggcttgatccgcctcgccaagaagaacggagagaagctcggattccttgcttgacccgcctcacaatccccccttccttctcctaccttttctactagcaaaaaggaaattccttggagttggagattgcatgcatgcatgtatgtatactagtcttatataatttttttctctcttctcttctcttctcttctcttgtggagacagcactgagttcagttaaacttcagttccatgtggatagatggatggacagatgatgtatctatcctctactgatgacctcagcggtagagtatatatatgcgcaatgctactggataaataattcaagtatttgtctcatta

SEQ ID NO: 114 - DNA, 1288 bp, Arabidopsis thaliana
gctcaaccattccactacaaatagaggctaaagaactaagtagagtattcactcctctctcaaaaccctaactgtttccaagataatggcaaaaactgaagctcctagtttggtggggaagctagagacagaagtggagatcaaagcttcggctggacagtttcatcacatgtttgccgggaagccacaccatgtctccaaagcaagtccaggcaacattcagagctgtgatctgcacgaaggcgactggggcactgtcggctctatcgtcttctggaattacgttcacgatggggaggcaaaggtggcgaaggagagaatcgaggcggtggagccggagaagaacttgatcacgtttagggttatagaaggtgatctgatgaaagagtacaagagctttttgatcacgatccaggtgacccctaagcatggagggcctggaagtattgtgcattggcaccttgagtatgagaaaatcagcgacgaggtagctcatcccgaaactctcctccaattctgtgttgaggtctcccaagagatcgacgaacatctcttatccgaggaagaagaggtgaagacaacagagacacttgagacagaggtggagatcaaagcttccgctgagaagttccatcacatgttcgccgggaaaccacaccatgtctctaaagcaactccaggaaacattcagagctgtgatctgcacgaaggtgactggggcacagtcggctctatcgtcttctggaactacgttcatgatggggaggcaaaggtggcaaaggagaggattgaggcggtggatccagagaaaaacttgatcacgttcagggttatagaaggtgatctgatgaaagagtacaagagcttcgtaatcacaatccaagtgactcctaagcatggaggttcagggagtgtggtgcattggcacttcgagtatgagaaaataaacgaggaggtggctcatcctgagactctcctccagtttgccgtcgaagtctccaaagaaatcgacgaacatctcttggccgaggaatagaggagaatattcctcgtgtgactatctattatcctgtccgtacatgtatgtgtgattgaagcatgccgatttttatcactctttgaatgtggaaaaataaagagttgtgttggatatatgagagtcatgttgtatgtttttaaagtgctatactctaaatttgtatacgtataatgtgttttgtttgtttaataaagtgtaaaatgtttttttaataaaatcttaagcctcgtcttttctttttttttggct

SEQ ID NO: 115 - DNA, 1824 bp, Arabidopsis thaliana
tcttttttcctttgctctcattcccacacagagaggtacaacaagactcgtcgctcttcgctttttcttctctctttctttctcttgccagtagtgtgatcttacgaagcttttagtagagaaaaagcatatacgctttgtctttcttaatcgactgataagtccttaggatcagatggaacaaatgggtggctactcaaaacaacaaggtccatttttagtttgattaagggatttggatctgagcttacttcatcaactttgtcggaatatacatttgctttgtgtggatttggaagttgtccctgaatggcgtccgaggatttgaatattgttgcggaatcaaagaaaggggaagagaatgttattgttgataattccaaggacatgaatagacctgagaatcttgacttatctactgagaaaactgatactgccaatgagaatggtccaaaagatgaagcttctaagctggtaaaggaagcagacctccctgagtctggtacttcagtgaagagtaaaacagctaaggataataaacctgttaagagaaagtcagggacgttttctcggagcccgagattcatgtctcagagctcttcatttccaactaaaggagcttatactgatattactagaaagagcattgatgccacaacatcaaagactagtcttaaacccgtcgttgctggtggatccaaaccaaaagccactccatcttcaagcagcggtgtttccgcaaagcgcaccagtttagtatctgcgcctctcaaaaagcaaactatgcctgtgaaaaccatttctaaggatgcagcttcaggccctacttccaaattaggagatgaaggttctaaatccatcaaagaagaaactgcggggaaggatgtcgaggaggctggatcaaccaccgctgtggtggcagataaagtatctaacccgttgaaagctgaaatggcaagcaaggacgacgaagacactcgttcaactaccacttcaacttctacacctcgtgggcggagaagcagtgttggatcggcatctggattttcgttcaggttggaggaacgggctgaaaaacggaaggagttttatatgaaactagaagagaagatccatgcaaaggaagtagagaagaccaatttgcaggcgaaatcaaaggagagccaggaagaagagatcaaaaggttgaggaagagcttgacgttcaaggctggtcccatgcccagtttctacaaagaacccccacctaaggttgaattgaagaagataccaactactcgtcctaagtctccaaagctaggacgcagaaagagtagcagtgatgcaacaggaggtgaagccgctcctcgcgtgacaaaaccaaaagactcatcatcatctacagtgaagaaaccaataacaaagtctcagccaaagcttgaaactcaagagaaatcagtgaaggccaaagaaaagaaaaagaaagtgaagaaagaagaagcagagaagagaggagaagaagagaaggctactgccgtggctgcgaaacctgaagagcagaaaccaaactccaataacatccaagtgaaggctgagataatggcgagtgaggttgtagtgggaggctgaagcaaagagagcattcagcagcgatgtctaatgtctgcttctttttttctttcttaaagcattaatgtgaatagagttgttgcattgcgtctacttttttaagagtttatacttcattccttcagtttattttttggaaaattaagcctcgattgcttcttaagatggtctcaaatgtgttgaactcaaatatgtatcacgagcatagatatgtgt

SEQ ID NO: 116 - DNA, 599 bp, Arabidopsis thaliana
aattctttgtttcttagtaagacacgcacactcacacatgggaacaaaagaatctgtcttcttctctgttctattatttatacttacttggtaaaatatctttcttgtgcagaacagaagaaaaagaaacacccatggctctgttttctagcttctcagtttctgcgtttctcttgatcgttgtatcggttcaatggactctggtttgcagtgaatccacaatcttagcttctcctgctgttttaccgtatatcaatgcaccagatatgtcttcatttttcccttctccgaccaaagactggccaatagagacagcgacatctcctgttccagaaccagaagcgcctggtccaagctcaggccagcttaatgggaagatttcaggcagatcaatgcggctccatcctgatatttccttggttctagccattgttgggatctgtacctttctatgttttaatgaaccaatacttgttaggtttctacactattgatgttgtaatcttttgtggttcgcttttagagcctcattgttccttcttggagtctgttttactcttcatcacatgaacttcaacatatactacgttattactgtt

SEQ ID NO: 117 - DNA, 1244 bp, Sorghum bicolor
taaactagggtttaaccggggccacacgtcagcctccacgccgtggttttctccgcctttattcccccacctctccacccatccgccgcctcccaatcatccttccccaacctccctccatccccgcagcatctccacgccgtcacacctcgtcgcgtcgtcaccggcgagaagatggtcgggccgggcctctacgccgagatcggcaagaagaccaaggatctgctgtacaaggactaccagactgaccacaagttcaccctcactacctacacctccaatggcgtcgctgtcactgcttctagcacaaagaaagctgacctgatctttggtgagatccaatcacagataaagaacaagaacattaccgtagatgtgaaagcaaactcagagtcaaatatcattactacagttactgttgatgagattgcaacaccaggactgaaaaccatccttagctttgctgttcctgatcagaggtctggaaaggttgagcttcagtatttgcatgattatgctggagttaatgcaagcattggtctgacagccaatcctgtcgtcaacctctctgctgcctttggcactaaggctcttgcagttggtgcagatgtctcacttgatactgccactggaaacttaaccaaatacaattctggactgaggttcactcatgaagacctcatcgcatccctgagcctgaacaacaggggagacagtcttactggagcttactaccacaaggtgagcgaattgaccaacacagctgttggggcagagcttacccacagcttctcgaccaatgaaaacaccgtcacctttggcgggcagcacgctctggacccactaaccgtcttgaaggcccgcatcaacaactctggcaaggccagcgccctcatccagcacgagtggaggccaaagtctctggtcaccatctcggccgaggtcgacaccaagaccatcgagaagagctcgaaggtcgggatcgccgtggccctcaagccctgattggttataagaccattttttttccttctaagctcctagcatgactgtttgggtcagatcaggtcagctggggaaaacaaaaactgttggggttcccggcatcctttggtcgttgcagtctgttgatttcatgaactgcgtaatgcttcgttgaggaaatttttcggtcatctgtgtagcgctctgttaaatgagcaaccttcacaataattcaagctttagaattctgaacttgttta

SEQ ID NO: 118 - DNA, 1833 bp, Oryza sativa
tatagaatccggtctccgattccgatcccctttcgatcccccttggtcgatctactagggtttccgatccacgaatcaacccaccagagtcgcccggccatgccttgggtttatcatccgcaacttgaattgctggccgttccgcaacaacctgaatcgtgtcccatggctgcggcggttacgcagcctgaatcgccggccatggctggggttgatcgtctccgcttggacggtgccatgcccccctcgtatccctcctcctggtctgtgctgccgcgggaggtcgtggttgtcgacgagatcgacgacggggaggagctacgccggtggaacatcctgagatgcgatcgcagggccggctacggcgtctgcgaggcagtggtggagggcgtgaagctcggtgcgcgcatcgtctccgaccggggcttctccgccctgtgcatcatcgtgagcaaagccgcgcgggctgggacgagaggccaagtctgcgccgcggtgctggctatcaagaatcatgtcatcgtcctctccgtcgcctttcccagaggtgatttgttccactccctcaagtgtgcgtgttcatccttctacctggtctacgacgcctccgacgcgtccatcaccatgatccccgacctgcaattctcctttcaccaccacaaagtgtcttctgctgtcaccaaggaacctctcccaatcgcttgtggtgttgcacattacctcgtcctcctaggccgtgccatgacgattaaggggatggatcagcacatagaagatcgtgtctgcctgagtccgctgcagcagtcatctttggctcatccatcgccatcgtccagcaccaactgcagtctgtggatgaccaagtcggccatcttccccaaagaggtggtgacgagaggcttttctgcaaataagatgctctcgttcgatggcttggctatgtgggttgacttgcatcaaggaatcctcttctgccaacactacgacttgttctccaattccaatgacagtggctctgtgccgttctactttgttgatctgccaccgggctgttgtaatgatgacatcaccacccgcccgctttctgactcctatccaccagagatgtaccgttctatcgtgtgtgtcggagacagcatcaagttcgtcaccattgaaggctacctccgcgacagcactgcccctatcgaggatcggatggtgactatgtggagcctgagaccccaggaatcttggtcgtggaggaaagaccgtgacctcagcattggaggcatatgcgcgcagcttttcaagaagattcctatatgcgcaacgatgctggagccgatgccgaatatggcaccgcagagtcctatcctgagcacggaggatggcagcctccatctccttatcgtgaatgataacagcaatgaaatgctcgagaatcagaatattatggtcactgttgacatgtccaagggctacgtaatctccgcttgtttgctccctactgactttggcgatcagctgcctgggttgtatggtgtcatgctgccgcgtatgctgggctccaacttcttccggttctgattggcaaaaaaagaagcacatggaacggcaatgagaaaacacatgcaatttatctatattattagatgtaatcggatatttgtagttctcttcttatctttctctaagcactatgttagtggtggaaactttatctgcactgcaagctatcttagcactgatgatcggcatgcaatcttagtaaaatttcttgagatgagaatgtgccatgtttgtaaaagatggacctattaagaatcaccttatgtgacctcacctttcacc

SEQ ID NO: 119 - DNA, 1533 bp, Sorghum bicolor
tcaccatctaattcaacaaattcttcaacatcggagagaatagttgacctacaacaaaaggttggagattgtgaaattgacttaagcatgctaacaagggaggataagatagcatctggatcgtctgcagatttatatcgaggaacttataaaggccatgatgttgctataaagtgtctcagatctgcaaatctcagcaatccttcacaagttgagttcctgcaggaagtgcttattctaaggggtgttaaccatgaaaatattctgcaattttatggggcatgcactaagcatccaaactattgcattgtaacagaatacatgcctggagggaatatatatgactttcttcacaagcaaaataacttcttggaactccataaaattctaagatttgctatcgatatctcaaaaggaatggattatctgcaccagaataacattatacacagagatttgaagtctgcaaatcttctgctaggctatgatcaagttgtaaagatcgcagactttggtgtggcgcgacttggaagtcaggaggggcagatgactgctgaaactggaacataccgatggatggcaccagagataattaatcataagccatatgactacaaagcggatgtattcagctttgccattgttctttgggagctggcaacttcaaaggtcccatatgacaacatgacacccttgcaggctgcattaggagtaaggcagggactgcgcttggacattccagccagcgtgcacccaagattgaccaaactgattcgacagtgttgggatgaagatcctgatctgcgtccgacttttgcagagatcatgatagaactccaagatattctacactatattcaggcaccgaagggacccagtcgtcgttctagagcaaagatgcagaagaaatcagagggatgaaaaatacatatgcgtacccaaggcgaaggggtcccagttcgtttttttgggtggggtggggggttatacacaacttatagtacaagtggttttagcaatgggagcagatatttatgtggtgccgtgctggtgtacagatgtgtcagtataggctgtttgtgcttgggcatttgcagctgataaatcatcacgctggactgtattgtgcttgggcatttgcggccgataaatcatcatggtccacacgggaacgtagagtattttaaggatagagtagtagcctgagcacataccgaccttagctcagttggtagagcggaggactgtagtaattgcagatcaatccttaggtcgctggttcgaatccggcaggtcggaagttatttgaacaatttttatcctttttgtttctattgcttttttttttgtttcttttccatcatgcaaaccacaaatgtgtcgcacactgtatcatgttcctttttgtttcttttgcttttttatatttcttttccatcatgcaaaccacaaaatgtgttgcacactgtatcatattgttgttccttattgggccactcataataataataataattagtccatgttgtgtct

SEQ ID NO: 120 - DNA, 1743 bp, Arabidopsis thaliana
gtagggtcagtctaattactctctcagcgtttctctttttggtcctcaaatcttcaccttcaagatcttcttcgtccctcgatctccgatttcaaatctcgtttctccgttcaagcaacctctctgaattcctagtctcacagcaggaattagtactcggcgaagcgatttctgcttcgatctctacatctgaagttccgatctgacgaaatttagggttcgtctgggtcgaagttaaataggaaaaagatttcgaattggcttgagaatggcggaatctagtggaagttggagagattcttataaaggaatgtcgtctgataacatcaagggtttggttttagcgttgtcttctagtttgttcattggtgctagtttcattgttaagaagaaagggcttaagaaagctgcgagtactggtactagggcaggtgttggtgggtattcttatctctacgagcctctttggtggattggcatgacgacaatgttacttggtgaaattgccaatttcgctgcttatgcatttgcgcctgctatacttgtcactcctctaggtgctgtcagtatcattatcagtgctgtcttagctcatattatattacgggaaaaactacatatctttggaattcttggctgtgccttatgtgttgtgggttccacaacaattgtcttacatgcccctcaagaacgtgaaattgactctgtgattgaagtttggaatcttgcaactgaaccagcattcatgttctatgcgagtctggtaattggggctgctgtatttctcattatccgttttgtgccccaatatgggcaaacaaatgtaatggtttacattggtatttgttcgctcgtgggatcattatcggtaatgagtgtaaaagcacttggaatagcattaaagctgaccttttcaggaacaaatcagttattttatcctcaaacatggatattcaccttggtcgtacttacttgtgtggtaacccaactgaactacttaaacaaggctcttgatacattcaatacagctatagtatctcctatatactacgtgatgttcacatctctaactattttggctagtgtcatcatgtttaaggactgggatcggcaaaacggtactcaaattgttacagaaatatgtggatttgttacaatactttcaggcacttttcttctccacagaacaaaggacatggtcgagggttcgtcggtaatattaccgttgcggataagcaagcatataaatgaagaagaaggcattccactcagacgccaagaatctctccggtcaccttaaaagctttttcgctctgttttctggtccactgcgataactgcaaaccagagaatcaaccttttttccttatctcgacttattatgaacatggaccatggttctgtctaacacttacaaatggttcaagaagatcgaagaaggaaagaggagcagcgaggatgagatcatcttctccaatatcggtaaatatgctgtgagttcaagcacacgccattagcacacacccacgcctaaacccttggtgtgacagttaaaattttataaacaagagatgggttttgcctaaattggtcttacaagcatctataactaaaggtttcaattcaagatttgcattattttttattgaatcttctatttttcttccttagttggtttgaagctttaaaccctttgaaaaacaagaaatggagactttgaaagttgacgaaacacacatgttt

SEQ ID NO: 121 - DNA, 2872 bp, Arabidopsis thaliana
aaaacatcgaagattttgatccaacgtataccaagagtttcggagacgacgtcgttttgtctctgcgccgcgttcttagtctgagctcacgcttgttcgtttctcctctaacgtcaactgtgtttttgcatcctcaaagggtttaacatagttggggctaggaattttcatggtttctgttggttctaaatcattgccatctaggaggcacaggaccattgaggaagatagcttgatgggtgaacgaggaaagtctagtaacaatcacagtgaaaggaataagggaatgcgtaggaaggaccataagggtaaccgtggatttgatgtagatagcagcaagaagaaccaatccggtggtgcccccaatgtaaagccagcatcaaagaaacactccgaattcgaacatcagaatcaatttgtcaggaaagagattgatccagagacttcaaagtatttctctgagattgccaatctctttgatagtaatgaagttgaattagaggaacgttcagtaatatgtggaaatgcccttgaagaaacaagagggagggagtatgaaattgctacagactatatcataagtcatgtcttgcaaactctacttgagggatgtgaacttgaccaactctgcagtttcatacgaaattctgctagtgtgttcccagccattgcaatggatagatctggttctcatgtcgcagagtctgctctcaaatccttggccacacatctagaaaatccagacgcctattctgttattgaggaggctttgcattctatatgcaaggtgattgtggataatcctcttgatatgatgtgcaactgctatggttcgcatgtactacgaaggcttctttgtctttgcaaaggagtctctttagattcccctgagctttatggcgcaaaatcatcaaaagctctggccaaacgtttgaatctgaagatgtctcagctagatgacaataatttagaaatccctcatcaagggtttccaggtatgctcacgtaccttttatctgggctattaagttgtagcagagaggacatgaagtatcttcaagtcgatcagtatagcagtttggtcttacagacggctctcagactaatgctgaaacaagatgagcagttgcttgaaatcattccgcttattctgcgctgcaactctactaataaaaaagtagaagggtttcatatagagactaatgttgccaaagaaattttagagtcgatgaaggataattcattcagtcatctggtggaggttattttggaagtggcccctgaaagtttgtataacgaaatgttcaacaaagttttcaagaattctttatttgagctttcagttgatcggtgtgcaaattttgttattcaagcattaatctcccatgcaagagaccaagagcagatgggtattatgtgggaagaattagctccaagattcaaggatcttcttgagcaagggaagtcaggtgttgtggcttctctgatagcagttagccaaaggcttcaaagtcatgaaaataagtgttgtgaggcccttgttggtgcagtatgctccacaaatgaatcccgtatctccattcttccacggttgctgtttcttgattactactttggttgtcgagataagtctacatgggagtgggcacctggtgcaaagatgcatgtcatgggttgtttgatacttcaggggatttttaagttttctagtgatcatatacagccatacataacaagcttaacttctatgaaagctgagtatatcactgaaacggcaaaagattccagtggagcacgtgtcatcgaggcctttcttgcctcagatgctgctacaaaacagaaacgtagactaattataaaattacgtggacattttggcgagctctcattacacacgtctggttcatttacagttgagaagtgcttcgatgcatgtaatttgacactaagggaagccatagcatctgaactgttggatgtgaaagttgatctctcgaaaacaaagcaagggccttatctgcttaggaaacttgatatcgatggttatgccagcagacctgatcagtggaaatcaagacaagaagctaagcaatcaacatataacgaattttgctctgcatttgggtccaacaaatcaaattttccaaagaacacctttgtctctgacgcatctgaggatgcagctcaggaaatagaagtaaagaatacaaggaaagagattgaccatcatcctacttccgggtttaagcgtcaccgagaaaaacatgcaaaggataaggatgaaccttttgcaggtgaaaaaagatcgaaacagaagaagaataaaactagtgaagcaacagataaaccaaaactagctggcagcaaaagacctttcctttctggtgagatgactggaaagaatcggcattcaaataaaatgagaatttgaagggctggagccagtccttgggattcttcggaagctatctttttcacctcttagagactctcctttcatctcctggcttatcttcaaatctctcacacctttactagaagctaaatccatggaagctggcgccatctgacgacactctacattatacttgctgctaaacaaagctagaagtaacagacagagagctgctgagatcgatgccgatgtatggaatctcttcattgtgaaatttctttttgatctgttgtggtcttaggttgttgtgttccttgagactgctattgagaaaactttagggtagcgagcttatgtttgagttaaagagcgagaatctttgttgctttgtagattatattatcgattcatgaaactttttgggatctaatcacgtgatctagtttgactgctgtgccaataatttccttattgttt

SEQ ID NO: 122 - DNA, 1495 bp, Sorghum bicolor
ctgtgtctctgtggtttggtttcttggccatgcgtatataacaactcccagcacttccgatctcttcttatcgccccctccccctccctattcctcccctcgattctccgggttgatcccgtcgctgtctgggcctgttccattggaggagaatcgcccggctagaagaaaaggcttggaaaggaaggtaattatctgacatggatgagcacatgggaagacgaacagttggcggcctcctcttcaccaagggaggctcaattcttctcttcagagaagacggttcgcgccccaagtccaagaactgctgctcgcgccatggctgtagtggtcagcattctgctgacaaagccaaaggcaaggaggtgcacagggcggcggcgcccaatgaatcaacgccagccacccctgggagatcacagatttttcggaagcccaacagaaagcctccacatgaaagcagtgcttcaggcagcatcagcagggatgcaggaggctcttgtagcgaaaccggcaacaggtcaagagacactcctgggcccgggcgtgatctactggctaggcttaaggagagggtcaacacatcaaggaaacgatcgttgaacagggagaacagcccacagtcaccgagtggattcagtgctggttccccgagcaatagtcgatcggtctcaaggccgtcgcatcgggcagcttcgaggataagaaaagctgatgaaggtgcagcaaatgcaggagctgacggtgtgcgcagaaatggtgctggagatgctaggaggagttcagagaggagtgacgacgacttgctgctagttgagcaggtaacaagaaaccatgtgccttctgaagggtttctttctggattcatggcgagatacagaagcggccttcagggagacctttcatctctggacgacagcatggaggactcaaatggatacttgcgctttgatgtgggtggaatagaagagcttgagaactacttcatattcaatgatcggcatagaggaatgaggatggatatcgacggcatgtcctacgaagagctgcttgctttgggagagcgaattggtactgtaaacactggtctttcagacaatgcattgtccacgtgcctgaacaggagcctctacatgcccacagcttcaggttctcatgaagattgtgaaagaaaatgcagcatatgccaggaggagtatttagccggcgaggaggtgggaaagatggcatgtaagcactactaccacctttcctgcatacagcattggcttcggcagaagaactggtgtcctatctgcaaatctgttgccctgaaaatcaactagcaactcatttcatgtttgaaatgaagtgtatagattcttcatgtcctgtattccctccccacccctctccattttccttttgaaattcttttcccttcttttttttactcaaaacactcatttttattatcaatttaaatcggaaaaggaaaaattgtgttgtgtgggct

SEQ ID NO: 123 - DNA, 1629 bp, Oryza sativa
ggaggaaggcctagcccaatagacagaaaacaaggggcgtgcggacttgtcgtgttggtcgcgtcgcgtcctctcctgatccccttttccttcgcccgtttgacatccgcagaaaagaaaagggaaatcctccgatcgaaatcatcgaaccgtctcttctacatcgatcgaaaagagaagaggagcggcggcgagatccaattccaatcgatccttgtgctgctgctgctgctgcgctcgacgatcccatccggatctcgatggcggccatggctcgccatctccctgctattcttcttctctcgtcggcgctgctcctcgcccttgcctccgcctccgcttccgctgctgctccggcgctggccgccttcgtcgatgccgcgtcgcgccgctacctgcgggatcagcaacaccacgaccaggccgcttcaatgtcactagaccaagtttctgcggctgtttctgtcttgcttggttttgcaccaccaccctcgctacctgcacaatcttcttcaaagttagacaagctgttactccctaacccatttgacagaccacgggctgttttcttgctgcaaatcgatggattccatgcctccgttgaaagcatcacatctgaagctggtagcatcttcaaaaccactattgatggtctaagcgattctgctacagggcttacagataaggatgatctagttattgttcattcagatgaatctccagctgttgattcaggttctgagtattttgatagtgatctcactgacttggcaaactggcttggtgggtcctatgagaaggttgatggcaaattgatcattcccttggagagtggagaaagtcttactttgcttattacaaaggaagcagacatggaatttgcatccagcttgatctcccttcgtaaaactataaaaaggggtattcaggttcatgaagatttctcaggaggtgtcatgagccctgcagagttattagtatgccacttcaaaggcattaaggctttggaagaagaatatggttccacagaaattgttaagcagggaactgatgtagtccggacagctgtcaccaaagcatttgatttactacgtggagcatataatggaaaaattgttgggttagtaatatccacaaaggaggcttcaccatccttagtgggtccagcatcttcactgcacatttcgagatggctaaaagagacaagccaaactaacactacaatagcctcttctgagatacttgttagaaagagtttggcatggattacagggatcattcttcttgtctctactctcattggggtttgcttgcttatgaatatgccacttaccagggacaccctcctgtattcgaatgtgaagatcgattagatggaattaggagggagggagagagattagcacattgatggttgtaatttccattttcacacgctgcgtggcctttatgggatggttttgacctttttgtaggccatatatgtttgacataaaaattgtgcttctgtgtgggtcagcccggccggaatgcaaaaccttgtttgtgaattgtcactgcctgtacggggcccttgttttttggttataaataaataatccagaggagcctctgataattgttccataa

SEQ ID NO: 124 - DNA, 992 bp, Sorghum bicolor
aacaagcacctgcaactgcaactgcaactagccagctgcaagcaatcaccagtttgtcaaacagcagaggcgatcgtcgattggcccgccggcgcgccggcagctcgcaaagacgatggcggcggaggcagggaagacgacggcggcgacgaagagcggcggcggcgggcagatcatgacggtggtgcggggcctggacgtggcgcggtacatggggcggtggtacgagatcgcgtcgttcccgtccttcttccagccccgggacgggcgggacacgcgcgccacctaccggctgctggaggacggcgccacggtgcacgtcctcaacgagacgtggagcaaggggaagcgcgactacatcgagggcaccgcctacaaggccgacccgaacagcgacgaggccaagctcaaggtcaagttctacctcccgcccttcctccccgtcatccccgtcgtcggcgactactgggtgctctacgtcgacgacgactaccagtacgcgctcgtcggcgagccgcgccgcaagaacctctggattctgtgcaggaagacgagcatcgacgaggaggtgtacaaccagctggtggagcgggcaaaggaggaaggctacgacgtgagcaagctgcacaggacgccgcaggacgacccgccgccggagagcgacgccgcgcccactgacaccaagggagtatggtggttcaagtcgctctttgggaaatgatgactgtacacatcaccgcacgcgtactccggtgcttgctgatagtactagtagtatataatctgcgctgcacgcagcaaataaaatgagacctgaagaggattgatgtttagctgtagtatatacgttgtagtgtatatgtctctgtgtgtgtggactgtgacgttatagtgttttgataattaatgggattgaaatgtaatgtttgattttactattaattgcattggcgaggtagtcaatctgaggatcatcatgcatgtgaatttgc

SEQ ID NO: 125 - DNA, 1001 bp, Sorghum bicolor
cgcagtctctccgcaaggaagcggagcgaaacgcaagcgactgaaacgagagcagcgtgcgtttctctttggactttgggtcgggtgagctgccagcgagagcgcggcggggtgaggctttgccgagcgacatgagctaccggctcggggaagcggcgggccgcgaggagggcgacgaggagccgttcgagacggcgtcgtccgtgtccagcggcgactccgactccgacgacgaggaggagggggaccagttccccggcggcggcggcggcagcgtggccgggggcgaggcctcgtgcgaccaccaggaccgccgcgcgttcgtgccgcagccgctgcggaggatgaactcggacagcatctacgacatgacgtccatgatgtcgcagctcccggccaagaaagggctgtcgcggtactacgagggcaagtcgcagtcgttcgcgtgcatgtcggaggtgcgctgcctggaggacctgcgcaagaaggacaacccctacaagcagaagatcaagtcgtgcaagagctacgtcgcgctgggagggatgatggccaagaagcagcccgcctccacctcctgcgtcaacctcgacctcgtcgccgccaacggcttcaggacgccgcccattcggaacgggtaccaccagtaggcggcgctggacgggtcgccgcttgcgagagagcgctgcaatgcgactgcaggaacgccgttattgttcctcgagggtcactgaactgtttttcttttctctgtttctttctacttgttctgcgggtgattttcttcacgggcgcatttagtctgtgagaattttacgaggtggcgtgaactgttacttgttctgctgttggtagagtactagaggaacttaccgttgaccgttctgcactgttgctgctcggcaaaaaagaaactgttctttgggtactgtatgtaaatacgaagcgcggcagtccagggctccaggcagaaaatcatcgaccgtttccttcttttgtgc

SEQ ID NO: 126 - DNA, 2461 bp, Sorghum bicolor
aaaaaaaacttccttctttcggtgctcaagacgccccatctcccctctcgtcgtcttctctctcatcccatcctgtgccaaaacaaaacgaaaaaaaatactcttcctgcaagctgctagcctagagcgagaggggaaaaaaagaaaagaaaaggaaaagaaaggggggtaatctccggaaccatctagagacagcgagcggcgcgtggagcggagcggagcgagcaagcctactgcgccggtggtggtggtggcggcggcggccgcgtcctcacgaagcagaagcggttctgatccgcagctctcgattccggaaggagttggtcaagaactggggatcctgagttgaatatgatatcaaatccggtggactggtatagtttcggacccggatagaattcgcagggatgccagattggagggtgcgtgagtttgaaggtaaattcactgatgagtttgcccacagtaatggcaaggaacatgaaggtggagttgaggctccaggtgtcactagtagtaagaagttgaagcatgcagtcgccaatgagaaagcccaaggtcccatccccagaacgaatagctcagattcacagaaatgtaatttagaggacaaccaatgtgagaacgggatagtatcccagaatataaacagtgccgctgactgcataggagactgcaaaaatggttccaatgcctttctttcaagagaagaaaatacaatcgttgaaaccagatgtccaacagataactggaactcctgtcagtttgcactgagcaatggttcgtccattctcaataaccacagtgctccacaggatagcctcacttatggagataatgatctaaactacatcgattggcctggcattgataattttgaggatgtcgacacattattcaggtcatctgattccacatatggtcagcagcagctggagaatgcagatgggttatcttggattccttcttcagatgctgtttactcttctgatgttgctatgcagcaagggtttgactcgtcttattcagattatggtattttggatgatctctcagcattccattgtgcagaagataaatcactaccctcagttgatccttcatcagctttatgtgataatcaattcaatgatacctacctgttcagtgagcaaaagaatgtgaatgcatatggtgaacagatataccaagaggatgtgatggagttgttgcccactgaccagatatgcagtggacatgaaaacattgatatgttgcaggttggaaaccagtattcatctgaaaatgcaattcaaggtattgaagacaagaaattctctatagcgtcaacttctcagctgagctcctctcagaatttactgaatcaaaggcaccacttaaattccagttcaccaagcaacattacttctgagtcctatgcagaaaagtttggtccatctagcggttcttttgcacaaaggaattcaaaagcgcagaagaaaactttgaacatgcaaccaagacagccaacaaatgataatgacataaacagacatcctcaaacattgacaagaagagcttcttatccttgtgagaactatgaaactgaaagaaaaggattagggaaaagaactctgggggatcctcaagttacaatgggtacttcaatggtagtggatggctcatttgtatcatctgtgtcctctgataactcagttgaagaaagcagctttcgacaactgcaggatgctgttagtcagctggatgtgcaaaccaaattgtgcattagggatggtttataccgattggcacgaagtgcgcaacataggcaagtttttccaaatatgatgaacaacaatggagatagccaggatgtaaaggatttgcagaatgcagaaacttcacacaagttcgtcgatccccggagcatcgagacgcagacaaacccgatcgatcggtctatagctctgctacttttccaccagtcatcggaccaggcggctgtagctgtcgacgatgcctcgtcactaaaatcccctgctggtaacaaacagcacccgggccctgcctctaaccaaggcctgatgccagcttcatcggtgtattccccaggaggtcaggggacccccaaggatgtacagtccctggacaagtactgaatttgtggcgctgctctccatgacctggttaaagcgccatgatgtggagcgttcaacgtccgtgattttcaatgcaatatttttacagacgtatgggggggctttcacatgatgtttctaggcttatatgtaaaaacaagcatattgtgtacccagtagtctgtagtcggttccaatcacattggttttgacatatgcttgtatcctattgttagacggccgctgtgctccctagtgagtgttgactcacatttcttgtgtaatttaaaaagaaaaaattcttttcccctagctatataacctttgaactggtgcacaggagt

SEQ ID NO: 127 - DNA, 716 bp, Arabidopsis thaliana
ttggtccaatggttgataaaatgttcattaatgcttctacattaagaggtgtaggcttcgagtctcagctactgcgatttataaacagatttgtagattaatggaggcaagtgtgcacaattatagccgttcgccaggattctatgtagagaagatattgaaggtatccatcaagcgcatagagaagaagaaggagaatcgctatgtaacagctttctttagcacacttctcttcacctgccgaaacatcataggctacacattcagcaacagcaaagaagttgttgactatgttgctgacatatctcctttgctctgtctctccttcatcctcgacggattaacggcagttctaaatggagtggctaggggatgtgggtggcaacacattggagctttgatcaacgtggtggcttattatcttgtaggagctcctgttggagtttacttagctttcagtcgtgagtggaatggaaaaggactctggtgcggtgttatggttggatccgcggtgcaagccactttactggctatcgtcacagcctccatgaactggaaggaacaggctgagaaggcaaggaagagaataatctcaactaaaaatggattggtttaaataaaggttgttcctcagagctatctcaaagtatttggaagtcatgtgcaagaaaatatttaatgttattttaatatttttcgtaaaacttatatccagg

SEQ ID NO: 128 - DNA, 1087 bp, Gossypium hirsutum
tggtcccaaaataaagaaattgatacttcaaaaatagaaagattctaagcgtttttgttctgttaatccttttagggttttttgaactttttttttgttccttttttgccgtttttacagctttgattattcccttcttcttcctttaacctgaaattttttgttctattgactgtagtacgttcttaagttgtgaattccattggaaaatctatctgggttttccttaaaatataatttctattgaatatctatacataattttcctttatatatctgagcccaactagaagaaccatttgaagtattttttatcttttatttttaatctttggtgagtttttttttttttggctgttttaagcttttarggttttgcagcattttttttttaaaagtaggagatggtgagaggcaaaattcagatgaagcgaattgaaaatgcaacgagccggcaagtcaccttctctaagcgacgaaacgggttgttgaagaaggcttatgaactatatgttctatgcgatgctgaagtagctgtcatcatattttctcataaaggaaaactctacgagttctcaagttccgacaacatgcaaaacaccatagaacgataccgtcagtacaagaaagatgtccagagtaacatccctgaatttgacagatacacacagcaactaaggcttgaagcagaaaatatggccaagaagattgagttccttgaggtttctaaaaggagaatgttgggtcaaaatcttggttcttgttctatagatgaacttcaagaggttgaaaaccagcttgaacgcagcttaagaaacattagggcaagaaagggctatttattcaaggagcagatactgcaactaaaagctaaggaaagatatatgcaagaggagaatgccaagttatctgctaagaacaatggtacaacatgcagccagcagaacgcggaggtggagacagaactgttcctcgggttgcccgaaaaccgctgttcctagcaggtaggtctttggatatggaatgaaaatgatattccctattggaataatgcttgcttgtacgttatcgccattgctactggttg

SEQ ID NO: 129 - DNA, 1755 bp, Zea mays
ggccgcggcgcacgggcacgttctggacggccagcgcgcacatcatcacggccgtcatcggctcgggagtcctgtccctggcctgggccatcgcgcagctggggtgggtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtctcgcgggagctccgcgtggggcccctcgccctcagcgtgttccgcctcacgtggcggtcggcgttcgtgtgcgtcaccaccgtcgtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggcctggcctgggtttggacgtatgtgcatgatgcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgttcctttctaactcttcttcttcttcttctcctcttcttctttatttacatttttcttttatgtgttttcgtctaattaaggttctggttttgtagttctaccgtgcaactcattgtaccggaaaagaatatatgaacaggaaatcccatatgatctttgccatcttt

SEQ ID NO: 130 - DNA, 1682 bp, Oryza sativa
cacgcgattcccccatctctccgacagcgagcttcgtcgtcggctgtgcgcggccgcggcggcggcgctggtcgtgtgcttcccaaattctctcattccccagcgagcgatcaccatggggctccacaaggaggcgagctcgtcgtcgtcgcggctcgacgcggcgccgctgctgccgcaccacggccacggcggcggcggcgcggggcaccacctgtcgtcgcagcccaagacgttcgccaacgtgttcatcgcggtggtcgggtcgggcgtgctggggctcccctacaccttctcccgcaccggctgggtggccgggtcggtcctcctcctcgccgtggccgcgctcaccttccactgcatgatgctgctcgtcgcctgccgccgccgcctcgcctacgaccaccccaagatcgcctccttcggggatctgggcgccgccgtgtgcggccccgcggggcggcacgtcgttgacgccatgctcgtgctcagccaggccagcttctgcgtcggctacctcatcttcatctccaacaccatggcgcacctttacccggttggggattcgtcgccctcgtcgccgctcctcaccgccaaggcgatcttcatctgggtcatgctgccgttccagctggggcttaactccatcaagacgctgacgctcctcgcgccgctcagcatcttcgccgacgtcgtcgatctcggcgccatgggcgtcgtcctcggccaggacgtgtccacctggctcgccaacaagccccccgtgttcgcctccgccggacccacggagatcctctacggcctcggcgtcgccgtctatgccttcgagggcatcggcatggtcctcccgctggaggccgaggccgccgacaagcgcaagttcggcggcacgctcgcgctgtccatggcgttcatcgccgtcatgtacgggctgttcggcgccatgggttacctcgcgttcggcgcggccacgcgggacatcatcaccaccaacctcggcaccgggtggctgtccgtcaccgtgcagctgggtctctgcatcaacctcttcttcaccatgccggtgatgatgaacccggtctacgaggtcgccgagcggctgctctgccgcaagcgctacgcctggtggctgcgctggctcctcgtcatggtcgtcgggctcatggccatgctcgtgcccaacttcgccgacttcctctccctcgtcgggagcagcgtctgcgtcctgctcgggttcgtgctgccggcggcgttccacctcaaggtgttcggcgctgaggtcgggtggcccgggctcgccggcgacgtcgccgtcatcgtcgtcgggaccgcgcttgcggtgtccgggacatggacatcgctcgcacaaatcttcagttcttccgatgtgtaagcggttgacagtaatgcagacaatgcgcaggcaacgcagctagtagctcatgtgtatacattgaatttagcagaaaagaacattcagctggcatgctgattttgggcacggttcacgtggttcaaattgaatactacataatactcctacttctatttccattgcctgacaattgacatgcgtcaagttagggaactcagtaaaatccatatggttttggtcagatatagattagcagatcacgaccagatatacgagatgttcttttgaaaaaaaaatcctttttata

SEQ ID NO: 131 - DNA, 1398 bp, Gossypium hirsutum
aaatcttctcccaagcaatagcaaacaaccagctaagtcaacatatatcataatgaaagggattcgctccattcttattgcttttggcctatttgcttttgcttgctcatcggcctcagcatatgaccccagtcctctccaggacttttgtgtagctatcaaggacatcaagaatggcgtgtttgtaaatggtaaattttgcaaagacccaaagcttgcagttgcagaagatttcttcttttcaggcctaaacaggccgaggaacacatcaaatccagatggatcaaatgtcactatgatcaatgtagatataataccaggacttaacactcttggtttaactctggttcgagtcgactatgcaccttatggtgtcaaccctcctcacactcaccctcggggatccgagatcctacttgttgtcgaaggcacactttatgccggcttcgttacggcggacccagacaaccgtctcttcactaaaatcctaaaccctggagatgcttttgttttcccctttggtttgattcatttccagttcaacataggaaaaactgcggcggttgcctttgctgttctcagcagccaaaatgctgggcgtatcaccatagctgacgcagtgtttggctcaaacccaccgatcaacccagatgttttggccaaggcgttccagttgaacaagaatgtggttaagtatcttcagtctcggttctaatgggattaacaactactttaagagycaaatcaaaaccccaaaagtttgtttgcttgtttgaaacaatgtttgcatgcacttttctaaaycaagtcatactattctgctaagtatcatgtaataaacagagaggtttaaatttacttctccagtctcctctcttgacattatcctttcagatataagaccagaatttgtagtgctctcggatttaaattacgaccacaatcaagggcaccaatgcatatgtagttcatgttgttattgttgtatttatgtcatgctagccctacttgcttgtattccttgttagttggacttgaatgcaaatgttggaatttcttcctttttttggggcccccaaatttcatttcagggggaattttggaaaaatcccttcacctggggggccccccaaaaatgctttaaagggcccaatttcccccaaaagggggccaaataaaatttcaggggccgcctttttaaaacctcgggaggggaaaaccccggggtttcccaaattaaaccccttggaaaaaaacccccttgccccccacaattcccctttccaaaaatttgcccccccaaaagggaaaaggaacccccccttaaccgcccttaaccccaaggggacccccaaattttgccagcccctaagctaaaagcttaaaatggggggcccc

SEQ ID NO: 132 - DNA, 1325 bp, Gossypium hirsutum
atcagttcaatatttcctggtaaacaggaaggcattgcagtaggaaggacttttgctgctcttaagaattataaagtggatggtaacaaggaaatgatggctattgggctgatgaacatggttggctcctccacttcttgctacattacaactggcgccttctctcgatcagcggttaatcacaatgcaggagcgaaaagtgcagtgtctaacatagtaatgtcgattacggttatggtgacccttctctttctcatgcctttattccagtacaccccaaacgtggtgttgggagctatcattgtgtcagctgtagttggccttatagacattccagcagcctgtcaaatttggaagatcgacaaattcgatttcattgtgatgttgtgtgctttcttcggkgttattttcatctcggtccaagatggtcttgccatggcagttgggatgtctattttcaagatcctccagcaaattactaggccaaaaacagtgatgttggggaacattcccgggacagatattttccgggatcttcaccactacaaagaatcgatgaagatcccgggtttccttatcctaagcattgaagctcctatcaacttcgctaactccacatatctgaatgagaggatcttgagatggattgaagaatatgaagccgaagatcataagaagcagtcaagccttcaatttgtggttttagtgatgtcagcggtgagtaccatagacacgagtggcgtatcaatctttaaagaactgaagaaaacagtggaaaagaaaggagctgagcttgtgttggtgaatcctttgggagaggtgatggaaaaattgcaaaaatcagatgaagcaggagatttcatgagaccagattgcttgttcttgacagtaggggaagctgttgcgacacttacagcaacaatcaaaagccaggtctccaatcatgtagtatgaacaaaaccaaaaatataactccacaaaagctatcatgttgtggtgttttacaatgagaatatcaaaagtatttcatattattaaaaaatatatatatcaagccgtttggttttccacatattttctccccgttcactatcttcctacttcccctcttgtcttactactgcaaaacataaattcaatgaccttgcaattggttttgcattccaataaaacataagataaaatgttatacattccctagacttttaggtttttttttttttaagtatcacattggctgcctccctcgctacactcgcgaattgcgttcttcgaatgttttcttcgatcttctgtgatggatctcttctctattcttctaattg

SEQ ID NO: 133 - DNA, 1207 bp, Triticum aestivum
ccacgcgtcmgcagcagtttatcttagcaaactactagctaggagacatcgaattaagatggccaaggttaacgccggcgccgccctgttgtctctgtgcctgttgctggcctgttctgccggaggcacacaggccgcctacgtggacgtggagggcaccgtgaggacagaagtagagaaggccatcaagagcaaccccggcatcggtgccgccctcgtccgtctggtgttccacgactgctgggttaatggttgcgatggatcggtgctcttggacaagacgacatccggtggcaataccgagaagaaggcgatcaacaatatcggcctggacggcttcaacctgatcgacaccatcaagtacaaactgggcaacagcgtctcgtgcgctgacatcgtcgtcttcgccgcgcgtgacgcggccagatacctgagcggcggcaaaatcacctactccgttccctcagggcgcaaggacggcatcgtctcgtctgccgctgccgcagacgccatcctcccgcaatccaccttcgagttccaacagctcgtggacaacttcgccaagaagaacttcacccaggaggagctcgtcatcctctccggcgcgcactccatcggcgtctcccacctctcgtccttccaggaccgcctcaacgattcaaccgcgaccccgatcgacgacaactacaagcaggctcttgtcgcagacgtcgaggcccagaagaagagccaaaatacgccggatccgattgagaagaacaacatccgcgacatgagctcgagcttccagaccaccgccgggtacgaccccacaggtgtgaacaccgcggcaaagggcgctctggacaacagctactaccacgccaacctccagaacagggtgctcttcaagtccgactgggttatgcgcacggacagcaaagccggggacgacatggccgagtacatgaacaatgccaccaagtggaacaacgacttcgccgctgccatggtcaagctcagcaagctgccggccgagggtagtactcgttacgagataaggaagaactgcagagtcaccaaccagaactactattactagaagcaacggcatcacctacaggctacaggtgccatggatgcaatgatttgtattttgaaggctctgttccatccctaatttgtataaccacaatactcactgcaaaataaaacgacaataaaagaa

SEQ ID NO: 134 - DNA, 2768 bp, Sorghum bicolor
tatttttcagcttgatagctcctgtgttcatgttatagtagtatattatgccagtttttatatcttgttttatttacagtggtttccttttgcatctgtactcatcctcctaattgtggtgatatgcgttgcagaaacaccctggtagcacaggaatcaatgagaagcaaagtggaaaaccaccattaccaattaatgcagtagcagagcttcgaaaaggttcttactatgcttcgttggaacttgttcaggctttatgtgatacatcttatggcctggtagatatatttcctattgaggatcgtaagattgccctccgggagtctcttacagagatcaatagtcagattgcttctgccgaaaaaaatggaggagtatgctttccgatgggaaagggcatatatcgagtggttcatatacctgaagatgagtctgttcttctgaattctagggagaaagctccttaccttatatgtgttgaagttttaaaagcagaagctcctagccactctaaaggatcatccgatgggcacaaattatcaaaaggtgggataccattggctaatggagatgtgcaactaccaaaaccaccaccatgggcttatcctttgtggagcaggcacgacacacaaaactatgaaacagacagaatgctgaagtctacttctcaggttattgaccaagcaatggctcaactctgggagacaaaagtaaaatttgtaaatgttagtttctctattgagaaacttggtcgctcaaggagcattgcactttctgaaacggggcgtaggctgcgacatgatgctatagattctcatgagccacctggagattcgcaaacagttgctgatcagcctattgaatgggtgaaggttacattgtctgcagttccaggagttaacatggaagatgtagatgataatgaaccaacacgaaagaaggaccatcgccgcattcctagtacaattgccattgaggaagtaaaggctgcagcattaaaaggagaagctccacctggtcttcctctaaaaggagttgggcagagcacccaaaatttagatcctaaggctactgatggtggggatccaaaaccaaccgatgctttggctggtgagctttgggctgtcaaacgagagagaattcgacggtcttcggttcatggaaaatcacctggctgggacttgcgctctattattgtcaagagtggtgatgactgccgtcaagaacacttggccgtacagcttgttgcacatttctatgacatatatcaagaagctggtttaccactatggctgcggccttatgaagtgattgttacttctgcttatacagcactaattgagactatccctgatacggcatcaatccattccgtcaaaagtaggtttcccaatatttcaagtctccgagactactatgtagccaagtatgaagagaattctccaaatttcaaacttgcacagagaaactttgttgaaagtatggctggatattcaattctgtgctacctacttcaggtgaaagatcgccacaatgggaatcttctaatagatgaggaaggacatattattcatattgattttggtttcatactatctaactctcctggaggggtaaacttcgagagtgcaccatttaaactaacaagggaactccttgaagtgatggattctgatgcagagggaactcccagcgagttctttgattacttcaaggtcctatgcattcaaggtttcctgacttgtcggaagcatgcagagcgtattatacttcttgtggaaatgttgcaggattctggctttccatgtttcaaaggtggccctcgcactatacagaacttgaggaagaggttccacttgagtctaactgaagagcaatgcgtatccctggtgctctcactgatcagtagcagcatggatgcttggcgcactcggcaatatgattactaccagagagtattgaatggaattttatgattttccccacaagagtcacggattcattcagaaaccaaacttcttgtatccttggagcaaaccatgggattgcataggtcagtttggggctgatctatactgggtaattgagcactgtgttttcatgtggcattgcacatttttggtcaactagggaaacagattggtgcctgcattctactttcatgtgatcccccctctgacagagttaagtgtacagtcatcggcagttatctagttagtgctttgtgctaggaggttgcgactagtggagctctatttggcatattggaatttggaacccgagctgcattgttgtacagacctttggttgacgtagcttggacaggatgtaggagaggactgggccatactttgaagcaaacaagtgtaaattataggcatatgggagctggggataatccgaggacaagaacagatatgccgttcgaagtgtcactgtactgatgtcctgtggtatccctatagcgccaaagtagatggagatgtgctttgctgcatttgtaaattaccaatactgtacagggaccatactataggagctttccgttttttagttgttaagatattaattccttttgttgtggctgtctggcctacgaagatctaggtgatagcttgttcactagcagtatgatcagtgtttggtattttttgctattttttcctgtggccctagcaaattgcaatgtggatacaaaaaatacatttccttgtgtcatgaagaaaaacactgcaatatttttagtacattttgctgtaccatgagag

SEQ ID NO: 135 - DNA, 737 bp, Hordeum vulgare
gctgcaggaattcggcacgaggagcgagtgagcgagtgttgcacaaacaacatgtctgcctgtgtcatggcatctttggctctgaaaccatcttcctctcctctgttacaacgatccaagcttggaggcgtgcgaccatcggcgaggccgtcgttggtcatagtggccaagaaggcgaagaaggtccagactgcccaaccctacgggcctggtggtggagtggcgttcaaggaaggcgtcgatgcgtctggaagggtagccaaggggaagggtgtttaccagtttgccgacaagtatggagcaaatgttgatgggtacagccctatatacacaccagaagagtggtctccaagtggcgacgtttatgttggaggaaagacggggctgtttctctgggcagtgactcttgctggaattctgctgggcggtgctcttcttgtctacagtactagcgccttggcttcctgaagcctatgtgcagcaaaccaagctatgcaccaaacgatgtgtataatagtgcggattataaccgtcaggacatatgtaatggatacaaatatcactacccgcaaatcagtaaatatccttaattaattactaatgttctaagcaacatgctgcaagcgtgattaagttttcagtgctaagctctctcacaattgttatcaacttctacaattggaattccttttttaaagaggaggcaatcatcatwagagttgaacagactttaattc

SEQ ID NO: 136 - DNA, 1616 bp, Gossypium hirsutum
tamaaacacaacataacacaagccttgccttgtttcttctctttygtctgctaaaagcctcctctcctgttacacacatacacacacagtgagaggtaggtttgcagttggcaaaagcttatgggaaagaagcttgctgcatttcttggacgaggcttcaagccttccaagttcaaatcactagtcactcttgccatttctcgtcttgctgttttcaagaaccagcrtcagattcgctgcaaccaagctcgttccgatgttgtacagctccttcaactttcccatcatgatcgggctcttcttagagttgaccaggtgatcaaggagcaaaacatgttggacgtctttgttatacttgaagggtattgtaatctcgttattgaacgactccatctcattgagcaggacagagtgtgccctgacgagctcaaggaggctatawccggcttgctctttgcatcttcaaggtgtggggattttcccgagcttctagagattcgtgcygtttttacatctcactacggcaaagaattcgctgctcgtgcaatcgagctgcgcaacaattgtggagtgaacgctaagattatacagaagctgtcaaccagacaaccagacttgcagagcagaaggaatgtgctcaaccagattgctgccgagtacggcattgctttacaactcgaggaaaccactgattccagcgagggaaatctggatgtaagcaagaagcaggagacatcagttaaggcaagtcatgatgcaggagatgatgatgagttctctgattcaataaaaacaaggagaaaatacagggatgtagcygatgcagskcaagcagcctttgagtcagctgcctatgcagcagcagctgcaagagcagctgtggaactctctcggtctgattcctatgatcctgatgatcagaacggtcccaatactcgacagaacacagtgtttgacaaacaagaagcaaattctaaagatatggaaaatcatggtagtcaagcagtggagttgaatcataccaagaaggcaccagaaatcaagatgtctagtccttcaagtgaaggatcagcagagggaatcatagaccttaggacaatgtcattcgacgaagtggacccactcaagctattggagaaggaagtggttatttatgagagtgatgatgataaatatgattcccgtggttcaagttttgatttgaatgcaaggaagcttaaaggcaaggtcctagatacagataatgatggtgagcactcagaaaagaaacttgactgatgtttccttcaagctttcctgttggcttgaaggtggagactcgacctgaaaacccactgcacacatggatgaaaggtaaatgacactttaccataaataaggtgctgttttcctcgaggacttggaccaagtgacaggatattgaggagcgcgaataaattaaatgtttgtaagttccatggagttgcaaatatagctttggttgagtgtataagttggttttggtctttgatatttcttttgttattttttatcagatgtaaacttaatgtagaatattttggaatgattctttttgtgaagcctaattattttgttatactataccaagttccttt

SEQ ID NO: 137 - DNA, 2442 bp, Sorghum bicolor
gtctattctccatggcaatcgtcatcgtcgtcttctccaatccaatcggcgctcactccgccggccggccggccggagcccctctataaatactagcctagggtggcccgaaccggccggccggctcgacgcacgcatcctccgcctgccgcacccgccaccgcaacaagaggttcgaaatactccgatggctccgcctgcacggccgccgcgtgttggggaggacatggaggagggcacaggcgagagctccccacctcctcggtcaccacgtgcgttcaaccccgacctccacgaggtgcagaggaagatctgcgagcgcctccgccagacggcgcggcatgaccgtacgctcgcagaccccaccttcaacgcccgcttcgcccgccacctcgagaggttgccgcggaggtacctcctcgacctcgacctcgaagacaaggtggacgatgtcctgctgcactggaggatcctcgacgagtgcgccgaccccaacaagcgacccgtctttcacgcgcggttcctaaagtataagacagttcccatggaggatgacggcattggccatagtcaaggtcaagaggagccgtatcaaaagttgttggaggagctcagtttggaaagaagaaagactgtggacagaaatgattccatgtctatctcctctaagaggacgagttaaaaactgtcctccttcatgagatcattttctcctccatcgacaggcccaagctcctaagccggctaactgcgttgctctctgaggttgggctgaatatccaggaagctcatgtttactccacaaaggatggtttttgtttggacgtttttgttgttgatggctggaagacggaggagactgatgacctgatcgcggcgattaaggagacattaacacaaaagaatgcttcaccatctaattcaacaaattcttcaacatcggagagaatagttgacctacaacaaaaggttggagattgtgaaattgacttaagcatgctaacaagggaggataagatagcatctggatcgtctgcagatttatatcgaggaacttataaaggccatgatgttgctataaagtgtctcagatctgcaaatctcagcaatccttcacaagttgagttcctgcaggaagtgcttattctaaggggtgttaaccatgaaaatattctgcaattttatggggcatgcactaagcatccaaactattgcattgtaacagaatacatgcctggagggaatatatatgactttcttcacaagcaaaataacttcttggaactccataaaattctaagatttgctatcgatatctcaaaaggaatggattatctgcaccagaataacattatacacagagatttgaagtctgcaaatcttctgctaggctatgatcaagttgtaaagatcgcagactttggtgtggcgcgacttggaagtcaggaggggcagatgactgctgaaactggaacataccgatggatggcaccagagataattaatcataagccatatgactacaaagcggatgtattcagctttgccattgttctttgggagctggcaacttcaaaggtcccatatgacaacatgacacccttgcaggctgcattaggagtaaggcagggactgcgcttggacattccagccagcgtgcacccaagattgaccaaactgattcgacagtgttgggatgaagatcctgatctgcgtccgacttttgcagagatcatgatagaactccaagatattctacactatattcaggcaccgaagggacccagtcgtcgttctagagcaaagatgcagaagaaatcagagggatgaaaaatacatatgcgtacccaaggcgaaggggtcccagttcgtttttttgggtggggtggggggttatacacaacttatagtacaagtggttttagcaatgggagcagatatttatgtggtgccgtgctggtgtacagatgtgtcagtataggctgtttgtgcttgggcatttgcagctgataaatcatcacgctggactgtattgtgcttgggcatttgcggccgataaatcatcatggtccacacgggaacgtagagtattttaaggatagagtagtagcctgagcacataccgaccttagctcagttggtagagcggaggactgtagtaattgcagatcaatccttaggtcgctggttcgaatccggcaggtcggaagttatttgaacaatttttatcctttttgtttctattgcttttttttttgtttcttttccatcatgcaaaccacaaatgtgtcgcacactgtatcatgttcctttttgtttcttttgcttttttatatttcttttccatcatgcaaaccacaaaatgtgttgcacactgtatcatattgttgttccttattgggccactcataataataataataattagtccatgttgtgtct

SEQ ID NO: 138 - protein, 356 aa, Gossypium hirsutum
MDGYCSRRVIMFLVFAFAAISRGYGQESTTLVPAIITFGDSVVDVGNNDYLPTIFKANYPPYGRDFANKKPTGRFCNGKLATDITAETLGFTTYPPAYLSPEASGKNLLLGANFASAGSGYDDKAAMVNHAITLTQQLEYFKEYQAKLAKVAGSTKSASITKDALYVLSAGSGDFLQNYYVNPLLNHAYTPDQYGSFLIDTFTNFVKNLYGLGARKIGVTSLPPLGCVPLARALFGYHEKGCISRFNTDAQQFNKKLNAAAANLQKQHPGLKIVVFDIFKALYDIVKSPSNYGFVEATKGCCGTGTVETTAFLCNPKAPGTCSNASQYVFWDSVHPSQAANQVLADALIVQGIALI

SEQ ID NO: 139 - protein, 223 aa, Gossypium hirsutum
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 140 - protein, 645 aa, Gossypium hirsutum
MEASSSTSHDPALFHAPLLYHPRRRSSRPLKGFAVIIGSVVFLLSLVTLIVNQSPEPLASNPSSVTEAGSYSMAAQPRGIAEGVSAKSNPSLFDKVGFNWTNAMFYWQRTAYHFQPQKNWMNDPDGPLYHKGWYHLFYQYNPDSAIWGNITWGHAVSTDLIHWFYLPLAMVPDQWYDINGCWTGSATLLPDGRIVMLYTGSTNDSVQVQNLAYPANLSDPLLLQWLKYPGNPVVVPPTGIEDEEFRDPTTAWLGPDGSWRIVVGTRFNTTIGTALVFQTTNFSDYELLDGVLHAVPGTGMWECVDFYPVAINGSVGLDTTALGPGIKHVLKASLDDTKVDHYAIGTYDMITDKWTPDNPEEDVGIGLKVDYGRYYASKTFFDQSKQRRILYGWVNETDSEADDLEKGWASIQTIPRSVLYDNKTGTHLLQWPVEEVESLRLNATVFKDVVVEAGSVVPLDIGTATQLDILAEFEIETLVSNSTEDEVSDCGDGAVDRNTYGPFGVLVIADDSLSELTPIYFRPLNISDGSLETYFCADETRSSKAPNVTKRVYGGKVPVLDDENYNMRVLVDHSVVESFGEGGRTVITSRVYPTEAIYGAARLFLFNNASGVNVKATLKIWEMNSAFIRPFPFEETLFQEMVAST

SEQ ID NO: 141 - protein, 310 aa, Gossypium hirsutum
MDVTSTPNRKEMDRIKGPWSPEEDDLLQQLVQKHGPRNWSLISKSIPGRSGKSCRLRWCNQLSPQVEHRAFTPEEDETIIRAHARFGNKWATIARLLNGRTDNAIKNHWNSTLKRKCLPVGEECNFVANGGYDGNLGGEERQPLKRSVSAGLYMSPGSPSGSDVSDSSVPVLSSSYVYKPIPRTGGVNVDVNVTPAGVEAASSSNDPPTSLSLSLPGVESCEVVSTQPITESTQNRSEERGGGVMGFSAEFMAVMQEMIRVEVRNYMTQMQQQQQQQNGAVPGGAGMGMCLDGGFRNLMAVNRVGVSKIE

SEQ ID NO: 142 - protein, 593 aa, Gossypium hirsutum
MGGPPYDCLANPLGAVRLAFEKAIGSELETPSTHPSAFNGKDWGALELFRHFLFQESGLSQVPILNPKTLRWVQPNSLVRYRGMIQDMLGNEFYAGAYKDGNLWRTNKFMDVSQYPMGSSPDMCIWERRLLYCVPVPGQNSWTEPSSEMEPNWSSQTREKRRRMDDEDDDPMDLVPDDEIKSSPITKKMREDGLPSPSQSMDAKTTSSSSITSTFQSVDKDNLPCLVKIYDSPESELKLNDVFEFIGVLTFDSELAVEKDDNDELSNSFYDDALVHLPPNKVPRLHCLIHRKLAVQDFLPGSPIIEPKPHLVKETREALFRHLTAVLGNDEVAAHFVLLHLLSKVHARVDDVAVGKLSLNLTGLNKESVSVFGTRLSDTFKNLLPFTNCMPLTLEYLNIASLAPKKDYQANRLVPGVLQLPEGSHLMVDETRLESGSLNSTGIENTKLLKNLIEFQKVEYDFQYYKVEMATDVQLLIFSEGKSNIVPADVIVPFQPSCLESTEMPVAEALEAWRWYLATVRSLPHSIGSEIQKVVEDDLVAARQMDRSLGSRDFSRWLTMARLISSSFGETSLSKEHWEMAKEMERLRRERLK

SEQ ID NO: 143 - protein, 628 aa, Gossypium hirsutum
MSTGVQHQERVPMNLKKQLALAVRNIQWSYAIFWSISTRQPGVLEWGEGYYNGDIKTRKTVQSVELNTDQLSLQRSEQLRQLYESLSAGESSPQAKRPSAALSPEDLTDTEWYYLVCMSFVFNIGQGLPGRTLSSGQPVWLCNAHCADSKVFGRSLLAKSASIQTAVCFPFSGGVVELGVTDLVFEDLSLIQRVKTLLLDDPQPIVSKRSIQVDGMNNDLACPALDPLILATKLSPILGCEQLETVSPDDSPDGLEPKQSREDSLLIEGINGGASQVQSWQFMDEEFSNCVHHSLNSSDCISQTIADHRKVVPLCRGENDNGLQDVEECNQTKLTSFDRQNDDRHFHEVLSALFKSSHPLILGPQFRNSNKESSFIRWQKNGLVKPQKERDETPQKLLKKILFLVPHMHDRGLIESPETNAVRDAAWRPEADEICGNHVLSERKRREKINERLMMLKSLVPANNKADKVSILDVTIEYLQTLERRVAELESCRKSEARTKIERTSDNYGNNKTNNGKKSSLSKRKAYDVVDEADQEIGYVASKDGSTDKVTLSMNNKELLIEFKCPWREGILLEVMDALSILNLDCHSVQSSTTEGILSLTIKSKYKGSSVAKAGPIEQALQRIASKC

SEQ ID NO: 144 - protein, 180 aa, Gossypium hirsutum
MELSIQKIEALIRLSTIVMLVLTACLIGLDSQTKVIFYVQKKASFKDLRALVGLLYITSLAAAYNLLQLCCSSFSASYKGTSLQSYAYLAWLRYILDQAVVYAVFAGNLAALEHSFLVLTGEENFQWLKWCNKYTRFCTQIGGSLLCGFVASLLMFSIASISAFNLFRLYSPTKFMHLKL

SEQ ID NO: 145 - protein, 123 aa, Gossypium hirsutum
MASSGVLKLVSMILMVCMTMMSAPKAAKAAITCSDVVNHLIPCLSYVQNGGTPAAACCSGVKALYGEVQTSPDRQNVCKCIKSAVNGIPYTSNNLNLAAGLPAKCGLQLPYSISPSTDCNKVQ

SEQ ID NO: 146 - protein, 468 aa, Gossypium hirsutum
MASLPFIFFLSFFIISTTLTSAGAAAATIKLSLSPFPHPSSSHPYQILNNLVTSSVARAHHLKHPKAKADNTTSSLLRAPLFSHSYGGYTISLKFGTPPQTLPFVMDTGSSLSWFPCTSRYLCSQCAFPNVDPAKIPTFAPKLSSSSKLVGCRNPKCSWLFGPDVESRCQDCEPTSENCTQTCPPYIIQYGLGSTAGLLLVENLAFPQKTFQDFLVGCSILSNRQPAGIAGFGRSAESIPSQLGLKKFSYCLVSRRFDDTGVSSNMLLETGSGSGDAKTPGLSYTPFYRNQVASNPVFKEFYYVTLRKILVGDKHVKVPYSYLVPGSDGNGGTIVDSGSTFTFMERPVFEVVSKEFEKQMGNYRRVREIENRSGLAPCFNTSGYTSIEIPELSFQFKGGAKMALPLVNYFSFDGDDKVVCLMIVSDNVVGQGSHSGPAIILGSFQQQNYYIEFDIANNRFGWAERSCA

SEQ ID NO: 147 - protein, 451 aa, Gossypium hirsutum
MAGVEAGKEEEATAVRITGKSHVKPGKLIGRKECQLVTFDLPYLAFYYNQKLLFYKNDGGGEFEDKVEKLKGGLRVVLEEFYQLGGKLGKDDDGVLRVDYDDDMDGVEVVEAVAEGITVDELTGDDGTSSFKELIPFNGVLNLEGLHRPLLSIQLTKLKDGVAMGCAFNHAILDGTSTWHFMSSWAQICNGTSSSVVVPPFLDRTTARNTRVKLDLSPVVSCNGDDATKQGQPAPQMREKLFRFSEAAVDKIKSRVNSTPPPSDGSKPFSTFQSLAVHIWRHVSQARNLKPEDYTVFTVFADCRKRVDPPMPDSYFGNLIQAIFTATAAGLLLENPPSFGASVIQKAIESHDAKAIDERNKAWEAAPKIFQFKDAGVNCVAVGSSPRFKVYEVDFGWGKPVGVRSGSNNRFDGMVYLYQGKSGGRSIDVEITMEAQAMEKLEKDKEFLMEV

SEQ ID NO: 148 - protein, 335 aa, Gossypium hirsutum
MKVLSPILACLALAVVVSHAALSPEQYWSYKLPNTPMPKAVKEILHPELMEEKSTSVNVGGGGVNVNTGKGKPGGDTHVNVGGKGVGVNTGKPGGGTHVNVGDPFNYLYAASETQIHEDPNVALFFLEKDMHPGATMSLHFTENTEKSAFLPYQTAQKIPFSSDKLPEIFNKFSVKPGSLKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 149 - protein, 302 aa, Gossypium hirsutum
MERQRSKQVCLLMWVLVAAFFSHNRVIAVTSTGLGEQKNYYPAPDPHAGTPPSGSHGTPPSSGGGSPPSHGTPSHGGGYHPSPTPSTPSGGNCGTPPHDPSTPSTPSHTPPHGTPPSSGGGSPPSYGGGSPPSYGGGSPPSYGGGSPPSYGGGSPPSYGGGSPPTTPIDPGTPSIPSPPFFPAPTPPIGGTCDFWRSHPTLIWGLLGWWGTVGNAFGVTNAPGLGTSMSLPQALSNTRTDGLGALYREGTASFLNSMVNNRFPFSTKQVRETFVAALGSNSAAAAQARLFKLANEGHLKPRT

SEQ ID NO: 150 - protein, 196 aa, Gossypium hirsutum
MMERGFIVLALTVVFAATVVTAADESGLANECSKDFQSVMTCLSFAQGKAASPSKECCNSVAGIKENKPKCLCYILQQTQTSGAQNLKSLGVQEDKLFQLPSACQLKNASVSDCPKLLGLSPSSPDAAIFTNSSSKATTPSTSTTTATPSSAADKTDSKSSGIKLGPHFVGSTAALLVATAAVFFLVFPAGFASIV

SEQ ID NO: 151 - protein, 628 aa, Gossypium hirsutum
MPVVDFVCVFLVSVVMFNLRVSTEPVEDKQALLAFISGIRHADRVKWNSSTSACDWFGVQCDANRSFVYTLRLPGAALIGSIPPNTIGRLNRLRVLSLRANRLSGEIPADFYNLTQLRSLYLQGNEFTGPFPPSVTRLTRLTRLDLSSNNFTGPIPLGVNNLTQLTRLFLQNNKFSGSLPSIDSDGLNDFNVSNNNLKGSIPDSLSKFPESSFAGNIGLCGGPLRPCNPFPPSPSPTEPIPPKTSGQSSKSLPTGAIIAIAVGSAIVALLLLLFLIICFRKWKRKSPRRQKAIPSTTHAVPVEEAGTSSSKDDITGGSTEIERMMNNKLMFFKGGVYSFDLEDLMRASAEMLGKGSTGTSYRVVLAVGTTVAVKRLKDVAVSKREFVMKMGMLGKIMHENVVPLRAFYYSDEEKLLVYDYMHGGSLFALLHGSRSSARTPLEWDPRMKIALGVARGLAHLHSSQNMVHGNIKSSNILLRPDHEACISEFGLNSLFNTNTPPSRIAGYQAPEVIQTHKVTVKSDVYSFGVLLLELLTGRAPIQPSITEEGFDLPRWVQSVVREEWAAEVFDAELMAYHDIEEEMVQALQIAMVCVSTVPDQRPVMSEVVRMIGDMIDRGGTNDGTAAAI

SEQ ID NO: 152 - protein, 508 aa, Gossypium hirsutum
MQILPFRGGALVCFIASLLFVASFCNADAKTVEVVGAGECADCAENNLEISQAFSGLRVSIDCKPENGKNFKTRGSGELDKQGNFKVFVPEDLVENGELKEECYAQLHSVSAAPCPAHDGLESAKLVLKSRSDGKHEFGLKGKLRFSPLTCASAFFWPHFKFPPLPKWNHPPLPKFPLPPFKGFHHHYPIIPPIYKKPLPPPSPVYKPPPVPVNPPVPIYKPPPVPVYKPPPVPVKPLPPPVPIYKPPPVEKPHPPPVPVYKPPPVPVYKKPCPPPVPVYKSPPVPVYKKPHPPPVPVYKKPHPPPVPVYKKPCPPPVPVYKSPPVPEPHPPPVPVYKKPHPPPVPVYKKPCPPPVPVYKSPPVPEPHPPPVPVHKPPPVPVYKKRVPPPVPIYKPPPVPVYNKPLPPPVPVYTKPLPPPVPTYKPKPLPPIPYKPLPPLPKIPPFPKKPCPPLPKLPPLPKIPPKYFHHHPPLPKLPPLPKIPPKYFHHHPKFGKWPPLPPFAPHHP

SEQ ID NO: 153 - protein, 198 aa, Gossypium hirsutum
MVRGKIQMKRIENATSRQVTFSKRRNGLLKKAYELYVLCDAEVAVIIFSHKGKLYEFSSSDNMQNTIERYRQYKKDVQSNIPEFDRYTQQLRLEAENMAKKIEFLEVSKRRMLGQNLGSCSIDELQEVENQLERSLRNIRARKGYLFKEQILQLKAKERYMQEENAKLSAKNNGTTCSQQNAEVETELFLGLPENRCS

SEQ ID NO: 154 - protein, 536 aa, Hordeum vulgare
MDRLVAAGILAFLLIASVGSHAARAPGQYWESALPNTPMPSSLSQLLDTQAGGTSVNVGSGGVHVDAGHGMPGGTTVDVGKGGVGVNVKPGSAKPGGTTVGVGKGGVGVNVKPGYGKPGGTTVGVGKGGVDVNVKPGSAKPSGTGTTVGVGKGGVDVNVKPGSGKPSGTGTTVGVGKGGVDVNVKPGYGKPGGSGTTVGVGKGGVGVNVRPGGGTTVGVGKGGVGVNVKPGYGKPAGGTGTTVGVGKGGVGVNVKPGYGKPGGTTVGVGKGGVGVNVRPGYGKPGGKPRGKPVHVNVSPFIYNYAATETQLHDDPSAALFFLEKDLHAGKKMSVHFMATPGAGGKFLPRSEADAIPFSSEKAPEILSRFSVAPDSAEAAEMKQTLRECEAAAGKGEKKSCATSLESMVDFATSSLGTSHVRAVSTVVGNGKEGSPEQEYTMTGVKRAAGADQLVACHAEPYAYAVFACHLTQATRAYTVSMVGRDGTAVEAVAVCHADTAGWNPGHVAFQVLKVKPGGAPVCHFLPQDHVVWTRRG

SEQ ID NO: 155 - protein, 490 aa, Oryza sativa
MDPATVGGGGGEPEAAAEWRARAVGGMEYGWYRAVPGGTGTTLLALRLARGAEAAVAAATVQAALRAILDAHPVLRARLRGSASGSPTLAFPSAAAPPPPPLALELLPVPESATDFPSLLEHELNRNPWTAAAATATASEHEPDAPPVLFATLYELPPPAGGGSALFVRIHTAACDRAASASLVRELLAQLAGDGAAAAAASEPEDAAVRASLEERIPQRDSWKPFWARGLDMVGYSINGLRTSTLPFEVTGTERSTQMLRLGFDRDETTRLLDACKQNGVKLCAAMAAATLLAARQSKLQLASNQQETYSIATLINCRKFLEPALDDHNVGFYHSAITNTHAIHGGEELWELAKRCQDSYTNAKNNKKHLTDIADLNFLMCRAIENPQLTTGSALRTAVVSVFEEPVVYDLSDLQSKAGVEEFVCCATVHGVGPSIGLFDSIRDGQLEFACMYPCPLHSRKQMQEILNKVKQILHEGSIGDDESFEDCT

SEQ ID NO: 156 - protein, 429 aa, Oryza sativa
MDRLLACLLGFLLIASVGSHAARTPEQYWKSALPNSPIPSSLSQLLSTAGGGTSVNVGGGGVHVDAGHGKPGGTTVDVGKGGVGVNVKPGYGKPGGTTVGVGKGGVGVNVKPGYGKPGGTSVGVGKGGVGVNVQPGYGKPGGTTVGVGKGGVGVNVQPGYGKPGGTTVGVGKGGVGVNVKPRGKPVHVNVAPFIYNYAATETQLHDDPNVALFFLEKDLHPGKTMAVHFTATTAGEKFLPRSEADAMPFSSEKVPEILSRFSVKPGSVEAAEMAQTLRDCEAPPAQGERKACATSLESMVDFATSSLGTSHVRAASTVVGKEGSPEQEYTVTAVKRAAAGGDQDQLVACHAEPYAYAVFACHLTRATRAYAVSMAGRDGTGVEAVAVCHADTAGWNPKHVAFQVLKVKPGTVPVCHFLPQDHVVWTRSG

SEQ ID NO: 157 - protein, 477 aa, Zea mays
MASHNGTKHLAPMEVSVEAGNGGGAEWLDDDGRPRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 158 - protein, 135 aa, Arabidopsis thaliana
MDKFWTFLTALHSGAGPIVMLLYPLYASVIAMESTTKVDDEQWLAYWIIYSFLSLTELILQSLIEWIPIWYTVKLVFVAWLVLPQFQGAAFIYNRVVREQFKKHGVLRSTHSKPTKPNILHSIFPHREGHEAHSH

SEQ ID NO: 159 - protein, 175 aa, Solanum lycopersicum
MAGEATRVMVAVNESTIKGYPHASISSKGAFEWTLNKIVRSNTSGFKLLFLHVQVPDEDGFEDMDSIFASPDDFKGMKNRNKIRGLHLVEYFVNRCHEIGVPCEAWIKKGDPKEVICHEVKRVQPDLLVVGCRGLGPFQRVFVGTVSEFCLKHAECPVVTIKRSAAETPQDPIDD

SEQ ID NO: 160 - protein, 274 aa, Solanum lycopersicum
MDWEKQQQQPPVSAPQQTAEELNGTVSGGMFVKVMTDEQMEVLRKQIAVYATICEQLVDLHKSMASQHDLAGARLGNLYCDPLVTSAGHKITGRQRWTPTPMQLQILERIFEQGNGTPTKQKIKEITSELSQHGQISETNVYNWFQNRRARSKRKQQVAATNNTESEVETEVESPNEKKTKPEDLQSSHMPTSMAEDLGYENPDVSSGMHSLDPRTSKPEPMFPSDGSSKPAASYGQMSFYGMSNPRMDQLMGKMEVPGSYHPYIHADDYNMTG

SEQ ID NO: 161 - protein, 425 aa, Solanum lycopersicum
MGFKKDEASSSSHVLSIPREDTPLLGKIQHLSSPSKTFANVFIAIVGAGVLGLPYTFKRTGWVMGSIMLFSVAFLTYYCMMLLVYSRRKIESHIKAAKISSFGDLGFAVCGPVGRLSVDLMIILSQAGFCVSYLIFVANTLAYLFNYSIAKPDPKILGLSPKAAYIWGCFPFQLGLNSIPTLTLLAPLSIFADIAELGAMGVVMVEDVMIYLQNRPVLEMFGGFNVFFYGLGVAVYAFEGIGMVLPLESQTRDKDKFGKILGLAMGFISLLFGAFGVLGYFAFGEDTKDIITTNLGQGLLSTFVQLGLCINLFFSFPLMMNPVYEVMERRFWEGRYCVWLRWLVVLAVTFVALAVPNFADFLSLVGSSVCIVLGFVLPSLFHLIAFKDELRWYGFASDAALIVMGTIFAVYGTSSSLMEIFAKKA

SEQ ID NO: 162 - protein, 425 aa, Oryza sativa
MGLHKEASSSSSRLDAAPLLPHHGHGGGGAGHHLSSQPKTFANVFIAVVGSGVLGLPYTFSRTGWVAGSVLLLAVAALTFHCMMLLVACRRRLAYDHPKIASFGDLGAAVCGPAGRHVVDAMLVLSQASFCVGYLIFISNTMAHLYPVGDSSPSSPLLTAKAIFIWVMLPFQLGLNSIKTLTLLAPLSIFADVVDLGAMGVVLGQDVSTWLANKPPVFASAGPTEILYGLGVAVYAFEGIGMVLPLEAEAADKRKFGGTLALSMAFIAVMYGLFGAMGYLAFGAATRDIITTNLGTGWLSVTVQLGLCINLFFTMPVMMNPVYEVAERLLCRKRYAWWLRWLLVMVVGLMAMLVPNFADFLSLVGSSVCVLLGFVLPAAFHLKVFGAEVGWPGLAGDVAVIVVGTALAVSGTWTSLAQIFSSSDV

SEQ ID NO: 163 - protein, 220 aa, Gossypium hirsutum
MKGIRSILIAFGLFAFACSSASAYDPSPLQDFCVAIKDIKNGVFVNGKFCKDPKLAVAEDFFFSGLNRPRNTSNPDGSNVTMINVDIIPGLNTLGLTLVRVDYAPYGVNPPHTHPRGSEILLVVEGTLYAGFVTADPDNRLFTKILNPGDAFVFPFGLIHFQFNIGKTAAVAFAVLSSQNAGRITIADAVFGSNPPINPDVLAKAFQLNKNVVKYLQSRF

SEQ ID NO: 164 - protein, 379 aa, Oryza sativa
MIMLWLPAAVSLLLSSSLHVAGDAGGGVASLSVRRYDAIFSFGDSLADTGNNPVVFDWYSIFDPVTRPPYGSTFFGRPTGRNCDGRLVLDFVAERLGLPLVPPFLAYNGSFRHGANFAVGAATALDSSFFHGAGDPPGASPFPLNTSLSVQLSWFDSLKPSLCSTTQECKDFFGRSLFFVGEFGINDYHSSFGRRSMQEIRSFVPDIIRTISMAVEKLIGDGATTVVVPGMIPSGCSPPVLVTFADAGAAEYDASTGCLREPNEVATLHNSLLLDAVEELREKHPDVAIMHTDLFRHVSEMVQNPDKFGFQKDVLSVCCGGPGKYHYNTRIICGDEGATTCVDPSKSLYWDGVHLTEAAYHYIADDWLHAITLSARATS

SEQ ID NO: 165 - protein, 482 aa, Arabidopsis thaliana
MGDYNMNEFAYGNLYDDDDGDVGGSSKEGNNSIQKVSMLPLVFLIFYEVSGGPFGAEGSVNAAGPLLALLGFVIFPFIWCIPEALITAEMSTMFPINGGFVVWVSSALGTFWGFQVGWMKWLCGVIDNALYPVLFLDYLKSAVPALATGLPRVASILILTLLLTYLNYRGLTIVGWTAVFMGVFSMLPFAVMSLVSIPQLEPSRWLVMDLGNVNWNLYLNTLLWNLNYWDSVSTLAGEVANPKKTLPKALCYGVIFVALSNFLPLLSGTGAIPLDRELWTDGYLAEVAKAIGGGWLQLWVQAAAATSNMGMFLAEMSSDSFQLLGMAELGILPEIFAQRSRYGTPLLGILFSASGVLLLSGLSFQEIIAAENLLYCGGMILEFIAFVRLRKKHPAASRPYKIPVGTVGSILICVPPIVLICLVIVLSTIKVALVSFVMVVIGFLMKPCLNHMDGKKWVKFSVCSDLAEFQKENLDCEESLLR

SEQ ID NO: 166 - protein, 67 aa, Oryza sativa
MSDQSSYPNPAQGYYQGPPASAAAGQDNTAAGGGKSNAAKKDQPSFMDNLLACLPCARPAEAKNDAS

SEQ ID NO: 167 - protein, 191 aa, Oryza sativa
MRKEIVIRLQSSEKGHKKAIKVAAAVSGVESVTLAGEDKNLLLVIGFGVDSNDLTEKLRRKVGHAEVVELRTVDADELMRVAAANQYPYRYYPGAPPPAPYYGNGGYPPPHQRGGGGGGSGGGYYTPMTMATGGYYGGGGGGYPQYGQSSSYPQYGQSSSYYPPAAAATTNTHTVVHHQYANNDPDSCAIM

SEQ ID NO: 168 - protein, 78 aa, Oryza sativa
MSCGGSCNCGSCGCGGGCGKMYPDLAEKITTTTTTATTVLGVAPEKGHSEGVGKAAESGEAAHGCSCGSSCRCNPCNC

SEQ ID NO: 169 - protein, 108 aa, Oryza sativa
MAMAGESRRRRRAAAEAVAWCLALGVVALLLVGSVEKEEEVVVVRGARLAAARPCEEIYVVEEGETLHSISDRCGDPYILEQNPHVHDPDDVFPGLVIKITPRPGRRN

SEQ ID NO: 170 - protein, 614 aa, Oryza sativa
MAPAAVAAAEAGSKAAAVAGKAVAACERDAEKLEFIEEMTRGFDAVQERVLAAILARNNGAEYLRRHGMEGRTDREAFKARVPVVTYEDLRPEIERIANGDRSNIISSHPITEFLTSSGTSAGERKLMPTIEDELDRRQMLYSLLMPVMNLYVPGLDKGKGLYFLFIKSETKTPGGLPARPVLTSYYKSDHFKHRPFDPYNVYTSPTAAILCTDAFQSMYAQMLCGLVARAEVLRVGAVFASGLLRAIRFLQLHWRELAHDIRTGTLSAKVTEPSIRDAVAEVLAAPDAELAAFVEAECGKDKWEGIITRMWPNTKYLDVIVTGAMAQYIPTLKFYSGGLPMACTMYASSECYFGLNLRPMCDPSEVSYTIMPNMGYFELMPHDPDAPPLPRDAPPPRLVDLADAEVGREYELVITTYAGLCRYRVGDILQVTGFHNAAPQFRFVRRKNVLLSIDSDKTDEAELQAAVERASALLSPYGASIVEYTSQADATTIPGHYVVYWELMVREGGAWPPPAEEEGRGVFERCCLEMEEALNAVYRQGRNGEAIGPLEIRVVRAGTFEEVMDYAISRGASINQYKAPRCVSFGPIIELLNSRVISKHFSPACPKYSPHKK

SEQ ID NO: 171 - protein, 410 aa, Zea mays
MARMISRPAVLLSPLAMIVVAAAVMALAPAPVAATKYNITKILAPYKEYSKFNDMLSKTRLAYDINRRQTITVLAVDNSAMSALDHYSLQTIRHILELHVLVDYYGDKKLKKLAHGSTASSSMFQATGSASGMSGYVNITRKDGKVSFMTEDADDTAKPSRYVKSVKEFPYDIAVLQVSSIISSAEAEAPVPPPAPVDLEELLSKRYCKSFASLLSANAEVFRAVNETKDNGLTLFCPVDSAVAAFAATYKNLTAKAKAAILLYHAVPDYFSLQLLKSNNGMVTTLATASDKKMDYSYDVKNKGETVTLQTRVVTSSVTATVGDMEPLAVYAVNKFLQPKELFKVVEAPAPAPEPSKKKKAGRGGSDDDSSDDSGDSTADAEKGDAAPALLVRWLVTAVATAGVAYALMG

SEQ ID NO: 172 - protein, 432 aa, Oryza sativa
MTGAVSKLAAPRPAAAAPLPPASVRSAFLASAPSPRRFSVSIAAGRARSPIIAMASAKEGNGAPTKRTTLHDLYDLQGQSPWYDNLCRPVTDLLPLIGSGVRGVTSNPSIFQKAISTSNAYDDQFKQLILAGKDAESAYWELVIKDIQDACKLFEPIYDQTDGADGYVSVEVSPRLANDTQGTVEAAKWLHKVVDRPNVYIKIPATAECVPSIKEVIANGISVNVTLIFSIARYEAVIDAYIDGLEASGLSDLSRVTSVASFFVSRVDTLIDKMLEKIGTPEALALRGKAAVAQAKLANQLYQKKFSGPRWEALVKKGAKKQRLLWASTSVKNPAYPDTLYVDPLIGPDTVSTMPDQALLAFIDHGTVSRTIDANVSDAEGVYSALEKLGIDWDEVGKQLELEGVDSFKKAFDSLLGSLEEKGNSLKKTVSL

SEQ ID NO: 173 - protein, 319 aa, Oryza sativa
MAYSRQIFVCSAMAALLFSAVVSAQLSTDFYDETCPDALDIIESAVRDAVSKESRMGASLLRLHFHDCFVNGCDGSVLLDDTAAITGEKNAKPNKNSLRGFEVVDDIKSQLEDACEQVVSCADILAVAARDSVVALGGPTWDVELGRRDGTTASLDAANNDLPPPTSDLADLIKSFSDKGLTASDMIALSGAHTIGQARCTNFRGRLYNETNLDATLATSLKPSCPNPTGGDDNTAPLDPATSYVFDNFYYRNLLRNKGLLHSDQQLFSGGSADAQTTAYATDMAGFFDDFRGAMVKMGGIGVVTGSGGQVRVNCRKVN

SEQ ID NO: 174 - protein, 530 aa, Oryza sativa
MAGEVAIDSGEKRLNELGYKQELRREMTLFKTLAISFSTMTLFTGITPLYGSSLRYTGPASLVWGWVVVSFFTWFVGFAMAEICSSFPTTGSLYFWAAHLAGPVWGPLASWCCAWLEAIGLIAGIGTQAFAGSQVLQSIILLCTGTNKGGGYLTPRWLFLLMYIGLTFIWAVLNTFALEVIAFLDLISMWWQVIGGTVIVIVLPLVAKTTQPASYVFTHFETAPEATGIRSSAYATILSLLVSQYSLYGYDAAAHLTEETKGADKNGPIAILSSIGIITVFGWAYILALTFSIQDFSYLFDPSNETAGTFVPAQILFDAFHGRYGSSAGAIALLFVIWGSFFFGGLSITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKV

SEQ ID NO: 175 - protein, 119 aa, Populus trichocarpa
MATPMKYICLFMFLAILSIAGLNQVDGAGECGKNTTPDMEAFKMAPCASAAQDENSSVSSQCCARVKKIGQNPACLCAVMLSNTAKSSGIKPEIAMTIPKRCNIADRPVGYKCGAYTLP

SEQ ID NO: 176 - protein, 246 aa, Glycine max
MAKIALGSTREATQPDCIQALIVEFIATFLFVFVGVGSSMVVDKLGGDALVGLFAVAVAHALVVAVMISAAHISGGHLNPAVTLGLLAGGHITIFRSMLYWIDQLVAAATASYLLYYLSGGQATPVHTLASGVGYGQGVVWEIVLTFSLLFTVYATMVDPKKGALAGLGPTLVGFVVGANILAGGAYSAASMNPARSFGPALVAGNWTDHWVYWVGPLIGGGLAGYIYETFFIDRSHVPLPRDEEN

SEQ ID NO: 177 - protein, 330 aa, Oryza sativa
MGGSEYDDDWELPSADITVVLCGKLGCGKSATGNSIVGREAFVSEYSHASVTSTCQLASTALKDGRTLNVIDTPGLFEMTITSEDAGKEIVKCMSMAKDGIHAVLMVFSATSRFTREDSSTIETIKEFFGEKIVDHMILVFTYGDLVGENKLKSMLNNAPEYLQKTVELCKNRVVLFDNMTKDRWLQEKQLENLLDVVDSVNTNNGGKPFSDQMLACIKEAHAREQEVHDAIGYTEEQISELKKEIQRTRDEQLANITNMVEEKLNITVDKLQQQLMEEQNARLEAERLAAEARLRSDEEIRKLKKRLEKAQQENEEFRKMASQHKCSIL

SEQ ID NO: 178 - protein, 187 aa, Populus trichocarpa
MKSSYTFFILFSLFSFANVIGARKDTGEYWRAVMKDQPMPEAIHGLIRETTLSSVSNEKADCHTTESNEKNNFVKDFGPQPTVTSYDNGIKPAKDKSFSKDFHPNTQLFLYNDGVVKGERSFAEDVEPRPNVSVYHDDATLKGEKSFPEDFEPGPNVSVYDDGVGLKGKKSFSDEFEPRPSVTAYSN

SEQ ID NO: 179 - protein, 151 aa, Populus trichocarpa
MALHGKIETTLELKSSAEKFYKVWRSQSFHVPKHASKHIQGVDIHAGDWETVGSIRIWQYTIGGKAGVFKEEVSFDDENKIITLNGLEGDVMKIYKVYRPIWQLTPKGSGCLAKLTIEYEKLRPEVPVPEIYVDFMVHMTKDIDESLSTEE

SEQ ID NO: 180 - protein, 222 aa, Solanum lycopersicum
MGQQKALIYAFVGRGNVILAEYTDFSGNFNSIAYQCLQKLPASNNKFTYNCDGHTFNYLVDNGFTYCVVAEESVGRQIPIAFLERIKDDFMSKYGSGKAATAPPNSLNKEFGPKLKEHMQYCAEHPEEISKLAKVKAQVSEVKGVMMENIEKVLDRGEKIELLVDKTENLHHQAQDFRNTGTQIRRKMWLQNMKIKLIVLGILIALILIIVLSVCKGFNCGK

SEQ ID NO: 181 - protein, 355 aa, Solanum lycopersicum
MEANSNSAVPLCTPYKLGRFKLTHRIVFPALTRNRSQNNTPQPHLTEYYSQRATNGGLIISEAAAASDISKECPNLPGIWNEEQVEAWKPVVNGVHEKGGVFFCQIWHSGRLSVPTVSALFFSIGIGWSTRPDDKVYAKPTPLPLESDKIPCIVNDFRIAARNAIKAGFDGIEINASSGGYLIDEFMNDQVHGWTDEYDESIKDRCRLALEIVEAVANEIGADKIGIKLSPFDGKKDSNSEALATYMANELSKLGVLYLHVMEPRETVNRSLLPIRKAFKGTLIASGGYGKSDGEKAIDENYADLISFGRMFLANPDLPKRFEVNAPLNKYNRSTFYTNDPIIGYTDYPFLEVAS

SEQ ID NO: 182 - protein, 273 aa, Glycine max
MGSVPLASAAALARRLEGKVALITGGASGIGECTARLFSKHGAKVVIADIQDELGHSICKDLDSSSATYIHCDVTKEENIEHAVNTTVSKYGKLDIMHSSAGIVGAWNPSILHNKKSHFEQVISVNLVGTFLGIKHAARVMIPSGRGSIVAMASICGRIGGVASHAYTSSKHGIVGLVRNTAVELGTLGIRVNSVSPYAVPTPMSKTFLNTDDEGIAALYSNLKGTVLKPQDVAEAVLYLGSDESKYVSGHDLVVDGGFTVVNPGLCVFGQSV

SEQ ID NO: 183 - protein, 171 aa, Oryza sativa
MLRAGGRRLLAPGLRRVLGGGAAAPVAVGGAKAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 184 - protein, 575 aa, Vitis vinifera
MDNSVAPMVITDDGLQETAISSKTNPSKGRWRAAIFIIFVEMAERFAYYGVAGNLFTYLTNVLGEHTATAAKNVNTWVGVSAIFPLLGGFIADSYLGRFKTIIASSVIYLAGLLLMTLSVSVQSLRHHRAVFFTALYILSIGEGGHKPCVQTFAADQFDEDTVEEKKDKSSFFNWWYVGIVVGSTTAILVVIYVQDNVGWGLGFGMLAAAVAAALLLFLIGIRSYRRQRPVGSPLTRVMQVLVATARKLRVNETRYGRGVCLEDEGDDGVEEGGRRGRSLAPTNQFRFLDKATIIDDIDASTKVRNHWRLCPATQVEEVKLLFSLFPIWLSCLTFATVIAQMSTYFTKQGSTLERSIGSHFSIPPASLQVCTGLTILVSVGLYDRVLVPVARKFTGLPSGITMLQRIGTGIFFSMLTMVVAALVETKRISVAIDHGLTDSPRTTLPMKIWWLLPQYMLTGMCDVFTIVGMQELFYDQMPEEMRSIGAALYISTVGVGSLMSSAAISIVQAITSRAGGKWLGDNLNRAHLNYFYSVLAGCSALNLIVYIWVAKRFVYKKTGYDDPKGEQKKAAELA

SEQ ID NO: 185 - protein, 343 aa, Zea mays
MWESVALTLAGTAGNNIGKVLQKKGTLILPPLSLKLKVVKAYASNQLWISGFLMDMCGAALMLTALSQAPVSVVQPIAGCGLAILCVFSHFYLKEVMNGLDWIAITLAGLGTIGVGVGGEEQKVDQIPLLNIPWLVLSIVILFVLLNTWLHMYKKQRREQELTGPEVIEEIIYGLESGILFGISSVISKMGFVMSEMGFPKIVVPAAISCSVCCSAVGFVYQTRGLKHGRAIVVSTCTSVASIVSGVVAGMIALDEHLPKAPTARFFLLLGWFFIITGVILLVSSTRLIARLPRPVQKFLKSNIERTHSIRRPGSARGKDPIPTTTIHTSSLHLLASPTKEKA

SEQ ID NO: 186 - protein, 498 aa, Oryza sativa
MPADAAAKGMKLERYASGAGAMLLLRRAASGKVVSASSHLLFRATVLATMALVFLFTFHYPSLLSRSFTLSSGAGAGEGGAAAHASHRSLLMSSSSASASAASVYGGAAWEKEVRRSAKPRKDGGIAVLVTGAAGFVGTHCSLALRARGDGVLGLDNFNAYYDPELKRARQRLLAGRGVLVLDADINDALLLEKLFDLVPFTHVLHLAAQAGVRYAMEAPQTYVASNVAGLVTVLEVAAKHADPQPAIVWASSSSVYGLNTDAPFSEEHRTDRPASLYAATKKAGEAIAHTYNHIYGLSITGLRFFTVYGPWGRPDMAYFFFAKSIVSGEPITLFRAADGADARRDFTYIDDVVKGCLGALDTSGKSTGSSKSGKKSGPAPLRVYNLGNTSPVPVTRMVAILEKLLGKKANKRIVAMPSNGDVPFTHANVTHAAHDFGYRPTTSLDAGLRHFVDWFADYYKLKLDVPKIAAKVAGAGKPSSSSASKKKKKAAAMSASS

SEQ ID NO: 187 - protein, 537 aa, Oryza sativa
MESGGLIAPSETCSSDGRGGGGGGWRAARFLIAVGFLERIGFNGVQGNLVMYLTGPMGMSTAAAAAGANAWGGTVLVLTLVGALAADSRLGRYRAIVAAGVLHLLSLGMLTISSVMQPNHPHPASCHDAAAACSPSPPPPPSLARLVFFHAALYLLALAQGFHNPCSEAFGADQFAASDPGARASRSSYFNWYQFFNSFGYGISNTALSYVEDSVSCTVGFAVCLATTAVYLPIFLLGTRAYRAEQPVDGALLARLAKTSSSAARAWTARVFRRKDTSCTERLLAREEVGEKGFLAKLLPIWVTSIVFAIVSAQEVTLFIKQGSTMDRRIGARGGLVVPPAALQSIVSVIFLTFVPVYDRALVPLARRFTGHPAGITTLQRVGVGMAMSCLAMAVAALVEAKRLRAASDAGLIDRPDATVPMGVWWLVPQYALVGLSKVFGIIGLDEFFYDQVPDDLRSVGLAMSLSVRGVGSYASGVLVSAIDCATRSGGESWFSDNLNRAHLDYFYWILAALAALEVAVFVYIAKRYVYKNKGEP

SEQ ID NO: 188 - protein, 541 aa, Sorghum bicolor
MDANTLLLPCSDGAVAGAVDFRGRPASRSGTGRWSAAMFVLGVEIAERFAYHGVSANLISYLTGPLGESTAGAAAAINAWSGVATMLPLLMACVADAWLGRYRTIVLASLLFVVSMGMLTVSALPAFHHDGCSSYASSSLACSPSPAQVGVFYVSLYLVALAEAGHKPCAQAFGADQFDQNDPKESVSRSSFFNWWYFGMCSGTAVTTMVSSYIQDNVGWGLGFGIPCLVMVFALLMFLLGTRNYRYYTSTESSPFARLARAFIALIKGSKSSQSDGTLASDDDAGHREEVKGVLRLFPIWATCIIYAVIFSQSSTFFTKQAATLDRRIGPTLRVPPAALQTFISVTIMVFIPVYDRAFVPLARRLTRLSSGITMLQRIGTGLVLALVAMVVAALVEMRRLGVARDAGLVDQPKAALPMSLWWMVPQYVLFGLSDVFAMIGLQEFFYDQVPDALRSLGLALFLSIFGVGHLFSSFIISAIDGATKKSGASWFSNNLNRAHLDYFYWLLAGLCAVELAAFVIVSRVYVYKKRVSHDNNDAVM

SEQ ID NO: 189 - protein, 635 aa, Arabidopsis thaliana
MGFLVDTQKEGGGHSWGYVRSLVRRKQVDSANGQSHGHQLARALTVPHLVAIGVGATIGAGVYILVGTVAREHSGPSLALSFLIAGIAAGLSAFCYAELSSRCPSAGSAYHYSYICVGEGVAWIIGWALILEYTIGGSAVARGISPNLALIFGGEDGLPAILARHQIPGLDIVVDPCAAILVFVVTGLLCMGIKESTFAQGIVTAVNVCVLLFVIVAGSYLGFKTGWPGYELPTGFFPFGVDGMFAGSATVFFAFIGFDSVASTAEEVRNPQRDLPIGIGLALLLCCSLYMMVSIVIVGLIPYYAMDPDTPISSAFASHDMQWAVYLITLGAVMALCSALMGALLPQPRILMAMARDGLLPSIFSDINKRTQVPVKATVATGLCAATLAFFMDVSQLAGMVSVGTLLAFTMVAISVLILRYVPPDEQPLPSSLQERIDSVSFICGETTSSGHVGTSDSSHQPLIVNNDALVDVPLIKNQEALGCLVLSEETRRIVAGWSIMFTCVGAFLLSYAASSLSFPGLIRYPLCGVGGCLLLAGLIALSSIDQDDARHTFGHSGGYMCPFVPLLPIICILINMYLLVNLGSATWARVSVWLLIGVIVYVFYGRKNSSLANAVYVTTAHAEEIYREHEGSLA

SEQ ID NO: 190 - protein, 249 aa, Oryza sativa
MDGEEDSEWMMMDVGGKGGKGGGGGGAADRKKRFSEEQIKSLESMFATQTKLEPRQKLQLARELGLQPRQVAIWFQNKRARWKSKQLEREYSALRDDYDALLCSYESLKKEKLALIKQLEKLAEMLQEPRGKYGDNAGDDARSGGVAGMKKEEFVGAGGAATLYSSAEGGGTTTTTTAKLMPHFGSDDVDAGLFLRPSSQHHPPPPHAGAGFTSSEPAADHQSFNFHSSWPSSTEQTCSSTPWWEFESE

SEQ ID NO: 191 - protein, 336 aa, Zea mays
MSVSASSPAAAAGDEKQEAAPVRRCKGVNDLDKVVLREVRGSSAEVYLYGGHVTSWKDEHGDELLFVSNKAIFKPPKAIRGGIPICFPQFSNFGNLEPHGFARNRTWSVDDDPPPFPVPTSNSAYIDLILKPTEDDLKIWPHSFEYRLRVALSPGGDLMLTSRIRNTNADGKPFSFTFAYHTYFKISDISEVRVEGLETLDYLDNLQDRARSTEQGDAIVFESELDRIYLGTPSKIAIIDHEKKRTFVVRKGGLPDAVVWNPWDKKAKAMSDFGDDEYKRMVCVEAAAIEKTVTLKPGEEWTGKLELSAVPSSYYSGQLDPDRVIQDSTVPEDSIS

SEQ ID NO: 192 - protein, 582 aa, Oryza sativa
MRAKVELAVLLLVLVGVAAGTRPPSAPPPVTEDTLQKVAGSLEMYVDELPQMPKIYGFSMRHGHPSPIRLTIGMYQKKWKFHRDLPASTVFVFGTSAATATFPGPTIEAAQGVPLSVTWQNYLPARHILPWDPTVPTAIPRRGGVPTVVHLHGGAHPPQSDGSAFAWFTAGFGETGPAWSTPTYTYPNAQSPGVLWYHDHALGLTRANLLAGLLGAYVIRNPAVEAPLGLPCGDEFDRVLMLADRSFYADGSIYMNYTGIIPNIHPQWQPEYFGEAITVNGKAWPFLAVARRRYRFRIINTSNARYFNLSLTNGLPFTVVGSDTNYLSKPVTAASLLVSVAETFDVVVDFSQSTSSEAELVNTAPYPYPDGQAPNDLNGKVMKFVISPAKAKDTSRVPAKLLDYVAVAEEEAVQRRYIVMYEYEDAATGNPTHLYINGKRLEDPATETPRPGTTEVWEVINLTPDNHPLHLHLATFQATRVRGLVDEDAFKGCMTKLNDAVRCNVSRHAVGEEVAVPEHEKGWKNVVKIAPGYMTTIVVKFFMVDSGKPYPFDATAEPGYVYHCHILDHEDNAMIRPLKLIK

SEQ ID NO: 193 - protein, 231 aa, Triticum aestivum
MAALTASIATSSAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 194 - protein, 204 aa, Oryza sativa
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAVAKSGTTPLSPAIAFILEKVAPFVPKEEPKPEPEAEAAAETTSREVAVEEEKKEEEAAPAEPAAAAAEAAAPSTEVVEEKKEEEKPAEAAAPAAEPEKQ

SEQ ID NO: 195 - protein, 163 aa, Arabidopsis thaliana
MATGKSYYARPSYRFLGTDQPSYFTASDSGLEFDESDLFNPIHSDSPDFCRKISSSVRSGKKSSNRPSAASSAAAASSLPVNVPDWSKILRGEYRDNRRRSIEDNDDDDDDNEDGGDWLPPHEFLAKTRMASFSVHEGVGRTLKGRDLSRVRNAIFEKFGFQD

SEQ ID NO: 196 - protein, 380 aa, Oryza sativa
MADDLGPPTVLQKIHGQSMMFSKISPYSLMKNPALYNANTSYSVPLKSYNGMDGNNGFSSVTSVSPVFASAPKEKGLSGFMIDFMMGGVSAAVSKTAAAPIERIKLLIQNQDEMIKSGRLSHPYKGIADCFGRTIKDEGVIALWRGNTANVIRYFPTQALNFAFKDHFKRMFNFKKDKDGYWKWFAGNLASGGAAGACSLFFVYSLDYARTRLANDAKAAKKGGGRQFNGLVDVYRKTLASDGIAGLYRGFNISCVGIIVYRGLYFGMYDSLKPVVLVGNLQDNFLASFLLGWGITIGAGLASYPIDTVRRRMMMTSGEAVKYNSSLDAFKQIVAKEGAKSLFKGAGANILRAVAGAGVLAGYDKLQVVVFGKKYGSGGG

SEQ ID NO: 197 - protein, 317 aa, Gossypium hirsutum
ISSIFPGKQEGIAVGRTFAALKNYKVDGNKEMMAIGLMNMVGSSTSCYITTGAFSRSAVNHNAGAKSAVSNIVMSITVMVTLLFLMPLFQYTPNVVLGAIIVSAVVGLIDIPAACQIWKIDKFDFIVMLCAFFGVIFISVQDGLAMAVGMSIFKILQQITRPKTVMLGNIPGTDIFRDLHHYKESMKIPGFLILSIEAPINFANSTYLNERILRWIEEYEAEDHKKQSSLQFVVLVMSAVSTIDTSGVSIFKELKKTVEKKGAELVLVNPLGEVMEKLQKSDEAGDFMRPDCLFLTVGEAVATLTATIKSQVSNHVV

SEQ ID NO: 198 - protein, 544 aa, Zea mays
  misc_feature (114)..(114): Xaa can be any naturally occurring amino acid
  misc_feature (260)..(260): Xaa can be any naturally occurring amino acid
  misc_feature (270)..(270): Xaa can be any naturally occurring amino acid
MAPEKPRKEQEEELMLEDGGIEESPRRSFEDCGDSEEDRGEGDDEEERDSDRDGVGSTRSFLPQKWPQSYRETTDTYTIAASPSFGYLGPSTSKYSLLDLGRSGLGSDLKLPLXSDKADGKQDSVKTLPKTLGSIRDERVSFQLQHTGELYITQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTXIFPKAGFDWXGIHVDGKHFFGVLTAILVLPTVWLRDLRVLSYLSAGGVIATLLVFLSVGLVGATDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGTYSSVKKIVENY

SEQ ID NO: 199 - protein, 373 aa, Zea mays
MLEEYKPCAAMVVTQCIYAALALLSKAAFTGGMSPLVFVVYRQAVATIVLVPVVIAANRKKMKEMTTGLGLTGFSLVFVASLVGATVNQCMYYQGVNLGSSSMATAMTNLIPAITFVMAASVGLERVEARRPRSLAKIFGTAVCVSGAMAMAFFKGPKLLGDGPNALQLLLHAGGGGRWVAGALFLVGSSSCWSLWLILQVPICKSYVEPLALSAWMCVLSTLQSALLVSFLLPDPSAWRIHSLFELSCCVFSGVFGSGVTFYLQSWCISVRGPLYSAMFNPLCTVITTVFAAAVLREELHVGSLLGAIAVIAGLYVVLWGKAGDANKGGVEPEHHSDDLEKTSSARSDPNSTAGVGSGIAEPLLAGGDPTEK

SEQ ID NO: 200 - protein, 281 aa, Zea mays
MVGVLSNRVDRDDLKAGDHIYTWRAAYIYAHHGIYAGDGMVIHFTRAAGHEIGTGTFLDWFLYSSSPAATEGPPCQKCGHLVKSDGVITSCLDCFLDGGSLYLFDYAVSPAFFLAKARGGTCTLAASDPSDVVIHRARYLLDNGFGMYSLFKNNCEDFAIYCKTGLLVETAFSVGRSGQLASLTAAFSAVASSPLRFLTTSAGGLAIVTSGMYCVGRYVSDIGVRRDVVKVPVERLVEQNVTWIPQCVATETDIAAGAPQQQLEVPCAVAEEASVIQPAAP

SEQ ID NO: 201 - protein, 111 aa, Arabidopsis thaliana
MMFEQGFNYINLGVASDGASPKLALIGEFLKQFFYSNPEETWRCGLKLRDRHEERGFTSPQSRLTVADRNFCGVPVNPTMRLNVMTRGLRTTRSLHVLDTKSTCVSCLSLF

SEQ ID NO: 202 - protein, 532 aa, Arabidopsis thaliana
MDATSGTPSLQYINLPEQSVSTTSPPVSPFQRPKRHCFGDTTPGEFPLAANPSIVLHVLTECRLDPRDLANLEATCSFFSQPANFAPDINLSLSELAALDMCNKRVIFKPMNEEERQEMKRRCGGSWKLVLRFLLAGEACCRREKSQAVAGPGHSVAVTSKGEVYTFGYNNSGQLGHGHTEDEARIQPVRSLQGVRIIQAAAGAARTMLISDDGKVYACGKESFGEAEYGGQGTKPVTTPQLVTSLKNIFVVQAAIGNYFTAVLSREGKVYTFSWGNDGRLGHQTEAADVEPRPLLGPLENVPVVQIAAGYCYLLALACQPNGMSVYSVGCGLGGKLGHGSRTDEKYPRVIEQFQILNLQPRVVAAGAWHAAVVGQDGRVCTWGWGRYGCLGHGNEECESVPKVVEGLSHVKAVHVATGDYTTFVVSDDGDVYSFGCGESASLGHHPSFDEQGNRHANVLSPTVVTSLKQVNERMVQISLTNSIYWNAHTFALTESGKLFAFGAGDQGQLGTELGKNQKERCVPEKVDIDLS

SEQ ID NO: 203 - protein, 230 aa, Glycine max
MASLSSLVLLLAALILSPQVLANYENPPVYKPPTEKPPVYKPPVEKPPVYKPPVENPPIYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPIYKPPVEKPPVYKPPYGKPPYPKYPPTDDTHF

SEQ ID NO: 204 - protein, 258 aa, Arabidopsis thaliana
MRMLVLRTPTGPVSAVRFITKSKPSPFSSPDSWLLPAPNTHRSRPRVVLALSNPDGSVNSKPSTSASQIPSSGDETVFVGQDNVPLEGVIQFDKPSSTSSSNITKWGRVALLAGGDVLALLIFSAIGRFSHGFPVFSLDTLHTADPFIAGWFLSAYFLGGYAEEGRGMKGKSKAVVAAAKSWIVGTPLGIIIRSASSGHIPAYSFVLVTMGSTAVLLIGWRALLFSVLPTESKKKDDTYRKGSAFELFELLTSLIRRW

SEQ ID NO: 205 - protein, 363 aa, Arabidopsis thaliana
MSCFGWCGSEDFRNATDTGPRPAHNPAGYNGGHYQRADPPMNQPVIPMQPISVPAIPVDELRDITDNYGSKTLIGEGSYGRVFYGVLKSGGAAAIKKLDSSKQPDQEFLSQISMVSRLRHDNVTALMGYCVDGPLRVLAYEFAPKGSLHDTLHGKKGAKGALRGPVMTWQQRVKIAVGAARGLEYLHEKVSPQVIHRDIKSSNVLLFDDDVAKIGDFDLSDQAPDMAARLHSTRVLGTFGYHAPEYAMTGTLSSKSDVYSFGVVLLELLTGRKPVDHTLPRGQQSLVTWATPKLSEDKVKQCVDARLLGEYPPKAVGKLAAVAALCVQYEANFRPNMSIVVKALQPLLNPPRSAPQTPHRNPY

SEQ ID NO: 206 - protein, 340 aa, Triticum aestivum
MAKVNAGAALLSLCLLLACSAGGTQAAYVDVEGTVRTEVEKAIKSNPGIGAALVRLVFHDCWVNGCDGSVLLDKTTSGGNTEKKAINNIGLDGFNLIDTIKYKLGNSVSCADIVVFAARDAARYLSGGKITYSVPSGRKDGIVSSAAAADAILPQSTFEFQQLVDNFAKKNFTQEELVILSGAHSIGVSHLSSFQDRLNDSTATPIDDNYKQALVADVEAQKKSQNTPDPIEKNNIRDMSSSFQTTAGYDPTGVNTAAKGALDNSYYHANLQNRVLFKSDWVMRTDSKAGDDMAEYMNNATKWNNDFAAAMVKLSKLPAEGSTRYEIRKNCRVTNQNYYY

SEQ ID NO: 207 - protein, 293 aa, Oryza sativa
MATDVAATEPEVAAEEAAAAAPETTATAGDSKPAKEAKAKKAAAPRKARSTATHPPYAEMISEAIATLKERTGSSQYAIGKFLEDKHKDHLPSNFRKQLLVQIKKLVAAGKLTKVKNSYKLPPTRAPAAAKPKAKPAAAAKPKPKPKAAAKPKAAAKPKAKAPAKSKAAAKPKAAAKPAAKPKAAAKPKSPAKPAAKPKAAPKAKAKPAAKPKAKAAPKPKAAAVTKTKATSAPARRPAKAAKTSAKDTPSKKAAPAAKKPAAAAKKAPAKKAAPAKKAAAPARKVPARKAKK

SEQ ID NO: 208 - protein, 259 aa, Oryza sativa
MAEKEESTSIPLSQAAEAVDPEDPAKSPPRPSSPTTSTRKACCAVLQSWVSRKFMTGCVVLFPVAVTFFITWWFIQFVDGFFSPLYAKLGIDIFGLGFLTSLVFIFLVGIFVSSWVGSTIFWVGEWFIKKMPFVRHIYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASLEPTPRKSQNIRLNRIMT

SEQ ID NO: 209 - protein, 366 aa, Sorghum bicolor
MARCRRHLLLLALFLALAAAAPGQAQSHGEASAVFIDAASHRYLRDQQADGQDASMSLNEVSAAVSVLLGFAAPTSLPAISSSKLNKVLLPNPFDRPRAVFLMQIAGTDASAPSFVSEGSNIFKTRIEGANSADTGLSDTDDLIVIHSDESLDLSRSDYLDNELSSLANWLEGSYQKSSSKLVIPLESGNSLTLLLDKEADMEFVSSLASLLKTIERAIQVHEDFSGVMNPAELLECHFTGIKALENEYGSTEIVKQATEVVQRAVTKSFQSLHEAYKGKIVGLVISTKEASSSLGSIIDAPSSLHISRRLEEASKTKEASVALVRKSLAWITGIILLVSTLIGVCLLMNMPLTRDTLLYSNVKID

SEQ ID NO: 210 - protein, 278 aa, Sorghum bicolor
MTTARKAACVLAAWVLVAAALSDLGSARAPLGSKPQREFDYFALSLQWPGTICASTRHCCASNGCCRSEPLQTFTIHGLWPDYDDGTWPSCCRRTQFELDKILPLMEVLNKYWPSLYCSKSGTCFSGKGLFWAHEWEKHGTCSAPVVQDELQYFTIALDLYFKYNVTEMLSSGGIQVSNGKEYALSDVIDTIKHAFGGSPQIVCKNGSVQELRLCFDKELKPRDCLTTSLTNGSVSKSKHCPRYITLPTYDPLVLANSTVEIMSQFDEFVVPTALYTA

SEQ ID NO: 211 - protein, 417 aa, Sorghum bicolor
MAGFKVTRISEGPVKPASSTPEETLPLAWVDRYPTHRGLVESMHIFRSGADAAPAVIRAALGKALAFFYPLAGRIVEGDQPGCPAIRCTADGVYFAEAVADCSLEDVRFLERPLLLPKEDLVPYPGDDRWTVEPHNTIMMMQITKFTCGGFVMGLRFNHASADGMGAAQFINAVGDMARGLTEPKVLPVWHREKFPNPNIKPGPLPELPVLALDYVVLDFPTPYIDDLKRQYKAHSGKFCSGFDVLTAKLWQCRTRALALDPATEVKLCFFASVRHLLKLDRGYYGNSIFPVKMSAPAEKVLASSILEVVDMIREAKDRMAVEFFRFAKEETDQDPFQMTFNYESIYVSDWSKLGFSDVDYGFGPPMFAGPLVNNDFIASVVILKAPLPLDGTRMLASCVTKEHSDEFARGMKEDLP

SEQ ID NO: 212 - protein, 237 aa, Sorghum bicolor
MPVNPPPPPPPGSSSSAPAGPSYFPLPFHLQQHQPPPQMPPPMAANSYQQYQQQLHQAHQLFQRDAQTITPEALQSVKAAIATSDVLDPAAAANARPSDPSTSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVHRKPKILKKSILHK

SEQ ID NO: 213 - protein, 445 aa, Oryza sativa
MAAVDNAPPSPVVTVTSTRTVAPAAAKCVLATFDLPYITFYYNQKLLLYRLPNGASDFPDAVARMSASLSDALAYFYPLAGRIRQDDHDGSLSIHGQHGAEVIEASADHVSVDQLAGEECSEEAEKVMQLLVPYTGVMNLEGLNRPLLAVQLTRLRDGVAVGCAFNHAVLDGTSTWHFMTSWAELCRVGGAPSLLPVHNRGMARSVRVNLPLPASAEAHEKTDPNGPKVPLVARVFSFPPSAVARAKAAANAALPPGAKPFSSFQSLAAHIWRAVSRARALGPSDITVFAVFADCRARLSPPLPPAYFGNLIQAVFTGVPAGMLLAGPPELAAGLLQKAIDDHDAAAITRRLEEYEAAPKLFHYSDAGPNCVAVGSSPRFRVYDVDFGFGRPERVRSGANNKFDGMVYLYPGRGGDGGIDVELSLQPEPMQRLDKDQDFLQMRAP

SEQ ID NO: 214 - protein, 452 aa, Zea mays
MRVKVISRSTDDYTRERSQDLQKVFRNYDPALRSQEKAVEYTRALNAAKLEKIFAKPFIGAMDGHIDAVSCMAKNPNHLKAIFSGSMDGDVRLWDIAARKTVCQFPGHQGAVRGLTTSTDGDLLVSCGVDCTVRLWKVPMLKMVDTSERAGDNSQPSAVYTWKHAFWGADHQWDGNLFATVGAQVDIWDPDRSEPINSFEWGKDTVLSVRFDPGDSNILITSGSDRSLTLYDLRMSSPARKLIMKTRCNSVCWNPREPMNFTAANEDTNCYSFDARKLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKQEYQDALKERYKHLPEVKRIVRHRHLPKPIYKAANLRRTMIEAESRKEERRRKHSAPGSMPVQPFRKRRIIREVE

SEQ ID NO: 215 - protein, 434 aa, Glycine max
MYSNFKEQAIEYVKQAVQEDNAGNYAKAFPLYMNALEYFKTHLKYEKNPKIKEAITQKFTEYLRRAEEIRAVLDDGGPGPASNGDAAVAARPKTKPKDGEGGGDGEDPEQAKLRAGLNSAIIREKPNVKWNDVAGLESAKQALQEAVILPVKFPQFFTGKRRPWRAFLLYGPPGTGKSYLAKAVATEAESTFFSVSSSDLVSKWMGESEKLVSNLFEMARESAPSIIFIDEIDSLCGQRGEGNESEASRRIKTELLVQMQGVGHNDQKVLVLAATNTPYALDQAIRRRFDKRIYIPLPDLKARQHMFKVHLGDTPHNLTESDFEYLASRTEGFSGSDISVCVKDVLFEPVRKTQDAMFFFKNPEGMWIPCGPKQQGAVQTSMQELAAKGLASKILPPPIRRTDFEKVLARQRPTVSKADLDVHERFTKEFGEEG

SEQ ID NO: 216 - protein, 1201 aa, Sorghum bicolor
MVRLLGLRSLSFGPEESPREIPSTADAAPPVGSSGWLVRFFDSAFFCEWIAVSYLYKHDHAGVRDYLCNRMYTLPLPGLEAYLFQVCYMLVHKPSPSLDRFVIDTCAKSLRIALKVHWLLAAELELEDADDLDGIDKVQEQCQVAATVQGEWPPLVRPAPPSPAASPRGNPMLSRIRSSKQRLLSLASSPSLGLSPPAGGGVNVAEDAMGTGGKQPATPSSEDNKLLKRLSIGPKMRDALLFRRSGEKDEEQDRDGFFKRLLRDSRDKDDDDGDREGFFKRLLKDSREKDNEEEEGDRDGFFRRLLRDSKEEDMELTPSSDGLLKRLFRDKEDKQGEDDEKEGFFRRMFKDKNEERRDSIHARHGDEERVGKSVEDDDKEGFFRKIFKDKNEERKDEGHQKPDEREKVGANIEEDKRDGFFRQLFKDKNDEKKEGSTPSKKEEDDRGHRNADDDNFFRRLFKDKNEEKKGIAHDRNEDDKCEEGDKENFFRKFFKDKNEERRTEGPDKNDDDGKGTSGIEEEDNPEFLSFRRLFRVHPEDSKSGVIESSQSNNLSEGSPGSESFFKRLFRDRDRSLEDSEIFGSKIAKEARICTGINEKQSGKPPLPINAVAELRKGSYYASLELVQALCDTSYGLVDIFPIEDRKIALRESLTEINSQIASAEKNGGVCFPMGKGIYRVVHIPEDESVLLNSREKAPYLICVEVLKAEAPSHSKGSSDGHKLSKGGIPLANGDVQLPKPPPWAYPLWSRHDTQNYETDRMLKSTSQVIDQAMAQLWETKVKFVNVSFSIEKLGRSRSIALSETGRRLRHDAIDSHEPPGDSQTVADQPIEWVKVTLSAVPGVNMEDVDDNEPTRKKDHRRIPSTIAIEEVKAAALKGEAPPGLPLKGVGQSTQNLDPKATDGGDPKPTDALAGELWAVKRERIRRSSVHGKSPGWDLRSIIVKSGDDCRQEHLAVQLVAHFYDIYQEAGLPLWLRPYEVIVTSAYTALIETIPDTASIHSVKSRFPNISSLRDYYVAKYEENSPNFKLAQRNFVESMAGYSILCYLLQVKDRHNGNLLIDEEGHIIHIDFGFILSNSPGGVNFESAPFKLTRELLEVMDSDAEGTPSEFFDYFKVLCIQGFLTCRKHAERIILLVEMLQDSGFPCFKGGPRTIQNLRKRFHLSLTEEQCVSLVLSLISSSMDAWRTRQYDYYQRVLNGIL

SEQ ID NO: 217 - protein, 266 aa, Zea mays
MGYAQLVIGPAGSGKSTYCSSLYDHCQTVGRTIHIVNLDPAAEHFDYPVDMDIRELISLDDVMEEIGLGPNGGLIYCMEHLEDSLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKDVEEYLDPNAQVLLSQLNRQMAPRFGKLNKCLAELVDDYSMVNFIPLDLRKESSIQYVLSSIDTCIQYGEDADVKVRDFEEDED

SEQ ID NO: 218 - protein, 138 aa, Hordeum vulgare
MSACVMASLALKPSSSPLLQRSKLGGVRPSARPSLVIVAKKAKKVQTAQPYGPGGGVAFKEGVDASGRVAKGKGVYQFADKYGANVDGYSPIYTPEEWSPSGDVYVGGKTGLFLWAVTLAGILLGGALLVYSTSALAS

SEQ ID NO: 219 - protein, 280 aa, Sorghum bicolor
MARRSLALLLASSLALVMMAAVASADSWLYEKFSTDGTVRTNYDESGAQVAMLNLDRSSGAGFNSKEQYLYGQFSVQMKLIPGNSAGTVSCFYLSSGDGDGHDEIDMEFMGNATGQPVVLNTNVWANGDGKKEHQFDLWFDPAADYHTYTIIWNPTNILFKVDDNVIRVFKRYADLAYPSSKPMTLHATLWDGSYWATEKGKVPIDWSGAPFVVSYKGYSADACVSGGACAAGSGAWMNKQPDSAEWGTVKWAESNYMRYNYCDDGWRFPQGLPAECSRS

SEQ ID NO: 220 - protein, 176 aa, Oryza sativa
MEVEAFPIRFTRGIRSHWGRRKYQRLEAANGGGKTRATQQLGGARRGGAGWGLRLRRLLRVRVRVARAWLSSPARLLARIRDAYVGGMLAVSRKASGMSLPNAPEGLWPRRVPRRKQLPAARPGQLTDFEQRLVVEIYKSIVASKELTTMLHHSTAHLPQQHNTAAPASSGQLLVN

SEQ ID NO: 221 - protein, 1451 aa, Arabidopsis thaliana
MGRLKLHSGIKAIEEEPEDFECTDSSNTTTLACMIDTEIAAVLAVMRRNVRWGGRYMSGDDQLEHSLIQSLKALRKQVFSWNQPWHTISPMLYLQPFLDVIRSDETGAPITSIALSSVYKILNLNVIDQNTANIEDAMHLVVDSVTSCRFEVTDPASEEVVLMKILQVLLACMKNKASVMLSNQHVCTVVNTCFRVVHQAGMKGELLQRVARHTMHELVRCIFSHLPDVERTETTLVNRAGSIKQEKAGVDSDYAIVSKPVEDGNANSEYDVENSMATFATGAQSLMDDGPVGPGSRKPASPYDLHIMTEPYGVPSMVEIFHFLCSLLNVVEHVGMGSRSNTIAFDEDVPLFALNLINSAIELGGSSIRHHPRLLSLIQDELFRNLMQFGLSMSPLILSMVCSIVLNLYQHLRTELKLQLEAFFSCVILRLAQGKYGPSYQQQEVAMEALVNFCRQKSFMVEMYANLDCDITCSNVFEELSNLLSKSTFPVNCPLSAMHILALDGLIAVIQGMAERISNGLTGLDLGPVHLDEYTPFWMVKCDNYSDPNHWVSFVRRRKYIKRRLMIGADHFNRDPKKGLEFLQGTHLLPDKLDPQSVACFFRYTAGLDKNLVGDFLGNHDEFCVQVLNEFAGTFDFQYMNLDTALRLFLETFRLPGESQKIQRVLEAFSERYYMQSPEILANKDAALVLSYSIIMLNTDQHNVQVKKKMTEEDFIRNNRHINGGNDLPREFLSELFHSICNNEIRTTPEQGAGFPEMTPSRWIDLMHKSKKTAPYILADSRAYLDHDMFAIMSGPTIAAISVVFDHAEHEDVYQTCIDGFLAIAKISACHHLEDVLDDLVVSLCKFTTLLNPSSVDEPVLAFGDDAKARMATITIFTIANKYGDYIRTGWRNILDCILRLHKLGLLPARVASDAADESEHSSEQGQGKPLANSLSSAHLQSMGTPRRSSGLMGRFSQLLSLDTEEPRSQPTEQQLAAHQRTLQTIQKCHIDSIFTESKFLQAESLLQLARALIWAAGRPQKGTSSPEDEDTAVFCLELLIAITLNNRDRIVLLWQGVYEHIATIAQSTVMPCNLVDKAIFGLLRICQRLLPYKESLADELLRSLQLVLKLDARVADAYCEQIAIEVSRLVKANANHIRSQAGWRTITSLLSITARHPEASESGFDAVSFVMSEGTHLYPANYVLCVDAARQFAESRVGQSERSIRALDLMGDSLEFLAKWALSAKENMGEEDFGKMSQDIGEMWLRLVQGLRKVCLDQREDVRNHALQSLQKCLGGVDGINLAHSMWSQCFDKVIFTVLDDLLEIAAGSQKDYRNMEGTLLLAIKLLSKVFLQQLQELSQLSTFCKLWLGVLTRMEKYMKVKVRGKKSDKLQESVPELLKNILLVMKTKGVLLQRSALGGDSLWELTWLHVNNIAPSMRLELFPDQESSQLGDDETVSNGLSSPENTTGS

SEQ ID NO: 222 - protein, 471 aa, Arabidopsis thaliana
MMEALLYVITLFSLSALTVTLGESISIDCGSTGSYVDSNNVTWVGDKGFVTNGEPMKIPDVVKKPINTLRYFPTGQTNCYTNIPVTKGQKTLVRTKFYYENYDAKFSPPSFDVIYDGKHRDSIVITESLLNDEETFYFSEVIYVPENKNISVCLLRTSPSDNPFISSIEVYSLDTGMYDDLGPNEGLILHDRIAYGAKELISYPLDPYGRVWLALGSQDSTLTDLTTSAPSIDITGASNKPPEIVMSKALSGVGLVLSDQTLPLTGVPVYLVLYFSEPQSLGRTQRRSFNVFLDNTQVGSRPIVPVFGKATQFILRDVVATSASQIVFQSTDDSVLPPLINGLELYSISNTSPDSGGGGGDQGGGSTDDSEGSGGAKQAKNLGKGGAKSSGGKKNNKLPLILGVTFASAFAVLASAFAAIWKKRQNAKSQSNSTVPNTSTEHGTGTGMSPLVGQQFASDMTDSYVVEDGHH

SEQ ID NO: 223 - protein, 516 aa, Oryza sativa
MAPLPPSSSPPSCKAGGGGGSPRWSLLHGGGGEWGVVVRRNVVKSSSLLLLVFSTFFVFSVLRSSQTSLVPPPPPAAAGPGEPALAQSGHDVAGDDGGEHVAVAVNNVAAETQSTPDDISLPSTNSSAAAVPTTTNKAEQQQTGANNMEEKCDMSMGKWVREPKGPVYTNTTCPTLPDFKNCQKHGKDPGHLYWRWQPHGCDLPRFSPDRFLAAVRGKRLAFIGDSLARNQMDSLLCLLSQAETPTEVYRDAHDKFQTWRFAAHEFTLMVMWTEFYVHAEPVVGADGKPTPSFDIHLDRLSANWTRRLPELDYAVISGGNWFNRPNYLWEGGRRVGCVKCGGAANLTDVGVPYAVRRVVRAAVEGIARCTGCKAGLVAFLRTFSPDHFEHGAWFSGGYCNRTRPLEEDEVSPDSAAWELRRVQREEVMRVKETAAAAAAASGNARRFEVLDVTKAMMLRADGHPGAAIDKRWQKNIVSDCLHWCMPGPVDMWNEMLLQRLTEISTLDQDASIFEAP

SEQ ID NO: 224 - protein, 385 aa, Gossypium hirsutum
MGKKLAAFLGRGFKPSKFKSLVTLAISRLAVFKNQRQIRCNQARSDVVQLLQLSHHDRALLRVDQVIKEQNMLDVFVILEGYCNLVIERLHLIEQDRVCPDELKEAITGLLFASSRCGDFPELLEIRAVFTSHYGKEFAARAIELRNNCGVNAKIIQKLSTRQPDLQSRRNVLNQIAAEYGIALQLEETTDSSEGNLDVSKKQETSVKASHDAGDDDEFSDSIKTRRKYRDVADAAQAAFESAAYAAAAARAAVELSRSDSYDPDDQNGPNTRQNTVFDKQEANSKDMENHGSQAVELNHTKKAPEIKMSSPSSEGSAEGIIDLRTMSFDEVDPLKLLEKEVVIYESDDDKYDSRGSSFDLNARKLKGKVLDTDNDGEHSEKKLD

SEQ ID NO: 225 - protein, 458 aa, Gossypium hirsutum
MGKKLDALLGRGFKPYKLKSLISVALSRLSVFKNRRQIRSNQARSDVVELLQLGHHDRALLRAEQVVKEQNMLDVFVILEGYCNLLIERLHLIEEDRECPDELKEAICGLLFASSRCGDFPELQEIRAIFTSRYGKEFVARAIELRNNCGVNTKIIQKLSTKQPDLQSRWNVLNEIAAEHSIALQLRETSVSATQENLDGSKNHSQPKLGTIGKASNHAVLGDDNEFSDSTKARKKYKDVADAAQAAFESAANAATAARAAVELSRSDFHDPDDDDHDDDQNSPNSQRKRVLEREEPNSEDKETQQGNQAEDLKQTPEIKISSPSSSKDSSQGNLDIRTVSLDDVDPIKLLEKEVVIHESDDENYDSHDSSFHMNTSMFKVRAQDEDKNYECTEKTALMFQNSFDKQIPSSLRAGLKVEAVPENPTEHVAQSSGTKGKRPFTINKAPFSVRTRQVRGY

SEQ ID NO: 226 - protein, 330 aa, Sorghum bicolor
MWNSIYRFLCGLCAPSSSEHGLHGAHPVAALGRDILSFQSTSQVPDELSRHVVSSKKAQANWYKKLLVAWKKARPPPKTPEEAAAFVVQTLKNHQKADVEGLLSFYGLPHPNAAAGTPAAPPPPKKPQGAKFELHTLPIDPKSVADGDTVNVYVDTADPREAGSVPREVQKAAAERAKARAAKNYQKADALQKIIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWASSKPQKPWEWRKDKRNGTA

SEQ ID NO: 227 - protein, 268 aa, Sorghum bicolor
MGYAQLVIGPAGSGKSTYCSSLYDHCQTVGRTIHIVNLDPAAEHFDYPVDMDIRELISLDDVMEDIGLGPNGGLIYCMEHLEDSLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKEVEEYLDPNAQVLLSQLNRQMAPRFGKLNKCLAELVDDYSMVNFIPLDLRKESSIQYVLSYIDTCIQYGEDADVKVRDFEPIEDED

SEQ ID NO: 228 - protein, 464 aa, Sorghum bicolor
MGASTTTSLAAAAAALLLLVSLAAAADMSIISYGERSEEETRRMYAEWMATHGRTYNAIGEEERRYQVFRDNLRIIDEHNAAADAGVHSFRLGLNRFADLTNEEYRATYLGVRTKPQRERKLSARYHADDNEDLPESVDWRTKGAVAEVKDQGSCGSCWAFSTIAAVEGINQIVTGDLISLSEQELVDCDTSYNQGCNGGLMDYAFEFIINNGGIDTESDYPYKGTDGRCDANKKNAKVVTIDSYEDVPANSEKSLQKAVANQPVSVAIEAGGNAFQLYSSGIFTGKCGTALDHGVTAVGYGTENGKDYWIVKNSWGSSWGESGYIRMERNIKDSSGKCGIAVEPSYPLKEGANPPNPGPTPPSPTPEPSVCDNYYSCPESTTCCCIYEYGKYCFAWGCCPLEGATCCDDHYSCCPHDYPICNVQQGTCLMGKDSPLSVKATKRTLAKPHWAFSGNTDGMKSSA

SEQ ID NO: 229 - protein, 433 aa, Brassica napus
MKVETIKPSSTTPDDLRTLQLSIYDHFLPPIYTVAYLFYTKDELMISPEHTSHKLKTSLSETLTKFYPLAGRINGVTVDCNDEGAVFVDARVDNCSLSGFLASPDLNALQQLLPLDAVQNPYEAASTWPLLLVKATYFQCGGMAIGVCITHKIADAASMSTFIRTWSAEARGEAGNTVMDPKFSAANFYPPANDTYKLPVDEKANKRSSITKRFVFGASKLEELRTKATSPESADIPTRVESVTALLWKCFVFASSLDTCGRKVLIQLADLRSKLPSLLPESLIGNVMFSSVVLSTAQGEEVKIEEATRDLRKKREDLQTMIQDEDGSSSMIGSKLANLMLTNYARMSYETHEPYTVSSWCRLPLYEASFGWGYPVWVVGNVAPTFENIAMLIDSKDGHGIEAFVTLPEENMSSLEQNSELLAFASLNPCVLV

SEQ ID NO: 230 - protein, 561 aa, Hordeum vulgare
MVGRSSLPDGALFLGLDSSTQSVKATVLSNELIIVASETVNFDSELPHYKTEGGVYRDPTDDGRIYSPTIMWVEALELLLEKLKPKINFSKVVAVSGSGQQHGSVYWKKGSQAVLSSLDPGKSLVSQLKDAFSTMDSPIWMDSSTTKQCREIENAVGGALELSKLTGSRAYERFTGPQIRKIYQTAPHIYENTERISLVSSFMASILVGCYASIDETDGAGMNLMDINKRTWSKVVLEATAPDLEQKLGNLAPAYAAAGRISSYFVERHQFDKNCLVIQWSGDNPNSLAGLTLNTPGDLAISLGTSDTVFGITAEAKPSLEGHVFPNPVEPDGYMVMLCYKNGSLTREDVRNQCAEKSWDIFNSYLEKTPPLNGGRLGFYYKDHEILPPLPVGFHRYIVENFNDASSENLTEREVQEFDPQSEVRAIVEGQMLSMRGHAERFGMPNPPKRIIATGGASSNESILKLIAQIFGCPVFTVERPDSASLGAALRAAHGWLCKEEGGFVPISRMYVGNLEKTSLGAKLAVPAPEEEGRELLKKYTALTRKRMEIERRLVEKIGRA

SEQ ID NO: 231 - protein, 190 aa, Hordeum vulgare
MAVKKIGSEMGVVLGLDVARYMGRWYEIASFPNFFQPRDGRDTRATYELMEDGATVHVLNETWSKGKRDYIEGTAYKADPASDEAKLKVKFYVPPFLPIIPVVGDYWVLYVDDDYQYALVGEPRRKSLWILCRKTHIEEEVYNQLLEKAKEEGYDVAKLHKTPQSDPPPEGDAAPTDSKGAWWFKSLFGK

SEQ ID NO: 232 - protein, 218 aa, Sorghum bicolor
MAVFSDLHTADGLKTLEAHLAGKTYVSGDAITKDDIKVFAAVPSKPGAEFPNAARWYETISAAVASRFPGKPVGVNLPAGSAPAAAAPAAEAEDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLTEEPINEYVQSCDIVAFNKI

SEQ ID NO: 233 - protein, 334 aa, Oryza sativa
MECSISRTNLNCISLGDPDTKKSVALLKQACLDSGFFYVVDHGISQELMDDVFAQSKKFFDLPINEKMELLRDEKNRGYTPMLDEILDPENQVNGDYKEGYYIGIEIPEDDPQANRPFYGPNQWPSDEVLPRWRKVMEQYHSEALRVAKSIARIIALALNLEEDFFDKPEMLGEPIATLRLLHYEGGQKTGKVSNPAEGVFGAGAHSDYGLITLLATDDVVGLQICKDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 234 - protein, 151 aa, Oryza sativa
MSGRKKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 235 - protein, 195 aa, Oryza sativa
MAAAAVEKKSGSEMTVVRGLDVARYMGRWYEIASLPNFFQPRDGRDTRATYALRPDGATVDVLNETWTSSGKRDYIKGTAYKADPASDEAKLKVKFYLPPFLPVIPVVGDYWVLYVDDDYQYALVGEPRRKDLWILCRQTSMDDEVYGRLLEKAKEEGYDVEKLRKTPQDDPPPESDAAPTDTKGTWWFKSLFGK

SEQ ID NO: 236 - protein, 212 aa, Zea mays
MGTVVDAAPAVVAEVTENMLGGKKVTVVFVLGGPGSGKGTQCANIVEHFGFTHLSAGDLLRAEIKSGSENGTMIENMIKEGKIVPSEVTIKLLQEAMIKSENDKFLIDGFPRNEENRAAFENVTKISPAFVLFFDCSEEDMEKRLLGRNQGRVDDNIETIKKRFKTFVDSTLPVIEHYNSKDKVKKIDAAKPIPEVFEDVKAIFAPYSLKAE

SEQ ID NO: 237 - protein, 493 aa, Arabidopsis thaliana
MGLDAVKAKGNWKSEKPKETENKNHKKKNGDDNKSRNEEEEEGEASGCWVKFRFMIGCIPSKSDLDASSSSIYGSNCTVTTMESKSANEKSNDQPVGQVSSTTTTSNAESSSSTPVISEELNISSHLRKFTFNDLKLSTRNFRPESLLGEGGFGCVFKGWIEENGTAPVKPGTGLTVAVKTLNPDGLQGHKEWLAEINFLGNLLHPNLVKLVGYCIEDDQRLLVYEFMPRGSLENHLFRRSLPLPWSIRMKIALGAAKGLSFLHEEALKPVIYRDFKTSNILLDADYNAKLSDFGLAKDAPDEGKTHVSTRVMGTYGYAAPEYVMTGHLTSKSDVYSFGVVLLEMLTGRRSMDKNRPNGEHNLVEWARPHLLDKRRFYRLLDPRLEGHFSIKGAQKVTQLAAQCLSRDPKIRPKMSDVVEALKPLPHLKDMASSSYYFQTMQAERLKNGSGRSQGFGSRNGQHQPVFRTLSSPHGSSPYRHQIPSPKPKGATT

SEQ ID NO: 238 - protein, 658 aa, Arabidopsis thaliana
MSRTIGSRVIFLILALFCCTENSRGKLVMQGSAGFFKGYRTLTSTKKHAYGQAFEDEIVPFKNSANDTVTSFSVTFFFAIAPEDKHKGAHGMAFVISPTRGITGASADQYLGIFNKANNGDSSNHVIAVELDINKDEEFGDINDNHVGININGMRSIKFAPAGYYDQEGQFKDLSLISGSLLRVTILYSQMEKQLNVTLSSPEEAYYPNKPLLSLNQDLSPYILENMYVGFSASTGSVRAMHYMLSWFVHGGVDVPNLDLGIPTFPPYPKEKSLVYRIVLVTSLALVLFVALVASALSIFFYRRHKKVKEVLEEWEIQCGPHRFAYKELFKATKGFKQLLGKGGFGQVFKGTLPGSDAEIAVKRISHDSKQGMQEFLAEISTIGRLRHQNLVRLQGYCRYKEELYLVYDFMPNGSLDKYLYHRANQEQLTWNQRFKIIKDIASALCYLHHEWVQVVIHRDIKPANVLIDHQMNARLGDFGLAKLYDQGYDPQTSRVAGTFWYIAPELIRSGRATTGTDVYAFGLFMLEVSCGRRLIERRTASDEVVLAEWTLKCWENGDILEAVNDGIRHEDNREQLELVLKLGVLCSHQAVAIRPDMSKVVQILGGDLQLPDNLLDIVKAEKVRMWSETSESVLGVLTSQGSIGTLTLTEPFTSRGR

SEQ ID NO: 239 - protein, 346 aa, Arabidopsis thaliana
MAEACRVRRMKLGSQGLEVSAQGLGCMALSARYGAPKPETDAIALLHHAINSGVTFFDTSDMYGPETNELLLGKALKDGVKEKVELATKFGFFIVEGEISEVRGDPEYVRAACEASLKRLDIACIDLYYQHRIDTRVPIEITMRELKKLVEEGKIKYIGLSEASASTIRRAHAVHPITAVQIEWSLWSRDAEEDIIPICRELGIGIVAYSPLGRGFLAAGPKLAENLENDDFRKTLPRFQQENVDHNKILFEKVSAMAEKKGCTPAQLALAWVHHQGDDVCPIPGTTKIENLNQNIRALSVKLTPEEISELDSLAKPESVKGERYMASMSTFKNSNTPPLSSWKAT

SEQ ID NO: 240 - protein, 225 aa, Arabidopsis thaliana
MEAALSIFKLSFLLTLLSGGSDLIDSLPPNCNRAECPSYEVVHAGNGYEIHRYNTTVWISTEPIQDISLNEASGNGWNQLSDYMNGNNDYHQRIEIALPYITQVSQNLSTFIVSFFVPKAFQPDPPPGNNLHVQRWDSRYVAVKQISGYVADHKIGKQVAELKASLQGTVWAKAIEKSRETGGVGSAWAYTVAQFSWPFQWSQRVNEIWFPFEMEDEETVSIVTQ

SEQ ID NO: 241 - protein, 650 aa, Arabidopsis thaliana
MSRNLDSPVQTQMAVAVFKTPLTGASKMEGKQHHKHQHLQRQSSGRRVFVQTETGCVLGMELDRSDNVHTVKRRLQIALNFPTEESSLTYGDMVLTNDLSAVRNDSPLLLKRNFMHRSSSTPCLSPTGRDLQQKDRSGPIEILGHSDCFSIVKHMVKDIVKAMKMGVEPLPVHSGLGGAYYFRNKRGESVAIVKPTDEEPFAPNNPKGFVGKALGQPGLKSSVRVGETGFREVAAYLLDYGRFANVPPTALVKITHSVFNVNDGVKGNKPREKKLVSKIASFQKFVAHDFDASDHGTSSFPVTSVHRIGILDIRIFNTDRHGGNLLVKKLDGVGMFGQVELIPIDHGLCLPETLEDPYFEWIHWPQASLPFSDEEVDYIQSLDPVKDCDMLRRELPMIREACLRVLVLCTIFLKEASAYGLCLAEIGEMMTREFRPGEEEPSELEVVCIEAKRSVTERDVFSPRSDVVGEAEFQFDLDCDDLESVYSSKIQLTDDYFTKNPFSNGRSSLGKLEESIKEEEEDEEEEEDKTENTVPMIIMKDSFFSSAAFHDKAPSLSKLSTSMKNTHLSDTTRKNPKPLTRGKSENTSSGHKSANEQLPVSASFVKVADMKEDEWVLFLERFQELLGPAFAKRKTATLSKRQRLGTSCQF

SEQ ID NO: 242 - protein, 475 aa, Arabidopsis thaliana
MATLYSQVPSVSAVFSLYTSFSAITMLFRTILNEIVPKRIREYIAMKAVDFFSSYFQSDFTFVIEQRWEFVENQTFRAAEVYLPTCLAGLSTGKLLVGSSNLKNPAAEPKLGIPVNTKIIDNFEGIHLEWTLHSVETKKYLPEKRYFHLTCKKEFREKIMTDYFTYLAKSAEKIMSHRENLKIYTYNQDRSKWESAIFEHHTTFETLAVEPDLKKTLIDDLDAFSKGKDFFKSVGRAWKRGYLLYGPPGTGKSSMVAAIANHMKYHIYDLQIQSVRDDGELREILTSTKNRSILLIEDIDCGADASRRRQSKKKEEDGGEDDGEPQKRKKKFEVGISLSGLLNFVDGLWSSCGEEKIIIFTTNHKEKLDPALLRPGRMDVHILMDNCTPFVFKKLVALYLKTDEHVLFDPIEKLILEVSSTPAEVTQQLMASKNADIALKGLAEFLENKKLKKGEDSSVEEEGEIEDAETKEAET

SEQ ID NO: 243 - protein, 484 aa, Arabidopsis thaliana
MGKDKTLPLLDPREPPELTGTKSASKVWAKEFGEESKRLWELAGPAIFTAISQYSLGALTQTFSGRLGELELAAVSVENSVISGLAFGVMLGMGSALETLCGQAYGAGQIRMMGIYMQRSWVILFTTALFLLPVYIWAPPILSFFGEAPHISKAAGKFALWMIPQLFAYAANFPIQKFLQSQRKVLVMAWISGVVLVIHAVFSWLFILYFKWGLVGAAITLNTSWWLIVIGQLLYILITKSDGAWTGFSMLAFRDLYGFVKLSLASALMLCLEFWYLMVLVVVTGLLPNPLIPVDAISICMNIEGWTAMISIGFNAAISVRVSNELGAGNAALAKFSVIVVSITSTLIGIVCMIVVLATKDSFPYLFTSSEAVAAETTRIAVLLGFTVLLNSLQPVLSGVAVGAGWQALVAYVNIACYYIIGLPAGLVLGFTLDLGVQGIWGGMVAGICLQTLILIGIIYFTNWNKEAEQAESRVQRWGGTAQE

SEQ ID NO: 244 - protein, 441 aa, Arabidopsis thaliana
MGISKDRIKFNVGGRLFETTATTLANAGRDSFFGALFDDEWNLSPLEDSILFVDRNSDCFAVLLDLLRTGDLNVPANIPERLLHREASFYGLLDHVRTAKWGPFDGNRLRLSDSVKGIAPGDGTAIRAGPDGGCCVAHGSVVHVFDWMLEEHSPINLDYQRVNDVGWIDSDNIVLSACEKLGRGDGGMGLFSSSSGDLRYKFQVCHENQVKSYTAGALSFSPDYEIFASCKGRSNEYGIGVWDQITGKQTDFFYESPGWSLGDADKLQWLNGKNCLLVATLFPRKDNCYISLLDFRDKNMVWSWSDIGSPMAIDEKRVRDAIAMEDSNSICVVNEFEDLGFIDLRMYGGSVRWSSRSKLMKSKMPDEPCYPKLALHEGQLFSSMNDSISVFCGPDWVLTSRLRRSYGGSICDFSIGGDRLFALHSEENVFDVWETPPCPII

SEQ ID NO: 245 - protein, 443 aa, Arabidopsis thaliana
MTMKVETISKEIIKPSSPTPNNLQTLQLSIYDHILPPVYTVAFLFYTKNDLISQEHTSHKLKTSLSETLTKFYPLAGRITGVTVDCTDEGAIFVDARVNNCPLTEFLKCPDFDALQQLLPLDVVDNPYVAAATWPLLLVKATYFGCGGMAIGICITHKIADAASISTFIRSWAATARGENDAAAMESPVFAGANFYPPANEAFKLPADEQAGKRSSITKRFVFEASKVEDLRTKAASEETVDQPTRVESVTALIWKCFVASSKTTTCDHKVLVQLANLRSKIPSLLQESSIGNLMFSSVVLSIGRGGEVKIEEAVRDLRKKKEELGTVILDEGGSSDSSSMIGSKLANLMLTNYSRLSYETHEPYTVSSWCKLPLYEASFGWDSPVWVVGNVSPVLGNLAMLIDSKDGQGIEAFVTLPEENMSSFEQNPELLAFATMNPSVLV

SEQ ID NO: 246 - protein, 531 aa, Oryza sativa
MEAVGVAPAPAGVPEKKLLEVKESRKAAPAAPSTSMAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 247 - protein, 498 aa, Oryza sativa
MRIPTTETETGTGTRSHRRRKGSSDGSRAVHRTDASRRGPTPTKETEIPGRPPKRSSLTLSLDDAGASNPASTWAILNRYGARRDSFRGDDRDRTTSAVSYTSGGDQISVSFELVKPPETSLLTLDWPQGPRPSAGTTSYPYVIAAHDNVVLFQIISPDKYARPSAIDYFVYNANSSSSSNHHPSLTRLPVSYWRRRDTLRPRIMSREGTCILSCSNNSPSFVVAELERRSCQSSETNIYLFASGSDDWRVFRNVPIRHGDGLAHLCWWTTDAVLSYHNRYMIWVDYLVAGMIVAKVAHPGRVDPPEPVLWYVPLPVDPVDGNPYDIDRGRGCPQASRSVCATHHGIKFVNVNQHGGGSSSSSSSSRSFSITLWSWREEDQTWGEDATLDADQLRDLDSENRLPNIQPEFPVVDMENPYAVCFLLNERYHTADPNATTWMIKVHMKKKVLLDCTGYSNKGSPSTARRMSEGLSFISSEMPSYLSRKTIKRQEVDKLGI

SEQ ID NO: 248 - protein, 360 aa, Oryza sativa
MEVTPNHTQTVSGWAAMDESGKIVPFVFKRRENGVDDVTIKVKYCGMCHTDLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLVLVGAPEKPVELPSFPLIFGKRTVSGSMTGGMKETQEMMDICGEHNITCDIEIVSTDRINDALARLARNDVRYRFVINVGGDSKL

SEQ ID NO: 249 - protein, 433 aa, Arabidopsis thaliana
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 250 - protein, 122 aa, Triticum aestivum
MTASVSYGLRALPTWSSSVSGDDHCSALAMSVSARGPRSTRPLRTPARMGNVNEGKGIFAPLVVVVRNIVGRKRFNQLRGKAIALHSQVITEFCKTIGADPKQRQGLIRLAKKNGEKLGFLA

SEQ ID NO: 251 - protein, 316 aa, Arabidopsis thaliana
MAKTEAPSLVGKLETEVEIKASAGQFHHMFAGKPHHVSKASPGNIQSCDLHEGDWGTVGSIVFWNYVHDGEAKVAKERIEAVEPEKNLITFRVIEGDLMKEYKSFLITIQVTPKHGGPGSIVHWHLEYEKISDEVAHPETLLQFCVEVSQEIDEHLLSEEEEVKTTETLETEVEIKASAEKFHHMFAGKPHHVSKATPGNIQSCDLHEGDWGTVGSIVFWNYVHDGEAKVAKERIEAVDPEKNLITFRVIEGDLMKEYKSFVITIQVTPKHGGSGSVVHWHFEYEKINEEVAHPETLLQFAVEVSKEIDEHLLAEE

SEQ ID NO: 252 - protein, 432 aa, Arabidopsis thaliana
MASEDLNIVAESKKGEENVIVDNSKDMNRPENLDLSTEKTDTANENGPKDEASKLVKEADLPESGTSVKSKTAKDNKPVKRKSGTFSRSPRFMSQSSSFPTKGAYTDITRKSIDATTSKTSLKPVVAGGSKPKATPSSSSGVSAKRTSLVSAPLKKQTMPVKTISKDAASGPTSKLGDEGSKSIKEETAGKDVEEAGSTTAVVADKVSNPLKAEMASKDDEDTRSTTTSTSTPRGRRSSVGSASGFSFRLEERAEKRKEFYMKLEEKIHAKEVEKTNLQAKSKESQEEEIKRLRKSLTFKAGPMPSFYKEPPPKVELKKIPTTRPKSPKLGRRKSSSDATGGEAAPRVTKPKDSSSSTVKKPITKSQPKLETQEKSVKAKEKKKKVKKEEAEKRGEEEKATAVAAKPEEQKPNSNNIQVKAEIMASEVVVGG

SEQ ID NO: 253 - protein, 119 aa, Arabidopsis thaliana
MALFSSFSVSAFLLIVVSVQWTLVCSESTILASPAVLPYINAPDMSSFFPSPTKDWPIETATSPVPEPEAPGPSSGQLNGKISGRSMRLHPDISLVLAIVGICTFLCFNEPILVRFLHY

SEQ ID NO: 254 - protein, 276 aa, Sorghum bicolor
MVGPGLYAEIGKKTKDLLYKDYQTDHKFTLTTYTSNGVAVTASSTKKADLIFGEIQSQIKNKNITVDVKANSESNIITTVTVDEIATPGLKTILSFAVPDQRSGKVELQYLHDYAGVNASIGLTANPVVNLSAAFGTKALAVGADVSLDTATGNLTKYNSGLRFTHEDLIASLSLNNRGDSLTGAYYHKVSELTNTAVGAELTHSFSTNENTVTFGGQHALDPLTVLKARINNSGKASALIQHEWRPKSLVTISAEVDTKTIEKSSKVGIAVALKP

SEQ ID NO: 255 - protein, 489 aa, Oryza sativa
MPWVYHPQLELLAVPQQPESCPMAAAVTQPESPAMAGVDRLRLDGAMPPSYPSSWSVLPREVVVVDEIDDGEELRRWNILRCDRRAGYGVCEAVVEGVKLGARIVSDRGFSALCIIVSKAARAGTRGQVCAAVLAIKNHVIVLSVAFPRGDLFHSLKCACSSFYLVYDASDASITMIPDLQFSFHHHKVSSAVTKEPLPIACGVAHYLVLLGRAMTIKGMDQHIEDRVCLSPLQQSSLAHPSPSSSTNCSLWMTKSAIFPKEVVTRGFSANKMLSFDGLAMWVDLHQGILFCQHYDLFSNSNDSGSVPFYFVDLPPGCCNDDITTRPLSDSYPPEMYRSIVCVGDSIKFVTIEGYLRDSTAPIEDRMVTMWSLRPQESWSWRKDRDLSIGGICAQLFKKIPICATMLEPMPNMAPQSPILSTEDGSLHLLIVNDNSNEMLENQNIMVTVDMSKGYVISACLLPTDFGDQLPGLYGVMLPRMLGSNFFRF

SEQ ID NO: 256 - protein, 306 aa, Sorghum bicolor
SPSNSTNSSTSERIVDLQQKVGDCEIDLSMLTREDKIASGSSADLYRGTYKGHDVAIKCLRSANLSNPSQVEFLQEVLILRGVNHENILQFYGACTKHPNYCIVTEYMPGGNIYDFLHKQNNFLELHKILRFAIDISKGMDYLHQNNIIHRDLKSANLLLGYDQVVKIADFGVARLGSQEGQMTAETGTYRWMAPEIINHKPYDYKADVFSFAIVLWELATSKVPYDNMTPLQAALGVRQGLRLDIPASVHPRLTKLIRQCWDEDPDLRPTFAEIMIELQDILHYIQAPKGPSRRSRAKMQKKSEG

SEQ ID NO: 257 - protein, 343 aa, Arabidopsis thaliana
MAESSGSWRDSYKGMSSDNIKGLVLALSSSLFIGASFIVKKKGLKKAASTGTRAGVGGYSYLYEPLWWIGMTTMLLGEIANFAAYAFAPAILVTPLGAVSIIISAVLAHIILREKLHIFGILGCALCVVGSTTIVLHAPQEREIDSVIEVWNLATEPAFMFYASLVIGAAVFLIIRFVPQYGQTNVMVYIGICSLVGSLSVMSVKALGIALKLTFSGTNQLFYPQTWIFTLVVLTCVVTQLNYLNKALDTFNTAIVSPIYYVMFTSLTILASVIMFKDWDRQNGTQIVTEICGFVTILSGTFLLHRTKDMVEGSSVILPLRISKHINEEEGIPLRRQESLRSP

SEQ ID NO: 258 - protein, 753 aa, Arabidopsis thaliana
MVSVGSKSLPSRRHRTIEEDSLMGERGKSSNNHSERNKGMRRKDHKGNRGFDVDSSKKNQSGGAPNVKPASKKHSEFEHQNQFVRKEIDPETSKYFSEIANLFDSNEVELEERSVICGNALEETRGREYEIATDYIISHVLQTLLEGCELDQLCSFIRNSASVFPAIAMDRSGSHVAESALKSLATHLENPDAYSVIEEALHSICKVIVDNPLDMMCNCYGSHVLRRLLCLCKGVSLDSPELYGAKSSKALAKRLNLKMSQLDDNNLEIPHQGFPGMLTYLLSGLLSCSREDMKYLQVDQYSSLVLQTALRLMLKQDEQLLEIIPLILRCNSTNKKVEGFHIETNVAKEILESMKDNSFSHLVEVILEVAPESLYNEMFNKVFKNSLFELSVDRCANFVIQALISHARDQEQMGIMWEELAPRFKDLLEQGKSGVVASLIAVSQRLQSHENKCCEALVGAVCSTNESRISILPRLLFLDYYFGCRDKSTWEWAPGAKMHVMGCLILQGIFKFSSDHIQPYITSLTSMKAEYITETAKDSSGARVIEAFLASDAATKQKRRLIIKLRGHFGELSLHTSGSFTVEKCFDACNLTLREAIASELLDVKVDLSKTKQGPYLLRKLDIDGYASRPDQWKSRQEAKQSTYNEFCSAFGSNKSNFPKNTFVSDASEDAAQEIEVKNTRKEIDHHPTSGFKRHREKHAKDKDEPFAGEKRSKQKKNKTSEATDKPKLAGSKRPFLSGEMTGKNRHSNKMRI

SEQ ID NO: 259 - protein, 374 aa, Sorghum bicolor
MDEHMGRRTVGGLLFTKGGSILLFREDGSRPKSKNCCSRHGCSGQHSADKAKGKEVHRAAAPNESTPATPGRSQIFRKPNRKPPHESSASGSISRDAGGSCSETGNRSRDTPGPGRDLLARLKERVNTSRKRSLNRENSPQSPSGFSAGSPSNSRSVSRPSHRAASRIRKADEGAANAGADGVRRNGAGDARRSSERSDDDLLLVEQVTRNHVPSEGFLSGFMARYRSGLQGDLSSLDDSMEDSNGYLRFDVGGIEELENYFIFNDRHRGMRMDIDGMSYEELLALGERIGTVNTGLSDNALSTCLNRSLYMPTASGSHEDCERKCSICQEEYLAGEEVGKMACKHYYHLSCIQHWLRQKNWCPICKSVALKIN

SEQ ID NO: 260 - protein, 370 aa, Oryza sativa
MAAMARHLPAILLLSSALLLALASASASAAAPALAAFVDAASRRYLRDQQHHDQAASMSLDQVSAAVSVLLGFAPPPSLPAQSSSKLDKLLLPNPFDRPRAVFLLQIDGFHASVESITSEAGSIFKTTIDGLSDSATGLTDKDDLVIVHSDESPAVDSGSEYFDSDLTDLANWLGGSYEKVDGKLIIPLESGESLTLLITKEADMEFASSLISLRKTIKRGIQVHEDFSGGVMSPAELLVCHFKGIKALEEEYGSTEIVKQGTDVVRTAVTKAFDLLRGAYNGKIVGLVISTKEASPSLVGPASSLHISRWLKETSQTNTTIASSEILVRKSLAWITGIILLVSTLIGVCLLMNMPLTRDTLLYSNVKID

SEQ ID NO: 261 - protein, 201 aa, Sorghum bicolor
MAAEAGKTTAATKSGGGGQIMTVVRGLDVARYMGRWYEIASFPSFFQPRDGRDTRATYRLLEDGATVHVLNETWSKGKRDYIEGTAYKADPNSDEAKLKVKFYLPPFLPVIPVVGDYWVLYVDDDYQYALVGEPRRKNLWILCRKTSIDEEVYNQLVERAKEEGYDVSKLHRTPQDDPPPESDAAPTDTKGVWWFKSLFGK

SEQ ID NO: 262 - protein, 172 aa, Sorghum bicolor
MSYRLGEAAGREEGDEEPFETASSVSSGDSDSDDEEEGDQFPGGGGGSVAGGEASCDHQDRRAFVPQPLRRMNSDSIYDMTSMMSQLPAKKGLSRYYEGKSQSFACMSEVRCLEDLRKKDNPYKQKIKSCKSYVALGGMMAKKQPASTSCVNLDLVAANGFRTPPIRNGYHQ

SEQ ID NO: 263 - protein, 576 aa, Sorghum bicolor
MPDWRVREFEGKFTDEFAHSNGKEHEGGVEAPGVTSSKKLKHAVANEKAQGPIPRTNSSDSQKCNLEDNQCENGIVSQNINSAADCIGDCKNGSNAFLSREENTIVETRCPTDNWNSCQFALSNGSSILNNHSAPQDSLTYGDNDLNYIDWPGIDNFEDVDTLFRSSDSTYGQQQLENADGLSWIPSSDAVYSSDVAMQQGFDSSYSDYGILDDLSAFHCAEDKSLPSVDPSSALCDNQFNDTYLFSEQKNVNAYGEQIYQEDVMELLPTDQICSGHENIDMLQVGNQYSSENAIQGIEDKKFSIASTSQLSSSQNLLNQRHHLNSSSPSNITSESYAEKFGPSSGSFAQRNSKAQKKTLNMQPRQPTNDNDINRHPQTLTRRASYPCENYETERKGLGKRTLGDPQVTMGTSMVVDGSFVSSVSSDNSVEESSFRQLQDAVSQLDVQTKLCIRDGLYRLARSAQHRQVFPNMMNNNGDSQDVKDLQNAETSHKFVDPRSIETQTNPIDRSIALLLFHQSSDQAAVAVDDASSLKSPAGNKQHPGPASNQGLMPASSVYSPGGQGTPKDVQSLDKY

SEQ ID NO: 264 - protein, 171 aa, Arabidopsis thaliana
MEASVHNYSRSPGFYVEKILKVSIKRIEKKKENRYVTAFFSTLLFTCRNIIGYTFSNSKEVVDYVADISPLLCLSFILDGLTAVLNGVARGCGWQHIGALINVVAYYLVGAPVGVYLAFSREWNGKGLWCGVMVGSAVQATLLAIVTASMNWKEQAEKARKRIISTKNGLV

SEQ ID NO: 265 - protein, 444 aa, Zea mays
PRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 266 - protein, 256 aa, Arabidopsis thaliana
MLVLRTPTGPVSAVRFITKSKPSPFSSPDSWLLPAPNTHRSRPRVVLALSNPDGSVNSKPSTSASQIPSSGDETVFVGQDNVPLEGVIQFDKPSSTSSSNITKWGRVALLAGGDVLALLIFSAIGRFSHGFPVFSLDTLHTADPFIAGWFLSAYFLGGYAEEGRGMKGKSKAVVAAAKSWIVGTPLGIIIRSASSGHIPAYSFVLVTMGSTAVLLIGWRALLFSVLPTESKKKDDTYRKGSAFELFELLTSLIRRW

SEQ ID NO: 267 - protein, 529 aa, Sorghum bicolor
MGKGIYRVVHIPEDESVLLNSREKAPYLICVEVLKAEAPSHSKGSSDGHKLSKGGIPLANGDVQLPKPPPWAYPLWSRHDTQNYETDRMLKSTSQVIDQAMAQLWETKVKFVNVSFSIEKLGRSRSIALSETGRRLRHDAIDSHEPPGDSQTVADQPIEWVKVTLSAVPGVNMEDVDDNEPTRKKDHRRIPSTIAIEEVKAAALKGEAPPGLPLKGVGQSTQNLDPKATDGGDPKPTDALAGELWAVKRERIRRSSVHGKSPGWDLRSIIVKSGDDCRQEHLAVQLVAHFYDIYQEAGLPLWLRPYEVIVTSAYTALIETIPDTASIHSVKSRFPNISSLRDYYVAKYEENSPNFKLAQRNFVESMAGYSILCYLLQVKDRHNGNLLIDEEGHIIHIDFGFILSNSPGGVNFESAPFKLTRELLEVMDSDAEGTPSEFFDYFKVLCIQGFLTCRKHAERIILLVEMLQDSGFPCFKGGPRTIQNLRKRFHLSLTEEQCVSLVLSLISSSMDAWRTRQYDYYQRVLNGIL

SEQ ID NO: 268 - protein, 385 aa, Gossypium hirsutum
  misc_feature (36)..(36): Xaa can be any naturally occurring amino acid
  misc_feature (108)..(108): Xaa can be any naturally occurring amino acid
  misc_feature (236)..(236): Xaa can be any naturally occurring amino acid
MGKKLAAFLGRGFKPSKFKSLVTLAISRLAVFKNQXQIRCNQARSDVVQLLQLSHHDRALLRVDQVIKEQNMLDVFVILEGYCNLVIERLHLIEQDRVCPDELKEAIXGLLFASSRCGDFPELLEIRAVFTSHYGKEFAARAIELRNNCGVNAKIIQKLSTRQPDLQSRRNVLNQIAAEYGIALQLEETTDSSEGNLDVSKKQETSVKASHDAGDDDEFSDSIKTRRKYRDVADAXQAAFESAAYAAAAARAAVELSRSDSYDPDDQNGPNTRQNTVFDKQEANSKDMENHGSQAVELNHTKKAPEIKMSSPSSEGSAEGIIDLRTMSFDEVDPLKLLEKEVVIYESDDDKYDSRGSSFDLNARKLKGKVLDTDNDGEHSEKKLD

SEQ ID NO: 269 - protein, 277 aa, Sorghum bicolor
MLTREDKIASGSSADLYRGTYKGHDVAIKCLRSANLSNPSQVEFLQEVLILRGVNHENILQFYGACTKHPNYCIVTEYMPGGNIYDFLHKQNNFLELHKILRFAIDISKGMDYLHQNNIIHRDLKSANLLLGYDQVVKIADFGVARLGSQEGQMTAETGTYRWMAPEIINHKPYDYKADVFSFAIVLWELATSKVPYDNMTPLQAALGVRQGLRLDIPASVHPRLTKLIRQCWDEDPDLRPTFAEIMIELQDILHYIQAPKGPSRRSRAKMQKKSEG

SEQ ID NO: 270 - DNA, 1279 bp, Theobroma cacao
aagtactatcctgctaaagaaaatggatgcttatagcacaaggttactgtttttggtctttgcatttgcgtcagtaagcagagggtatgcacaacagtcaactactgttgttccggcaatcataacctttggagactctgtggtagacgtcggcaacaatgactacctccccaccatcttcaaggctaattaccctccttatggaagggacttcgacaatcatcagcctactgggaggttttgcaatggaaaattggccactgacatcactgctaaaacactggggtttacaacctatccaccggcttatcttagcccagaagcatcagggaagaaccttctcatcggagcaaattttgcttcagctggatctggctatgatgacaatgcagccatgctaaatcatgctatcacattgacccagcaggtagagtatttcaaggagtaccaggcaaagctagcgaaggtagctggcagtagcaaatcggcttccataatcaaggatgctttgtatgtattgagtgctggaagcggtgactttctccagaactactatgtcaaccctttaattaaccatgtctatactccagaccagtacggctcaatccttattgatgccttcacaagctttgtcaagaacttgtatggcttgggagccaggaaaattggagttacttctctcccaccgttaggttgcattcccttagcaagaacrttgtttggttaccacgagaagggatgcgtctccaggttcaatacagatgcccagcaattcaataaaaagctcaactcggctgcagccaatctccagaagcagcaccctggtcttaagattgtggtttttgacattttcaaggcactttatgatgttgttaattctccttcaaactacggtttcgtggaagcaacaagaggctgctgtggaacagggacagtggagacaacctcattcctgtgcaatccgaagacaccaggaacttgtcccaatgccacccagtatgtgttttgggacagtgttcatccatctgaggctgctaatcaggtccttgctgatgcattgattactcagggccttgcccttgtttgattcagaagacacatatctacttgcccttcgaaactgtactaagcttgctagtactcttttactattaccttaatcaaaaacttattcatattgcatwcgsttgtytctttaatmamgtgtgccagaaaattcaatatccwtcaagatgatttcwtttagtttggtgacatacggttaaagaaattgttacca

SEQ ID NO: 271 - DNA, 1424 bp, Gossypium hirsutum
cattccgtcggcttataaggcctaagtcaatgctcaaagcttccccaatactatcccctggtgaaagtgaaaatggaggtttacagcagaaggctgatgtttctagtgtttgcatttgcattagtaagtatagggtatgcacaagagtcgaactcgaccactctggttccagcaatactgacttttggtgactcagtggtagatgtgggcaataatgattatctccccaccatcttcagggctaattaccctccttatgggagggacttcgccaaccaaaagcctaccgggaggttttgtaatggaaagttggccactgacatcactgctgaaactctggggtttactacttatccaccagcatatttaagccctgaagcatcagggaacaaccttcttattggagccaattttgcttctgctggatctggctatgacgacagagctgcctctttgaatcatgctatcacgttgagtcagcaagtagagtatttcaaggagtaccaggcaaaactagcaaaggtagctggtagtagcaagtcagcatccatcatcaaggatgcactctatgtattgagtgctggaagcggtgactttctccagaactactatgtcaatcctttggttaaccatgcctatactccagaccagtatggctctttccttattgatgccttcacaagattcgtccagaacgtgtatggcttgggagcgaggaaaattggtgttacttctcttcctccgttaggttgcattcccttagcaagaacattgtttggttaccatgagaagggatgtgtgagcaggttcaataccgacgctcagcaattcaacaaaaagctcaacgcagcagcaaccaatctccagaagcaacaccctgatctcaagattgtggtttttgacatttacaaggcccttcttgatgttgttaataccccttcaaactatggtttcgtagaagcaacgagaggctgctgtggcacagggactgtagagacaactgaattcttatgcaatccgcatacactgggaacttgtcccaatgcctcccagtatgtgttttgggacagtgttcatccatcgcaggctgctaatcaggtccttgcagatacattgattgttcagggcattcccctcctttgattcgccaggacaccgtgtctacttgccctttttaaactgtactaagctctgtcactactcctttttctattatcttaatcaaaaagtgactcgtattgtagaagcttgtatttgtagttaaaccttcctttttcctcaacgtatatttctttttagattatttacaattcctaaatgtatcttaggaccaagaaaatgtgatacagctacagtgttgggaaaaaaatgaacaacaaagaaaaagatgtagaaggaaataagaaagaagaaaactgtttttt

SEQ ID NO: 272 - DNA, 1008 bp, Prunus dulcis
actttggcttctttgggattagaaattttccgaaagctgaagtgaacggagtggaagcaaaagtaaaggtaggtcttcaaatttaagatggggagaggaaagattgagatcaagaggatcgagaacaccacaaaccgtcaagtgaccttctgcaaacgaagaaatggactgctgaagaaagcttatgagctatccattctctgtgatgctgaagttgccctcattgtcttctccagtcgaggccgcctctacgagtactccaacaacaacataagaaacactatagaggggtacaagaaggcttgctcagatagctcaggttcaacctccattaccgaaattaatgctcaatattatcaacaggaatcggcaaagctgaggcaacagattcaaatgctgcagaattccaacaggcacttaatgggagatgccttgagtactttgagtgtgaaagagctaaagcagctggagaataggcttgaacgaggcattaatagaatcaggtccaagaagcatgaaatgctgcttgcagaaattgagtacttgcagaaaaaggagatcgagctggaaaacgaaaatgtgtgtcttcgaactaagatttcagaagttgagaggcttcaacaagcaaacatggttgggccagagctgaatgcaatccaggcattagcttctcgcaatttctttagccaaaatatgatggagggtggagcaacctacccacagcaagacaagaagattctccatcttgggtaagctttgtggagagagattcagcaaatgctagctcaatattattcaaaataatgatgtcactgcctactgtttttagtagcgttgtgtgtccaatagttctggaacattgccatttttagaaactgctgagcacttaattagcatatgcttgctgcatatgaacatggaaatgtatttggaaagattgttatatgacttggttcaatctccagaataattactttagtaaggctggtaattcagtaagtttaccgc

SEQ ID NO: 273 - DNA, 1033 bp, Malus domestica
ggaggacttgcccataagctttggcttctttgggatcagaagttttccgaaagctgaggcagaaggttggttcgttcttggatctgatcaaagtaatcagatattaagatggggaggggaaagattgaaatcaagaggatcgagaacacgacgaatcggcaagtgaccttctgcaaacgaagaaatgggctgctgaagaaagcatatgaactatccattctctgtgatgctgaagttgccctcattgtcttctctactcgtggccgtctctacgagtactctaacaacaacagcataagaaacaccatagagaggtacaagaaggcatgttcagatagcacaggatcatcctctgttactgaaattaacgctcagtattatcaacaggaatcggcaaaactgaggcaacagattcaaatgctgcagaactctaacaggcacttaatgggagatgccttgagcactctgactgtgaaagaactaaagcaggtggagaataggcttgaacgaggcattactagaatcaggtccaagaagcatgaactgctgcttgcagagattgagtacttccagaaaaaggagattgagctggaaaacgaaaatgtttatcttcgaactaaggtatcagaagtcgagaggcttcaacaagcaaacatggtttctgggtcagagatgaatgcaatccaggcattagcttctcgccatttctttagccagaatatgatcgagggtggaggagctaccttcccacagcaagacaagaagaacctccatcttgggtaactaattagctttttgaaggcagaatcttcaaatgcaggaaatgctacctcaatcatcttaattatatccagataataatgatgatatatcttctcttatgctgaacaacttttctaattactagctttattatgtatttgtaaggattgtaatatgactttggggtttagtacccagtactacccagaataattactactacactatgatctggtattcaataagtttaaattaattagcttaaaaaaaa

SEQ ID NO: 274 - DNA, 1029 bp, Phaseolus coccineus
atagtgcagtttgatttctttgggatcacaaatttttccgaaagctgaacttgccggagtgagacacaggaacagttgaagaatggggagaggaaagattgaaatcaaaaggattgagaacaccacaaatcggcaggtaaccttctgcaagagaagaaacgggcttctgaagaaagcttatgagttatcagtgctgtgtgatgcagaagtggctctcattgtcttctccagccgtggcagactctatgagtattcaaacaacaacataagatcaacaattgagaggtacaaaaaggcatgttcagatcattcaagtaccagcactacgaccgaaatcaatgctcagtattatcaacaagaatctgcaaagctgagacagcaaatacagatgctgcaaaattcaaacaggcacctaatgggtgatgctttaagcacattgactgtgaaggaacttaagcagttggagaatagacttgaaagaggaatcactagaatcagatctaagaaacatgagatgctactggcagaaattgaatacttccagaaaagggaaattgaactggaaaacgaaaatctttgccttcggactaagataactgacgttgagaggattcagcaagtaaacatggtttctggaccagagctgaatgccattcaggcattagcttctcgtaacttcttcaatccaaacatgatggagggtggatctgtttaccctcagtcagataagaagattcttcatcttgggtgatgaatatataatattagccaactacggctaaatgcattgttactacttcttcttcgattgctcattattagaccaactcatctcttttaaattctctttttcaatatataatatatatggatacttatattattatatatatgtattgatgattctatcatatataaccatctatgttgctagaacaataattaaaaaatagttgtgtatgaagacattaagctattattatggcattttatgaacgacttcttttttttttttgctaaatattagtc

SEQ ID NO: 275 - DNA, 1122 bp, Theobroma cacao
cggggactctctcttttataattatctttagctttagctccctctactctatattgacaaagaaagaaaggggctatcagtcgtttccagagagcaagtgtggaaaaaaagtcgaaacactttgccttctttgagattcggaattttccgaaagctgaagtggccggaagtgtggccaaagctcagggttttataggaagtgatctgtgacaatggggagaggaaagatcgagatcaagaggatagagaacaccaccaaccgtcaggttaccttttgcaagcgcaggaacgggctgctcaagaaagcttatgaactgtcagtcctttgcgatgcagaagtagctctcattgtcttctccagccgtggccgcctctacgagtactcaaacaacaacataagatcaacaatagagaggtacaagaaggcatgttcagatagttcaaacacaaactcggttattgaaatcaatgctcagtattatcaacaagaatcagccaagttgagacagcagattcaaatgcttcagaattctaacaggcacctaatgggagattccttgagttccttaactgtgaaggagttaaagcagctagagaataggcttgaacggggcattactaggatcaggtcaaagaagcacgaaatgctgctagctgaaatagagtatttgcagaaaagggaaatcgagttggaaaatgaaagcgtttgtctccgaaccaagattgcagaaattgagaggctacagcaagctaacatggtaactggaccagagctaaatgcgatccaagcattagcttctcgcaatttcttcagcccaaatgtgattgagggaggaactgcctactctcatccggacaagaagatcctccatcttgggtagagatcagttggacaacaaatctggcaaaatggtgttttgatataataataaataagcatttgaaccgtatgtaaaaggatcatgaagttcttgtgatgtagctctttacttgttatgtgcttgatttggagtagcactcttgacttytaaaatatatgacgcatatggagtgtggagtatggacatgtttagtttgcttttattaactaatgccatggaccagataccatcaattatgtya

SEQ ID NO: 276 - DNA, 1296 bp, Citrus sinensis
ggggatataaaacacacattgattttggttttctatttttcttcgggattctaaattttccgaaagctgaattggccggactgtggccaaaaaactcaggtccaatggggagaggaaagattgagatcaaaaggatcgaaaacacaacgaatcgtcaagtgaccttctgcaagaggagaaatggactcttgaagaaagcttatgaactttctgttctttgtgatgctgaagttgccctcattgtcttctccagccgcggccgcctctacgagtactccaacagcaacataaggtcaacaattgataggtacaagaaggcatgttcagataattcaaattccggcactgttactgagatcaatgctcagtactatcagcaggagtcagcaaagctgcggcagcaaattcaaatgttacagaattctaacaggcatttgatgggtgattctctgagttctttaactgtaaaagagcttaagcaactggagaacaggcttgagcgaggcatcactaggatcaggtccaagaagcatgaaatgctgctagctgaaattgagttcttgcagaaaagggagattgagctggaaaatgaaagtgtgtgtctccgatcaaagatagcagaaatggagaggtttcagcaagcaaacatggtgactgggcaagagctgaatgcaatccacgcattagcttcacggaatttcttcagccctgctatcatcgagggtggtgtcactgcttactctcacccggacaagaagatactccatctcgggtaagctagatactggagatcaagttgtggcatctcaacaaaagatctacgatcaaactatcattatctactgaatgtgtgtgctacttgatactatttttgaaaccagcgatatatgaaactggatgaatttgtctgtaacctaattacttacgctgaattatcactggcttcctctctttaggataccagttactatgcagaaacttaatacgttttataactgatgctgtatgatgttggaggatttgctctatctataaggtataaataaagattatgtcatatatgtataaatgaatattgtgcctgataagcttggtgtgaatcaaacaagggtcatacgtttggtggtttattgagagtctctcggatattagtctgtttgaatttttgggaaagtcatggttgttagaagggcatatcttgggttctatctgttacaaatgtggtatagcgttcgttaagagctcaatgaggagaaaaagagtcagatctctttggatccaccgtgtaagaaaaga

SEQ ID NO: 277 - DNA, 1373 bp, Gossypium hirsutum
ggcacgagctccctcaactctctcaaagcaagcattgtgaaacaaaaatccaaacactttggccttctttggaatttgtaattttccgaaagctgaagtggccggaactgtggcctaacctcagtaggaatatataaaagggtgaagatgggaagaggaaagatagagataaagaggatcgagaacaccacgaatcgtcaggttacgttttgcaagcgcaggaatgggctgctgaagaaagcatacgagctgtcagtcctttgtgatgcagaagttgctcttatcgtcttctccacccgtggccgcctctacgagtactccaacaacaacataagatcaacaatagagaggtacaagaaggcatgttccggtacctcaaacacaaataccgtcacggaaatcaatgctcagtattatcaacaagaatcagccaagttgaggcagcagattcaaatgctacagaattctagcaggcatctaatgggagattcgttgagttccttgacagtgaaggagttaaagcagctagagaatagacttgaacgagggattactagaatcagatcaaagaagcacgaaatgctgctagctgaaattgaatattttcagaaaagggaagttgagctggaaaatgaaagtgtatgtctccgagctaagattgcagagatagagagggttgaggaagcaaacatggtaacaggagcagagctgaatgctattcaagccttggcatctcgcaatttctttactccaaatgtgattgagagaggaactcccactccctactcccaccatgacaagaagattctccatcttgggtagagagagttggagagaacaaatctgaaaagggtgttgtgatattatgagattaaataaggatgcatttcaaccatatgtactctacatatattatgaagctgtcatgtaatttgttacttgttttgttctgttatattgtctcaaaacctatactagtagtaatgtgtttaattttgtgtgttaaattgattttttttatataaaaaaaaaaaaaaaaamwmmaraartctttaaagggssccgggsccctcrattttcccccgggggggggacmmgggaargggwccccatttcccccyaawaggggggcctattaaaatttcacggggccgcggtttttacaacccttcgggggcggggggaaaaaaccctgggcgttttccccaaactttaaacccccctttgtcaaccaccatccccccccttcttctcccccggcggggggggataaaaaataggaaaaagagaggccccgcccccccccgaaatccctcccccctttcccccaacaaaaggtttgttggccccccccccccgccggaaagaggggg

SEQ ID NO: 278 - DNA, 972 bp, Vitis vinifera
tttggcttcattgggatacgcgtttttgcacagcccgaaattttccgaaagctgaagtcgccggattttggaaacaagtgtagtgaacatggggagaggaaagatcgagatcaagaggatcgaaaacacgaccaaccgtcaggtcacattctgcaagcgaaggaatgggcttttgaagaaggcttatgaattatcagtgctatgtgatgcagaagttgccctcatcgtcttctccagccgcggtcgagtctatgagtactcaaacaacaacataaaatcaaccatagataggtacaagaaggccagctcagatagtacaaatggaggctctaccatggagatcaatgcccaatattaccagcaagaatcagcaaagctgcgccagcaaatacagatgctgcagaattctaacaggcacttaatgggtgattccttggcttccttgactgtgaaggagctaaagcagctcgagaacaggcttgaacgaggcatcacaagaatcaggtcgaagaagcatgagttgctgttggctgagattgaatacttgcagaaaagggaaattgagctggaaaatgaaagcgtatatctccgaaccaagattgcagaagtggagaggcttcagcaagcaaacatggtatcaacacatgagttcaatgccatccaggcattagtttctcgcaatttctttcagcccaatatgattgagggtggatccacaggctacccacttcctgataagaaggtcctccatctcgggtaaatgatgggagaaaatatccgccaacttcatctccttatgatgtttaaataaatcttttcccatgctatccaaactgttatgtaacggagaattaatgtcattgttgtatttggggtttctatgacttggtatttatccgctagcaaccagtactgttttgtataacattatgatatataatatagcctattaaaatatacaatattcctaat

SEQ ID NO: 279 - DNA, 944 bp, Lotus japonicus
aagctgaagttgccggagtctagatcacaggactacttcagaagatggggagggggaagattgagatcaagaggattgagaacacaactaatcgccaggtgacattctgcaagagaagaaacgggcttctgaagaaagcttatgagctatcagtgctgtgtgatgctgaagttgccctcattgtcttctccagccgtggccgcctctatgaatattcaaacaacaacatcaggtcaactatagagaggtacaaaaaggcttgttcagatcattcaagtacgagcactaccacagaaattaatgctcagtactatcaacaagaatctgccaagctgcgacaacaaattcagatgctgcaaaattcaaacaggcacttaatgggtgatgccttaagcaccctgacggtgaaggagcttaagcaacttgagaacaggcttgaaaggggaatcactagaattagatccaagccacatgagatgctactagctgaaattgaatacttccagacaagggagattgaactggaaaatgaaaatctttgccttcggactaagataactgatgttgagaggattcagcaagtaaacatggtttctggacaagagctgaatgccattcaggcattagcttctcgtaactttttcaatccacccatgattgaagatggaacttcctaccctcagcagcctgataagaagatccttcatcttgggtgatcratcataattgcagtggttatattatattactatatattatgtatccattttgctagaggctaaatgcattgttactactcttttaattgtgctcgttagcccaagtgaccgattacgtccttcactctatttttttgcaatatcttatatatgcgagtactggtgagtgtatgacgttgtgatwacatatcttgttagacataataataaaaaaattgtgttttg

SEQ ID NO: 280 - DNA, 890 bp, Medicago truncatula
gtgggattccaaacttttcccaaacctgaaactaagagtatagagttwtcagaaacataagatggggaggggaaagattgagataaaaaggattgagaatacaacaaataggcaagtgactttttgcaagagaaggaatggacttctgaagaaagcttatgaactatcagttttgtgtgatgctgaagttgctctcattgtcttctccagccgtggcagactttatgaatattcaaacaacaacataaggtcaacaattgataggtacaaaaaagcttgttcagatcattcaagtaccaccactaccactgaaattaacgctcagtattatcagcaagaatctgcaaagctgagacaacaaatacagatgctgcaaaattctaacaggcacttgatgggtgatgcattaagcacactcactgtgaaggaattgaagcagctggagaatagacttgaaagaggaatcactagaattagatctaagaaacatgagatgctactggctgaaattgaatactttcagaaaagggagattgagctggaaaatgaaaatctttgtcttcggactaagataaatgatgttgagaggcttcctcaagtgaacatggtttctggacaagagctgaatgcaatccaagcattagcatctcgtaattttttcaatccaaacatgatggaagatggtgaaacttcctaccatcaatcagataagaagattcttcatcttgggtgatgaataataaataatattagcatttgctatatgactacctatccaattagctattaatgctcattagcccaagtgaccaattaagtccttaaattttctccaatttattattatgggttttttttttgtgagggcatattatggactttatggatgg

SEQ ID NO: 281 - DNA, 1431 bp, Carica papaya
ctctgaaaccttattcaacattctaccattttagagttgtgagtttgaatttttttgcagacactaggttatgggatttatttatacatatttaatatctaatatttaatttttaataattttcttttagtttcaccttccattctgtatatctgctttgtatccattaaaaggatcagtactcaaaccactcctctcttcattcaccctctctacatcaaaacctttcttacttttctctgtctgcagatttataaagtcatttaatttttattatagctttcaagtgtataaatatatgtatctgtatatgcaaacccgtaacagatctgttctttctctctttttctatcttgaaagatgtttaagaacctttctcctccgcagaaattatatcttgtttctgggtttttttctcttctttcaaaaaatgtcacataaaacagatgatttagtaaaattttgcataaaacaacgaagttgaacattaaatttctcaaaactaacttactatcataattaattaacattcaagcaagaaagatatataatgaaaggtgatgggttttctttacaggttggtgcagaaatataaagaggatatatatatatatatatatatatatcggtgcttggaccatataagagaaaaataagatcaaatgggtagaggaaagatagaaatcaagcggatagaaaacacgacgaatcgccaagtcaccttctgcaagagaagaaatggattgctgaagaaagcttatgagctgtctgttctgtgcgacgctgaagttgctctcatcgtcttctcaagtcgtggtcggctctacgagtactcgaataacaacataagatcaacaatagaccggtataaaaaggcatgttctgatagctcagctacaacttctgttacagaaattaatgctcagtactatcagcaagaatcagcaaagctgcggcaacaaattcaaatgctacagaactctaataggcatttgatgggggattcgctgagtgctttaagcgtgaaggagctaaaacaactggagaataggcttgaacgcggcattacccggatcaggtctaagaagcatgaaatgttgctagctgaaatcgaatacttacagaaaagggagattgagctggaaaatgaaagcgtgtgtcttcggactaagatagcagaagtggagagatcactccaagtaaacatggttacagggccagagctgaatgcaatccaggcattagcttctcgcaacttctttattgagaacgaaactacctactcacacggccctgacaagaagattctccatcttgggtaactcgttggagacggacgagtctgccaattgcccctcaagatatatatatatatatatatatatatatatagactaaatatccatttgatttgatttcgagaacatgtat

SEQ ID NO: 282 - DNA, 859 bp, Populus trichocarpa
aagcacttctatttctttcagaattctacaaaataaattttccgaaagctgaagaggccggagtgtgaccaaattaagcctgcagacatgggaagaggaaagatcgagatcaagaggatcgagaacaccaccaatcgtcaggttactttctgcaagaggagaaatgggctcttgaagaaagcttatgaattatcagttctatgtgatgctgaagttgctctcatcgtcttctctagccgtggccgtctctatgagtacgccaacaacaacagcataagatcaaccatagataggtacaaaaaggccagttcagatagttcaaatgcatcctctatcacagaaatcaatgcccagtattatcaacaagaatcagcaaagctgcggcaacaaattcaaatgctacagaattctaacaggcacttaatgggcgatgctgtaagtaatttatctgtgaaagagcttaagcagctggagaataggcttgagagaggcattactagaatcaggtcaaagaagcatgagttgctgctagctgaaattgagtacttgcagaaaagggagattgagctggaaaatgaaagtgtttgtcttaggaccaagatagcagaagttgagaggcttcaacaagccaacatggtgactggagcagagctgaatgcaatccaggcattagcagcctctcgcaatttctttgctccacatttgcttgagggtggaactgcatacccacacaatgacaagaagattctccatcttgggtaaaaaaagaactattggagaactggtgtgcaagtggtattttgatatatatatatatgtaattcaatccagaaaataaagatactaccatattatctgg

SEQ ID NO: 283 - DNA, 1036 bp, Populus trichocarpa
cttttttcagaaatctaaacatttttccgaaagctgaagtggccggagattaagcctgcagacatgggaagaggaaagattgagatcaagaggatcgagaacactacgaatcgtcaggttactttctgcaagagaagaaatgggctgttgaagaaagcctatgaattatctgtcctttgtgatgctgaagtttccctcatcgtcttctctagccgtggccgtctctatgagtacgccaacaacaatataagatcaactatagataggtacaagaaggtcagttcagatagttcaaatactgcctctatcacagaaatcaatgcccagtattatcaacaagaatcagcaaagatgcgtcaacaaattcagttgctacagaattctaacaggcacttaatgggagaagccgtgagtaatctgtcggtgaaggagctaaagcagctggagaataggctcgaaagaggcatgactagaatcaggtcaaagaagcatgaattgctgctagctgaaattgagtatatgcagaaaagggagattgagctggaaaatgaaagtgcctatcttcgaaccaagatagcggaagttgagaggcttcaacaagccaacatggtcaccggagaagagctgaatgcaatccaggcattagcagcctctcgcaatttctttgctcctcattttcttgagggtggaactgcatacccgcacacttataacaagaagattctccatcttgggtaagaaactggagaactgatgtattttgatacatatgtgcaatccagaaaatgaagacagtacgatattatctgatagtgtgtgccctagttaagatcagtccttgaagtactgctggtcaatgtaagctggatgtgttctagctagataagatatcaacattattaattggcactgctttaatttgtatggattttttgtatgaactctactaaatcactgttgaaaggcagtggttatgctagttctagtctgaaggatttctatcagataaataaagttcatatatagatataaacat

SEQ ID NO: 284 - DNA, 1009 bp, Prunus persica
actttggcttctttgggattagaaattttccgaaagctgaagtgaacggagtggaagcaaaagtaaaggtaggtcttcaaatttaagatggggrgaggaaagattgagatcaagaggatcgagaacaccacaaaccgtcaagtgaccttctgcaaacgaagaaatggactgctgaagaaagcttatgagctatccattctctgtgatgctgaagttgccctcattgtcttctccagtcgaggccgcctctacgagtactccaacaacaacataagaaacactatagagrggtacaagaaggcttgctcagatagctcaggttcaacctccattacygaaattaatgctcaatattatcaacaggaatcggcaaagctgaggcaacagattcaaatgctgcagaattccaacaggcacttaatgggagatgccttgagtactttgagtgtgaaagagctaaagcagctggagaataggcttgaacgaggcattaatagaatcaggtccaagaagcatgaaatgctgcttgcagaaattgagtacttgcagaaaaaggagatcgagctggaaaacgaaaatgtgtgtcttcgaactaagatttcagaagttgagaggcttcaacaagcaaacatggttgggccagagctgaatgcaatccaggcattagcttctcgcaatttctttagccaaaatatgatggagggtggagcaacctacccacagcaagacaagaagattctccatcttgggtaagctttatggagagagattcagcaaatgctagctcaatattattcaaaataatgatgtcactgcctactgtttttagaagcgttgtgtgtccaatagttttggaacattgccatttttagaaactgctgaagcacttaattagcatatgcttgctgcatatgaacatggaaatgtatttggaaagattgttatatgacttggttcaatctccagaataattcctttggtaaggctggtaattcagtaagtttaccgc

SEQ ID NO: 285 - DNA, 1010 bp, Glycine max
ctatagcgcagtttcatttctttggattagaaatttttcccaaagctgatcgagaagccagccaggccagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagttgtgtttgaagacactaagttatcattatattaaggcattatatgaaccacttg

SEQ ID NO: 286 - DNA, 1038 bp, Glycine max
gggatggaagtggaagaaagtctatagcgaagtttcatttctttggattagaaatttttcccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcactaccacagaaatcaatgctcagtattatcaacaagaatctgctaagctgcgacagcaaatacagatgctgcaaaattctaacaggcacctgatgggtgatgccttgagcacactgactgtgaaggaacttaagcagttggagaatagacttgaaagaggaatcactagaatcagatctaagaaacatgagatgctattggctgaaattgaatactttcagaaaagggagattgagctggaaaatgaaaatctttgcctccggactaagataactgacgttgagaggattcagcaagtaaacatggtttctggaccagaactgaatgtcattcaggcattagcttcccgtaacttcttcaatccaaacatgttggacggtggaactgtttaccctcagacagataagaagattcttcatcttgggtgatcaataatatgatcttcgctatagcctataactatctatccaattagccggaggctaaatgcattattattactactcttttgattgctcattaactagaccaaatgatctatatacattacatatgaattatggattatggatacttatgtttaatgattgtatgatatcataacaatatgttagaaataataattaaaaagtagagttgtgtttgaagacactaagctatgattatgacattatatgaatcactttttattttatt

SEQ ID NO: 287 - DNA, 672 bp, Euphorbia esula
aaatataattaacttcgatctcttcagctcagctcagatgggaagaggaaagatagaaataaagagaatagagaacacaacaaatagacaagtgacattctgcaagagaagaaatggacttctcaagaaagcttatgaactatctgttctttgtgatgctgaggttgctcttattgtcttctccagtcgtggccgtctctacgagtactccaacaacaacataaaatcaactattgatagatacaagaaggcttgttcggatagttctaatactaattctatcacagaaattaatgctcagtattaccaacaagagtcagcaaagttacgtcagcaaattcagatgctccagaattctaacaggcatctaatgggagacgccttgagttcactgactgtgaaggagcttaaacaactggagaataggcttgaacgaggcattactcgaatcaggtctaagaagcattaattgctgctggctgaaattgagtacttgcagaaaagggaaattgagctggaaaacgaaagtgtttgtctccgaaccaagataggagaagtagagaggctgcagcaggcaaatatggtgagtggagcagagctgaatgcaatccaggcattaacctctcgcaatttctttggatctcaccacatgattaatgatcatgatcatga

SEQ ID NO: 288 - DNA, 2198 bp, Gossypium hirsutum
gttctctctttaattttacctcccattacccttttctacttaatctctcattgcttacttatattgtaagtgtgaccaaataaaccaagtacagaggctcaattcccaagatggaggccagcagcagcacctcccatgacccagcattgttccatgctcccttgctacaccaccctcggaggaggagcagcagacccttaaagggtttcgcagtgatatttgggtccgtcgttttcctactctcactggtcatattaatcgttaaccaaagcccggagccattagcaagtaaccccagtagtgtaacggaggcagggtcgtattcaatggcggcgcagccaagagggatagctgaaggagtttcagccaagtcaaacccatcactttttgacaaagttgggtttaattggacaaacgctatgttttactggcaaagaactgcctaccactttcagcctcaaaagaattggatgaatgatcctgacggtccgttatatcacaagggatggtaccatcttttctatcaatacaaccctgattcagccatatggggcaacatcacttggggccacgctgtatcaaaggacctcattcactggttctatctcccactcgccatggttcctgatcaatggtacgatatcaatggttgctggacggggtcggccactctccttccagatggccgaatcgtaatgctttacaccggcagcaccaatgagtccgtgcaagtccaaaaccttgcatatcccgccaacctatctgatcccctcctccttcagtggttaaaatacccgggtaacccggttgttgttcccccaaccgggatcgaagacaatgagttccgagacccgacaacagcttggcttggacccgatggttcctggcggattactgttggtacaaggtttaataccaccataggaacagcccttgttttccaaacgacaaacttttcggactatcaattattggatggggtcttacatgctgttccgggcacgggtatgtgggaatgtgtagatttttaccccgttgcaataaacgggtccgtcggacttgacacgacggcacttgggcctggaattaaacatgtcctgaaggctagtttggatgatacgaaagttgatcattatgcaatagggacctacgacatgataacggataaatggacacccgataacccggaagaagatgtaggcatcgggttgaaagtggattatgggagatactatgcctccaagacattttttgatcagagtaaacaaaggaggattctttatggttgggttaatgaaactgatactgaagctgatgacctcgaaaaaggatgggcttccattcagacaattcccaggagtgtgttgtatgacaacaagaccggaacccatttactacagtggcctgtggaagaagtggagagcttgagactgaatgctacagtgtttaaggatgttgtagttgaagcaggatcagttgtgcccctcgacataggcaccgctactcagttggatatattagcagagtttgaaatagagacgttggtatcgaacagcacggaggatgaagtcagtgattgcggtgatggggcggttgataggagcacttacgggccatttggggtcctggttattgctgatgattcactttctgagctcactcctatatatttccgtccacttaatatatccgatgggagtcttgaaacttacttttgcgctgatgaaacaaggtcttctaaagctcccgatgtcacgaaacgagtgtatggaggcaaagttccagtgcttgacgatgaaaactacaaaatgagggtattggtggatcattcagtagtggaaagctttggagaaggagggaggacggtgataacatcaagagtgtatccaacggaagccatatatggagcagcacggctgttcttgttcaacaatgcaagtggagtgaatgtgaaggccacactcaaaatttgggagatgaattctgcttttattcgtcctttcccctttgaagaaacattatttcaggaaatggttgcttccacatgattatcatttgggaagggtggatgcaatacatattactattagtattatgtttgcagtgcttaatttttttttattggttgggcattatccattcactttgttttgtcgcctggtatttgtttgagaataaatcactaaaattttgacatt

SEQ ID NO: 289 - DNA, 2161 bp, Theobroma cacao
cgcggggggttttcctttaaactccaaaccgaaaaaaaaaaaagragaaaccaccgagaacayatccaaagcatcaaaattttcctttgcatgctyttaaatttgatttcatggcaataacaagcacatcaaacagaaaagaaatggatcggatcaaaggtccatggagccccgaagaagatgacctgctccaaaagctggtccaaaaacacggccccagaaactggtctttgattagcaaatcaatcccgggtcgatccgggaaatcctgtcgcctccgatggtgtaaccaactatccccccaagtcgagcaccgggcctttacccccgaagaagacgagaccataatccgagctcatgcccggttcggtaacaagtgggccaccatagcccgactcctcaacggtcgtaccgacaacgccattaaaaaccactggaactcgacgctaaagcgtaagtgtttgtcggttggggaagagtgtaattttattactaacggagggtatgatggtaatttgagaggggaggagcaacagccgttgaaaagatcggtcagtgctggcctttacatgagcccaggaagcccatcgggatccgatgtgagcgattctagtgttcccgttttatcatcttctcacgtgtacaagccaataccaagatccggcggtgttaacgtcgacgtaaacgttgacgtcaatgttatgccagctggagtcgaagcggcgtcgtcttctaacgatccaccgacttcgctgagtctctctttaccgggggccgagtcatgcgaggtgtcaacccacccagtttctgaatcaaytcagatgaggaacgaagcgaaaaatgaagaaagggtaggtggggtgatggggttcagttcggaatttatggcggtgatgcaagagatgataagggttgaggtgaggaattacatggtgcagatgcagcagcaaaacggtggcgttgcgggrgggggaatggggatgtgtttggatggagggtttaggaatgttatggctatgaaccgagtgggggtgagtaagatcgagtagagagatgtaaagagttgcatgagaggtaaaagagagaaaaaactgggttgttttttcctaacatggcaaattagcggggaataattttggttaatgtacgacagactgagagagatgggttaaaaggaaaaaacgagtacaaagaaaaaatggacttttttttggttttttacctgtctcttggcctttgaaatttcaatytaagctcttttaatctcatttcttagtggttttttttttcttttcggtatctaaatataaataatttttatatgtaaaatgtaaagaatatggaaaggaaaaggattatggtaagatgggttttgcttcttatatcaggaactgaaaactagacagaaagattaccggaattacctattactaatattttctctgttcttattctatttggttttgtgggacatgatgttcttttttatgggtttaaggaagaaaaagatttggttaagaaaagcaaacgtgaccacaaaagggattttattttcttgaaataaatgaaaaggtcaaaaaaaaaaaatctcaaaagcaaactgtctactacttctactacaactgccaggttttaacctctttctgaaatttagtaacttccaaaattcgatttgtgttctctttgatcatagccaggaaaatttctggaaaatttctgggacacgttttggttgtttgattttgaataatcttttaaaaaacaggacaagaactacacgccaagaaaggaaaaagtaactgtaagaaaaaaaacagattttyttttaatttcaagttagtgaataatgctgctagcttattggtggatggtcaaggtcaacgaaaaatattycagatgtatccaaaatgctacagttggtgaaagatgagccgagcccagacctttttttaaagttccaagctacattttaaacaaatcaaaagaacaaattttgcatttaataaaaagctgcttggtctttgatgataagattaaatgatcagcatgggggtctggccgttatgaggtgaaagttgtttgcaagttgggaaaaaagaaaaataaaataaaacatggggcggtttggagaaaaaggttgtcgggacgaacgcccatggca

SEQ ID NO: 290 - DNA, 1256 bp, Gossypium hirsutum
  misc_feature (9)..(9): n is a, c, g, or t
tggcacgangggaaaaaagaaaaagccaaaaacccgatattatatccaaaagaaaccaaaattttatttgcatgcttttaaatttgatttcatggctgtaacaagcacatcaaacagaaaagaaatggatcggatcaaaggtccatggagccccgaagaagatgatttgcttcaaaaactagtccaaaaatatggacctagaaattggtctttgatcagcaaatcgatcccgggtcggtccgggaagtcctgtcggctccgatggtgcaaccaactgtctccgcaagttgagcatcgggccttcacccccgaggaagacgagaccatcatcagagctcatgcccgatttggtaacaagtgggccacaatagcccgactcctcaacggtcgtacggacaacgccattaaaaaccactggaactcaacgctaaaacgtaagtgcttgtcggttggggaagagagtaatttcattacacatggtgggtatgacggtaatttgggaggggaagggaagcaacaaccgttgaaaagatcagttagtgctgggctttacatgagcccggggagcccatctgggtccgatttgagcgattccagcgtccccgttttatcatcttcacacgtgtacaagcccatcccgaggaccggcggagtcagcgttgacgtcaatgttatgccattacctggggtcgaagcggcggcgtcttcttctaacgatccaccgacttcactgagtttgtctttacctggggctgaatcgtatgagttgtcagtttcaaccctcccagttaccgagtctactcagacgaggaacgaagcaaaaaatgatggaaagggaggcgaggtgatggggttcagtgcggagtttatggcggtgatgcaagaaatgataagaatggaggtgagagattacatggttcagatgcaacagcaaaacggtggcgtttcgagaggagagggaatggggatgtgtttggatgcggggtttaggaatgttttgtctatgagtcgagttggggttaataagattgactaaactccatattgtgaaaaaaaaaaacccaaaaaagaatggtcttttattttgttttggttttccccccttaataattgttatwaatgtamagaracaatgggaaaaaaaaattgggtgtttaaaagaaaaaattgtaaaaaaagaaaaaaaataaacggaactttttttaaaaatttaaaataggaaaaaaaaattcccccttttggatatttcccaaaaa

SEQ ID NO: 291 - DNA, 788 bp, Gossypium hirsutum
ctcccattacttggtttggccactttgatggtaaaaaagaaaaaagaggcagaaatttagagaagttgattcaaacagaaagggtgatggaactgagcattcagaaaacagaagccttgattaggctgagtacgatagtgatgctggttttaacagcttgtttaattgggttggattctcaaacaaaggtcatcttctacgttcaaaagaaagcttctttcaaggatttgcgtgctcttgttggattgctgtatgtcacatcattggctgctgcttataatctacttcaactatgctgttcttcattttacaaaggaacctcgctgcaatcttacgcatatctagcttggcttcgttatattttggatcaggcagtagtgtacgcagtgtttgcgggaaacctagcggcaatggagcattcatttttggtattaaccggagaagagaacttccaatggctcaagtggtgcaataaatatactcgattctgcacccaaatcggaggatccttgctctgcggcttcgttgcaagcttactaatgttttccatcgcttccatctccgcattcaacttgttcaggctttattcccccaccaagttcatgcacttgaaactctaatcgtaaattatggttaatgtggtattgaaaattttttaacttcataatttgattgatattttgccatataatttaaaatttttaaaaataaactatttgtgaagttaaaaattttcatgccaaataattacttatgttaatattattatttataaaagaaatgaaaaa

SEQ ID NO: 292 - DNA, 586 bp, Gossypium hirsutum
accatttaaactccaaacactagaagaaggtttagttttacaaacatggctagttccggtgtccttaagttggtttccatgattctcatcgtgtgcatggcggtgatgggtgcacccaaggctgccaaagccgccatcacgtgcagcgacgtggtgagccacttgatcccgtgcttgtcctacgtacaaaacggcggtacacccgctgctgcatgctgcagtggggtaaaaacactctacggccaggctcagacctccacggaccgccaagacgtgtgcaagtgcatcaaatcggcggtgaacggaatgccttacaccggctataacctcaatctcgcagccggcctacctgctaaatgtggtctccatcttccttacaacatcagcccctccactgactgcaacaaggtgcagtgaggttgatgatgatgatatggaagaaggagtgggagaaggtttcagctcagctagataaagtagctagctaaggttaaataagctgtgctggtgtgttgtttttcagcaaattccatgtataatcggggaaagaaaaagaaatagaagctgtactttctaactgtatttc

SEQ ID NO: 293 - DNA, 455 bp, Gossypium hirsutum
acaacctatagatttacaaacatggcaagttcgggagtccttaagttggtatgcatgattctgatggtgtgcatgaccatgatgagtgctccgaaggcaatgaaagccgcgatcacctgcggccaggtcgtcaaccacttgatcccgtggttgtcgttcgttgaaaacgggggtagacccgcagcagcatgctgcagtggcgttaaatcactgttcggcgaggttcagacgtccccggaccggcaaagcatctgcaagtgcctcaaatccgccgtgaacggtattccgtataccagcaataacctcaatctcgctgcgggcctacctgcaaaatgtggagtccaactcccatacaagatcagcccgtcgactgactgcaacaaggtgcagtgaggtggccttttaggccttaattaaggagtggaattcctggttccagctcagctagataaagt

SEQ ID NO: 294 - DNA, 1719 bp, Gossypium hirsutum
ctcaaattcatttcacttttaaataccaattaatattacttacacttacttcccctttacaaatagataatccaaaagcagagcaaaaacagagataaccattctttttcttttgttgttgttgttgtcgtcgtcatggcttctcttcctttcatcttcttcttatctttctttataatctccacaacattgacgtcagccggcgccgccgccgccaccatcaaactctccctctctcccttccctcacccttcttcctcccatccttaccaaattctcaacaacttagtcacttcttctgttgcaagagcccaccacctcaaacaccccaaagccaaggccgataatactacctcttctcttctcagggcttccctatttcctcacagttatgggggctacactatctccctcaaatttggaactccgcctcaaacccttcctttcattatggacactgggagcagcctctcctggttcccttgcacctctcgttacctttgttcccaatgcgctttccccaatgttgaccctgcaaaaatccccacttttgcccctaaacgttcatcttccaagaagctcgtaggttgcagaaaccccaagtgtagttggctttttggccccgacgttgcgtctcgttgccaagactgtgaacccacttccgaaaactgcactcaaacttgccctccttacctaattcaatacggtttaggttccactgctgggcttctattagtagaaaaccttgttttcccccagaaaaccttccaagatttccttgtcgggtgctccattctctccaaccgacagcccgctggaatagccgggttcggtcggagcgctgagtctttaccctcccaattaggcctcaagaaattctcttactgtctcgtttctcgccggttcgatgacaccggcgtcagcagcaacatgttgttggaaaccgggtcgggttccggtgatgccaagaccccaggccttagctacacaccgttttacaggaaccaagtggcttcaaacccaaatttcaaagagttctactacgtaactctacgtaaaattctggtgggagataagcacgtcaaagttccgtacagttatttggtcccaggatcagacggtaacggtggcaccatcgtggactcgggatcaacattcactttcatggatagaccagtgttcgaggtagtctcgaaagagttcgagaaacaaatgggaaattatataagagcgcgtgaaatagaaaacatatcgggtttagccccatgcttcaacatttcgggctatacttcaataaaattccccgaattgagtttccagttcaaaggaggagccaaaatggcattgcctttggttaattatttctcatttgtcggtgatgataaggttgcgtgtttgatgatcgtttcagacaatgtggtcggccaaggctcacacggcggtcctgcaataatactagggagctttcagcagcagaattattacatcgaatttgatatggcaaacaataggtttggatgggctgaacgaaggtgttagtgagctgcactttgttattttgtgttttggccttgaatatggaagtcatctttttcttttgcttctatttttaatggaatggtgacaaaagggttattagcttcttcttttttctgtcatttttaatcaaaaagtttgatgatattgaaaattttaatgcatcaatatactattataaca

SEQ ID NO: 295 - DNA, 1357 bp, Theobroma cacao
cgcggggatgtaatcgtaggtttcatagtctctttttctctctgtcttgctcttcttgaggtcttgctattgcatacactcggttctctatggaatttaatctctccccggttcttgcttttctggctctagcggtggtggtaagccatgctgctttatcacctgagcaatattggaactatgtgctgccaaatactccaatgccgaaggccgtcaaagttttgctacatcctgacttcatggagaacaaaggtacctctgtcaatgtagggggaggtggtgtaaacgtcaatacaggaaaaggaaagccgggtggtggcacctccgtaaatgtgggtggcaaaggtggaggagtatctgtgaacacaggacacaagggaaagccggtatatgttaacccaggaggatttatttacawttatgcagccaccgagactcaagtccatgatgatccaaatgttgctcttttctttctggaaaaggatatgcatcccagagcaacaatgaccctgcatttcactgaaaatacagagacggcaactttcttacctcgccaaattgcccaaaagataccattttcatctgacaagttgccagaaattttgaacaagttttcagtgaaacctggatcagcggaagctgagataatgaagaacacaattaaggagtgtgaacagccccaaattcaaggagaggacaaatattgtgcaacctcactagagtcaatgattgactttagtacttccaagatcgggaaaaatgcttacgcaatctctacagaggtgcaaaaacaaacccccgaacagaagtacacaatagcagctggagtgcagaagatgggaggtgacaaatctgtagtgtgccataagcagaattatgcatatgctgtcttctattgccacaaatcagaaacaacaagggcttacatggttcatttggagggtgctgacgggacaaaagccaaagcagtagcaatctgccacacagatacatcagcatggaacccaaagcatttggctttccaagtccttaaagttgagccaggaaccattcctatctgccatttccttcctcaggatcacattgtttggatccccaagtaaaagcctgaagagtacactgagaccctttaatttcatcagtcaactaagtatagtgtgcattaaaacagcttaaagccatatccagtttgttctataataatatacctcaaacccacgggtttagttatccmcaatctatttgttcacttttgtaatgaatgatgaatcatgtactcagtaatagataaaatggtgttactttttgtatcacaacggtttggtggtaaatctattagagttytatcccatgatga

SEQ ID NO: 296 - DNA, 1556 bp, Gossypium hirsutum
caactacatttctcattataaatgtggagaattcttgctctactttccattccatgcaacactagcttttagattccctttccattgcactgctctttctttctttagaattagtcactcctgttctagatgaaggttctctccccaattcttgcttgcctagcgcttgctgtggtggcaagtcatgctgctctctcacccgagcaatattggagctataagctgccaaatactccaatgccaaaggctgtcaaagaaattctacatccagaactgatggaggagaaacgtacctctgtaaatgtaggaggtggtggtgtaaacgtcaatacaggaaaagggaagccagggggtggcactcatgtgaacgttgggcgcaaaggagttggagtgaacacaggaaagccagggggtggcactcatgtgaacgttgggcgcaaaggagttggagtgaacacaggaaagccagggggtggcactcatgtgaatgttggaggcaaaggagttggggtgaacactggaaagccaggaggtggcacccatgtgaacgttggaggcaaaggtggaggagtatctgtacacaccggacacaagggaaagccagtaaatgttaatgtgagtccgtttgtttacaactatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcactgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaacgcagcagtatacaataacagctggagtgcagaagatgacaaatggcaaagctgtagtgtgccacaaacagaattatgcatatgctgtcttctattgtcataaatcagaaacaacaagggcttacatggttcctttagagggtgctgacggaacaaaagccaaagcagtagcagtctgccacacagatacatcagcatggaacccaaagcatttggcttttcaagtcctaaaagttgagccaggaaccattcctgtctgccatttccttcctcgggatcacattgtttgggtccctaagtaaaagtcctgaagagtagattcatacactatagtttcttcacagtgtgcattaaaacagcttaaagcaatatccagtttgttctataataatatacccacaagtttagtcatgtaaaatctatccatgaatcatgttcttagtaatggataaaatgatattactttctgtatcacaagggtttggtgataaatgtattagtattttaagtaacttttcagacatcgtattccaagtaa

SEQ ID NO: 297 - DNA, 1432 bp, Gossypium hirsutum
ccattccatgcaacactaacttttagattccctttccattgtactgatctttctttctttagaattagtcactcctgttctagatgaaggttctctccccaattcttgcttgcctagcgcttgctgtggtggcaagtcatgctgctctctcacccgagcaatattggagctataagctgccaaatactccaatgccaaaggctgtcaaagaaattctacatccagaactgatggaggagaaaagtacctctgtaaatgtaggaggtggtggtgtaaacgtcaacacaggaaaagggaagccagcgggtggcactcatgtgaacgttgggcgcaaaggagttggagtgaacacgggaaagccagggggtggcactcatgtgaatgttggaggcaaaggagttggggtgaacactggaaagccaggaggtggcacccatgtgaacgttggaggcaaaggtggaggagtatctgtacacaccggacacaagggaaagccagtaaatgttaatgtgagtccgtttctttaccaatatgcagccagtgaaactcaaatccatgacgatccgaatgtggctcttttctttctggaaaaggatttacaccccggggcaacaatgagcctgcatttcactgaaaatacagagaaatccgctttcttaccttatcaaactgcccaaaaaataccgttttcatctaacgagttgccagaaattttcaacaagttttcagtgaaacctggatcagtgaaggcagagatgatgaagaacacaattaaggagtgcgaacagccagcgattgaaggagaggaaaaatattgtgcaacctcactggagtcaatgattgactacagcatttccaaactagggaaagttgatcaggcagtctcaacagaagtggaaaaacaaaccccaacgcacaagtatacaataacagctggagtgcagaagatgacaaatgacaaagctgtagtgtgccacaagcagaattatgcatatgctgtcttctattgccataaatcagaaacaacaagggcttacatggttcctttagagggtgctgacggaacaaaagccaaagcagtagcagtctgtcacacagatacatcagcatggaacccaaagcatttggcttttcaagtcctaaaagttgagccaggaaccattcctgtctgccatttccttcctcgggatcacattgtttgggtccccaagtaaaagtcctgaagagtagactcatacactatagtttcatcatagggtgcattaaaacagcttaaagcaatctccagtttgttctataataatatacccacgagtttagtcatgtaaaatctatccatgaatcatgttcttagtaatggataaaatgatagtactttctgtatcacaagggtctggcgataaatttattagtattttaagtaacttttcag

SEQ ID NO: 298 - DNA, 1189 bp, Gossypium hirsutum
cctgtttccatttacttcacctagttagtgctttatattgatcatctccctcattcttctcaactcacacaccttccaatctttcattctttgctgttgaagtagtaatatctatagaagacggagatggagaggcaaagaagcaagcaggttcgtttgttgatgtgggttttggttgctgccttgttctcccacaacatggtcattgcagtgacctccactggccttggagagcagaaaaattactatccagttcctgaccctcatgctggaactcccccttcaggttcacatggcacaccaccatcttcaggaggtggaacacctccctctcatggaaccccatcacatggaggtggttaccacccttcaccaacaccatcaacgccttcgggtggaaattgtggaactccaccacatgacccttcaactccatcaacaccatcacacactccttcgcatggtactccaccatcatctggaggtggtagtcccccatcgtatggaggaggcagtcccccatcgtatggaggaggcagtcccccatcatacggaggtggcagtcccccatcatacggaggtggcagtcccccatcatacggaggtggcagtcccccatcatatggaggtggcagtccaactactcctattgatccaggaactccaagcattccctcacctccattctttcctgctccaactccaccaattggtggtacatgcgatttctggaggagtcaccccacactgatatggggtctgcttggttggtggggcactgtaggcaacgcatttggcgtgaccaacgttcctggacttggaacaagcatgagcttgccccaagcactttcaaacacacgtactgatggacttggggcgctttaccgagaaggaacagcctcatttctcaactccatggtgaataataggttcccattctcgactaagcaagttagggagacttttgttgcagcacttggttcaaacagcgctgcagcagctcagctcgtctcttcaagcttgccaatgaaggccacctcaagcaaaggacctaagcaaacacctttttggtttgtcagtttcttgaaccattttatccactaatgtgtgctacttaaattttatgttcctagaattccacatctataatgcttacagcttttcattttgggaaagaaaactggtgcct

SEQ ID NO: 299 - DNA, 1143 bp, Gossypium hirsutum
aatctttcattctttgctgttgaagtagtaatatctatagcagacggagatggagaggcaaagaagcaagcaggttcgtttgttgatgtgggctttggttgctgccttgttctcccaaaacatggtcattgcagtgacctccactggccttggagagcagaaaaattactatccagttcctgaccctcatgctggaactcccccttcaggttcacatggcacaccaccatcttcaggaggtggaacacctccctctcatggaaccccatcacatggaggtggttaccacccttcaccaacaccatcaacgccttcgggtggaaattgtggaactccaccacatgacccttcaactccatcaacaccatcacacactccttcgcatggtactccaccatcatctggaggtggtagtcccccatcgtatggaggaggcagtcccccatcgtatggaggaggcagtcccccatcatacggaggtggcagtcccccatcatatggaggtggcagtcccccatcatatggaggtggcagtccaactactcctattgatccaggaactccaagcattccctcacctccattctttcctgctccaactccaccaattggtggtacatgcgatttctggaggagtcaccccacactgatatggggtctgcttggttggtggggcactgtaggcaacgcatttggcgtgaccaacgttcctggacttggaacaagcatgagcttgccccaagcactttcaaacacacgtactgatggacttggggcgctttaccgagaaggaacagcctcatttctcaactccatggtgaataataggttcccattctcgactaagcaagttagggagacttttgttgcagcacttggttcaaacagcgctgcagcagctcaggctcgtctcttcaagcttgccaatgaaggccacctcaagcaaaggacctaagcaaacaccttttggtttgtcagtttcttgaagcattttatccactagtgtgtgctacttagattttatgttcctagtattcgacatctataatgctacagctttcatttggatagatactgtgcctagaactgaatgttaagtttatgttttcttattttaaataaaatttaagatatttgtttaaa

SEQ ID NO: 300 - DNA, 829 bp, Gossypium hirsutum
gagcagtgaagaaagatgatcaaaatgggttttattgttttggccttgatggtggtttccgccgcgacggtggttacggcggctgacgagagtgggttagcgaatgagtgcagcaaagatttccagagcgtgatgacttgcttaagctttgctcaaggaaaagcagcgtcgccgtcgaaggagtgctgtaattcagtggcggggattaaagagaataaacccaaatgtttgtgttatattttgcaacaaacacaaacctctggtgctcaaaatctcaaaagcttaggtgttcaagaagataagctgtttcagttaccatcggcttgtcaattgaagaacgctagcgtcagtgattgcccaaagcttcttgggttatctccgagctcaccagacgccgccatcttcaccaactcctcctctaaagcaacgacacccagtacttcagcaaccaccgcaacgccgtcttccgcggcggataaaaccgatagcaaatccagtggaaccaagcttggtccccacttcgtcggttccacggcggcgctactggttgctacagcggccgtgtttttccttgtattcccagctggatttgcttcaatagtttagggtttttgcatgggatttcgagatttgggggtttatttattgttgaagtccttttgtttttaaacagtctcagaaaaaagatggactgagttgacaattatgattattttcgtttatttttcctttttgccctttaaattaaaactagtatattttcccagcttcacctgggaaatccttttatatatatttttaaaattttataaataaaaattataattat

SEQ ID NO: 301 - DNA, 1647 bp, Brachypodium distachyon
tcctgtgatgagctcagtttgctcgttggtgcccgcaatggataggctcctcgccggcttccttggctttctactgattgcgtcggtaggaagccatgcagctcgggctccggagcaatactggaagtctgctcttcccaacactcccatgccaagctccctctcgcagctcctgaacactccagcgggaggcacgtcagtgaacgtcggctggggaggtgtccatgtcgacgctggtcatgggaagcccgggggcacgacggttgatgttggcaagggtggcgtcggcgtcaacaccaagcccggcgggactacggtcggcgtcggcaagggcggcgtgggcgtcaacgtcaagcccgggggcaccacggtcggcgttggcaagggcggcgtcggtgtcaacgttaacccaggccacggcaagcccggtggaaccaccgttggtgttgggaagggcggcgtgggcgtcaacgtcaaccccagcagcggcaagcccggaggcaccacagtcgacgttggcaaaggtggtgtaggcgttaacgtgaaacccgcatatggtaagcctggtggcagtggcaccacggttggagttgggaaaggcggcgtcgacgtgaacgtcaagcccggcagcggcaagcccggcggcaccacggtcggcgtcgggaaaggcggcgtgggcgttaacgtgaaacccgcatacggtaagcctggtggcagcggcaccacggttggagtcgggaagggcggcgtcggcgtgaacgtcaagcctggctacggcaagccaggcggcaccacggtgggcgttggcaagggcggagtgggcgtccacgtgagaccccgcgggaagcccgtcaacgtcaacgtctcgcctttcatatacaactacgccgcgacagagacacaggtgcacgacgaccccagcgccgcgctcttcttcctggagaaggacctccacgccgggaagaagctggccgttcacttcatggccacgacgggcgccggagagaagttcctgccgcggagcgaggccgacgccatccccttctcctccgagaaggtccctgagatcctcagccgcttctccgtgaagccagactccacggaggcggcccagatgacgcagacgctgcacgactgcgaggaggcggcagcgaaaggggagaagaagtcgtgcgccacgtcgctggagtccatggtggacttcgccacgtccagcctcgggaccagccacgtcagggccgtctccacggtggtcgggaaggaggggtcgccgaagcaggagtacgccatgaccagcgtgaagcgcacggccggcgccgaccggctcgtggcctgccacgcggagccgtacccgtacgccgtgttcgcgtgccacctgacgcaggccacgagggcgtacacggtgtcgatggtcggcagcacggacggcacggccgtggaggccgtcgcggtttgccatgccgacacggccggatggaacccgaggcacgtggctttccaggtgctcaaggtgaagcccggcacggtgccggtctgccacttcttgccgcaggaccacgtcgtctggacccgcagcggctgaagcccggacatgcgccgttcgttcgtgcgcgccactatacagtctagtgctttgctatttgaatg

SEQ ID NO: 302 - DNA, 1814 bp, Leymus cinereus x Leymus triticoides
  misc_feature (5)..(9): n is a, c, g, or t
agtannnnnagtgagcagatcatcctcaccttgcgagttgtcgtcagtttcctctcgatggataggctcctcgcagccggcatccttggctttctactgattgcgtcggtaggaagccatgcagctcgtgctccggagcaatactggaactctgctcttcccaacactcccatgccaagctccctctctcaactcctcaacaatcaagccggaggcacgtcggtgaacgtcggctggggcggtgtccatgtcgacgcgggtcatgggaagcccgggggcacgacggtcgatgttggcaagggtggcgtcggcgtcaacgtgaagcctggcagcgccaagcccggcgggactacggtcggcgtcggcaagggcggcgtgggtgtcaacgtcaaccctggctacggcaagcccgggggcacaaccgtgggcgttggaaagggcggcgtggacgtcaacgtcaaacctggcagcggcacgacggtcggcgttggcaaaggcggcgtgggcgtcaacgtcaagcctggctatggcaagcccgggggcacaacagttggcgttggcaagggcggcgttgacgycaacgtcaaacctggcagcggcaagcccagcggcacgacggtcggcgtcgggaaaggtggcgtcggcgttaacgtgaaacccgcatacggcaagcctggtggcaccggcaccacggttggcgtcgggaagggcggcgtcggcgtcaacgtcaagcctggctacggtaagccaggcggcaccacggtcggcgtcggcaagggcggcgtcggcgtccaagtgaaaccccgggggaagcctgtccacgtcaacgtctcacctttcgtatacaactacgccgcaacggagacgcagctgcacgacgaccccagcgccgcgctcttcttcctggagaaggatctccacaccgggaagaagatgaaggttcatttcatggccaccccaggcgccggagagaagttcctgccgcggagcgaggccgacaccatcccgttctcctccgagaaggtccccgagatcctcacccgcttctccgtggcgccagactccgtcgaggcggcggagatgaagcagacgctgcacgagtgcgaggcgacggcagccaagggggagaagaagtcgtgcgccacgtcgctggagtccatggtggacttcgccacgtccagcctcgggaccagccacgtgagggccgtctccacggtggtcgggaaggaggggtcgccgaagcaggagtacaccatgaccggcgtgaagcgcgcggcgggcgcggaccagctcgtggcctgccacgcggagccgtacgcgtacgccgtgttcgcgtgccacctgacgcaggcgacgagggcctacacggtgtcgatggtcggcaaggacggcacggcggtggaggccgtcgcggtgtgccacgccgacacggccggctggaacccgaggcacgtcgcgttccaggtgctcaaggtgaagcccggcgcggcgccggtctgccacttcttgccgcaggaccacgtcgtctggacccgcagcggctgaagaagcccggatggatctgtgccgttcgtaagcaccatacagttcagtgctttgctatttggatgatgcctgcctttgttacggtcagatactactatgtcctatattgagtatatggtatcttgcatcctagcatacatttccgttgttgctacctattgtatttggatggtgttgccagtatcgccagcttgtacggagtgggatgtttgctgtatagtttagcacggttatgcaataaacagactggtacttatttacctcttttt

SEQ ID NO: 303 - DNA, 1844 bp, Pseudoroegneria spicata
ccgttgctgtcggcagttccaagtgagcagatcatcctcgccttgcgagctgtcgtcagtttcctcattggtgccctccatggataggctcgtcgccgccggcatcctcggctttctactgatcgcgtcggtaggaagccatgcagctcgtgctccggagcaatactggaagtctgctcttccctacactcccatgccaagttccctctctcaactcctaaacaatcaagccggaggcacgtcggtgaacgtcggctcgggcggtgtccatgtcgacgcgggtcatgggatgcccgggggcacgacggtcgatgttggcaagggtggcgtcggcgtcaacgtgaagcctggcaccgtcaagcccggagggactacggtcggcgtcggcaagggcggcgtgggtgtcaacgtcaagcctggctacggcaagcccgggggcacgacagttggcgttggcaagggcggcgtggacgtcaacgtcaaacctggcaacggcaagcccagcggcacgacggtcggcgttggcaaaggcggcgtgggcgtcaacgtcaagcctggctacggcaagcccggtggcaccacggttggagtagggaaggggggcgtcggtgtgaacgtgaagcctggcggcggcaccacggtcggcgtcgggaaaggtggcgtcggcgtgaacgtgaaacctgcatacggcaagcctggtggcaccggcaccaccgttggcgtcgggaagggcggcgtcggcgtcaacgtcaaacctggctacggtaagccaggcggcaccacggttggcgtcgggaagggcggcgtcggcgtcaacgtcaagcctggctacggtaagccaggcggcaaaccccggggtaagcctgtccacgtcaatgtctcacctttcgtatacaactacgccgcaacggagacgcagctgcacgacgaccccagcgccgcgctcttcttcctggagaaggatctccacgccgggaagaagatggacgttcatttcatggccaccccgggcgccggagagaagttcctgccgcggagcgaggccgacaccatcccgttctcctcggagaaggtccccgagatcctcagccgcttctccgtggcgccagactccgtcgaggcggcggagatgaagcagacgctgcgcgagtgcgaggcgacggcggccaagggggagaagaagtcgtgcgccacgtcgctggagtccatggtggacttcgccacgtccagcctcgggaccagccacgtgagggccgtctccacggtcgtcgggaaggaggggtcgccggagcaggagtacaccatgaccggcgtgaagcgcgcggcgggggccgaccagctcgtggcctgccacgcggagccgtacgcgtacgccgtgttcgcgtgccacctgacgcaggcgacgagggcgtacacggtgtcgatggtcggcaaggacggcacggcggtggaggccgtggcggtgtgccacgccgacacggccggctggaaccctaggcacgtggcgttccaggtgctcaaggtgaagcccggcgcggcgccggtctgccacttcctgccgcaggaccacgtcgtctggacccgcagcggctgaagaatcccggatctgttccgttcgttcgtaagcaccatacagttcagtgctttgctatttggatttggatgatgcatgcgttcgtttatatgagtgtatggtatcttgcgtcctagcatacatttccgttgttgctacctattgtatttggatggcgttgccagtatcgccagcttgtacggagtgggctgtttgctgtatagtttagcacgttgatgcaataaacagactggtacttatttacctctca

SEQ ID NO: 304 - DNA, 1875 bp, Triticum aestivum
cgcagttccaagtgagcagatcatcctcacattgcgagctgtcgtcagtttcctcattggtgccctccatggataggctcgtcgccgccggcatccttggctttctactgattgcgtcggtaggaagccatgcccatgcagctcgtgctccggagcaatactggaagtctgctcttcccaacacccctatgccaagctccctctctcaactcctaaacaatcaagccggaggcacgtcggtgaacgtcggctggggcggtgtccatgtcgacgcgggtcatgggatgcccggcggcacgacggtcgatgttggcaagggtggcgtcggcgtcaacgtcaagcctggcagcgccaagcccggcgggactacggtcggcgtcggcaagggcggcgtgggtgtcaacgtcaagcctgcctacggcaagcccgggggcacaaccgtgggcgttggcaagggcggcgtggacgtcaacgtcaaacctggcagcggcaagcccagcggcacgacggtcggcgttggcaaaggcggcgtgggcgtcaacgtcaagcctggctacggcaagcccggcggcaccacggtcggagtagggaagggaggcgtcggcgtgaacgtgaagcctggcgacggcaccacggtcggcgtcgggaaaggtggcgtcggcgtgaacgtgaagcctgcatacggcaagcctggtggcaccggcaccaccgtcggcgtcgggaagggtggcgtcggcgtcaacgtcaagcccggctacggtaagccaggcggcaccacggtcggcgttggcaagggcggcgtcggcgtcaacgtcaagcctggctacggtaagccaggcggcaaaccccggggtaagcctgtccacgtcaacgtctcgcctttcctatacaactacgccgcgacggagacgcagctgcacgacgaccccagcgccgcgctcttcttcctggagaaggatctgcacgccgggaagaagatgaacgtccatttcatggccaccccgggcgccggcgagaagttcctgccgcggagcgaggccgacgccatcccgttctcctcggagaaggcccccgagatcctcagccgcttctccgtggcgccggactccgccgaggccgcggagatgaagcagacgctgcgcgagtgcgaggcgacggcggccaagggggagaagaagtcgtgcgccacgtcgctggagtccatggtggacttcgccacgtccagcctcgggaccagccacgtgagggccgcctccacggtggtcggaaaggaggggtcgccggagcaggagtacaccatggccggcgtgaggcgcgcggcgggggccgaccagctcgtggcctgccacgcggagccgtacgcgtacgccgtgttcgcgtgccacctgacgcaggcgacgagggcgtacacggtgtccatggtcggcaaggacggcacggcggtggaggccgtggcggtgtgccacgccgacacggccggctggaacccgaggcacgtggcgttccaggtgctcaaggtgaagcccggcggggcgccggtgtgccacttcctgccgcaggaccacgtcgtctggacccgcagcggctgaagaagcccccggatctgtgccgttcgttcgtaagcaccatacagttcagtgctttgctatttgggttgatgatgcctgcgttcgtttacgttctagcctcagcagacgctgctgtgtcctactatatgagtatatggtatcttgcatcctagcatacatttccgttgttgttgcctattgtatttggatggcgttgccagtatcgccggcttgtacggagtgtgggctgtttgctgtatagtttagcacgttgatgcaataaacagactggtacttatttacctct

SEQ ID NO: 305 - DNA, 1704 bp, Panicum virgatum
ggccatcttgtctgcatcgccctccttccttacacttgcaccgggatcatctcagcttgcgcattggccatcttcgtcgtccatggacaggctcctcgccggcctgcttggcttcctattgcttgcgtcagtaggaagccatgcagctcgagctccggatcagtactggaaatctgctctccccaacacgcccatgccaagctccctctcccaactcctaaacaccccagccggcggcacgaccgtgaacgtcggccgtggcggtgtccatgtcgacgccgggcatggcaagcccgggggcacgaccgtcgatgtaggcaagggcggcgtcggcgtcaacgtcaaccctggcagcggcaagcccggcggcaccacggtcggtgtcgggaaaggtggagtcggcgttaacgtcaagcctggttatggcaagcccggcggcaccacggtcggcgtcggcaagggcggagtcggcgttaacgtcaagcctggttatggcaagcccggcggcaccacggtcggcgtcggcaagggcggagtcggcgttaacgtcaagcctggttatggcaagcccggcggcaccaccgtcggcgtcggcaagggcggcgtcggcgtcaacgtcaaaccagggagcgggaagcccggcggcaccacggtgggcgtcgggaagggcggggttggcgttaacgtgaagccccgcggcaagcccgtccacgtcgacgtcgctcctttcctatacaactacgccgcaacggagacgcagctgcacgacgaccccagcgtcgcactcttcttccaggagaaggagctccaccccgggaagaagatgaccgtccagttcaccaacaccgtgcccggcaccaagttcctcccccggagcgaggccgatgccatcccgttctcctcggagaaggtgcccgagatcctcagccgcttctcggtgagcccggactccgtcgaggcggcggagatggcgcagacgctgcgcgactgcgaggcgcccgcggccaagggcgagaagaaggcctgcgccacgtcgctggagtccatggtcgacttcgccacggccggcctcgggaccagccacgtgagggccgtctcgaccgtcgtggcgaggccggactcgccgaagcaggagtacaccatcaccggagtgaagcgcgcggccggcgccgacgacggccggctcgtcgcctgccacgcggagccgtacgcgtacgccgtgttcgcgtgccaccagacgcggcagacgcgggcgtactcggtgtcgatgctcggcagagacggcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttggatggccgccgtgcctgttcttgctgcgcaggtttcatctacgttctagtagccggcctctgagcgaactgtcatcttgtgtcatgtgtttgcttatgttttcagtacttgatacttgtatgaatggtgttgccagccagtatcgtgtatcgactatcgatcacctgctaggttctgctgtatagttctaaataaacagacatctctttatcttggtgttactgttctcagcctcagcccaaacaaaacttctgctgatc

SEQ ID NO: 306 - DNA, 1788 bp, Brachypodium distachyon
gagctttctcatctccaagaagaagactctacttctagctcccaattccagctgaccctcctccagctgccactctcgcccaattcgatccatttctagctaggactgaggtcgattttgttgttgatttgagaacacaaacacatagccatggctgcgggcaagaagcttgtgtcgccgatggaggtgtcagtggaggccgggaacgcggaccaggcatcctggctggacgacgacgggcgcccacgccgctccggcacgttctggacggccagcgcgcacatcatcacggccgtcatcggctccggcgtgctctccctggcgtgggccatcgcgcagctgggctgggtcgccggcccagcagtgatgctcctcttcgcggccgtgatctactacacctcgacgctcctggccgagtgctaccgcacgggcgacccggccacgggcaagcgcaactacacctacatggacgccgtcagggccaacctcggcggcggcagggtcgtcttctgcggcgtcatccagtacgccaatctcgtcggcgtcgccatcggctacaccatcgcgtcctccatcagcatgagggcgattaggagggctggctgcttccatgccaacggccatggcgtcccctgcaagagctccagcaacccttacatgatcctcttcggcctcgtgcagatcgtgttctcgcagatccccgatttcgaccagatttggtggctgtcgatcgtggctgctgtcatgtccttcacctactccggcattgggctctccctcggcatcgcccagaccatctcgaatggagggatcaaggggagcctgacggggatcagcatcggcgtgggcggcatcacggggatgcagaaggtgtggcgcagcctgcaggcgttcggggacatcgccttcgcatactccttctccaacatcctgatcgagatccaggacacgatccgggcgccgccgccgtcggaggccaaggtgatgaagagcgcgacgcggctgagcgtggcgacgaccaccgtcttctacatgctgtgcggctgcatggggtacgcggccttcggcgacgcggcgccggacaacctgctgacggggttcggcttcttcgagcccttctggctcctcgacgtcgccaacgtggccatcgtggtgcacctcgtgggggcctaccaggtcttctgccagcccatcttcgccttcgtcgagcgatgggccgccgccacatggcccgacagcgcgctcttcgcctccgcgcgggccgagttccgcgtcggcccgttcgcgctcagcgtcttccgcctcgtctggcgctccgccttcgtctgcctcacaacagtcttcgccatgctgctccccttcttcggcaacgtcgtcggcttcctcggcgccgtctccttctggccgctcaccgtctacttccccgtcgagatgtacatcaagcagcgcgccgtgccgcgaggaggcacccagtggctctgcctcaagatgctcagcgtcgggtgcctcatcgtgtccgtcgccgccgccgcaggctccattgctgacgtcatcgaggctctcaaggtgtaccggcccttcagcggctgatttgggaaggagatgtttgtacttaggtccttatagaacgtttttattacagtttaaagggttaggcgccccaccaattggtggccatctttgttggattcctccgaagacgaggggtgtaaacaagaacggcaggaggtgctgtctgtattgtggactcaaagcgtagggtgccttatgcaaaatggtagttttcgt

SEQ ID NO: 307 - DNA, 1858 bp, Zea mays
acccacactcctcttcactcactaacggccgtgcttgcactcgcagcgcatcacttgctactttggtagtggagagcagaaagaacagagctagattattcccaacaagctacagcaaattagttgctcttcatggccgtgtcacacaacgttgggagcaagcacggtgtcgcgccgctggaggtgtcggtggaggccgggaacggcggagccgccgagtggctggacgacgatggccggcctcgccgcacgggcacgttctggacggccagcgcgcacatcgtcaccgccgtcatcggctccggggtgctctcgctcgcctgggcgatcgcgcagctgggctgggtcgccggccccgccgccatgctcctcttcgccttcgtcacatactacaccgccacgctgctcgccgagtgctaccgcacgggcgacccggagacgggcaagcgcaactacacctacatggacgccgtgcgctccaacctcggcggcgccaaggtcgcgttctgcggcgtcatacagtacgccaacctcgtcggcgtcgccatcggctacaccatcgcggcgtccatcagcatgaaggccgtcaggagagctgggtgcttccacgcccacgggcacgctgatccctgcaacagctccagcaccccgtacatgatcctcttcggcgtcgtgcagatcctcttctcgcagatacccgacttcgaccagatttggtggctctccattgtcgccgccgtcatgtccttcacttactcttccatcgggctctccctcggcatcgcacagaccatctccaatggtgggttcatgggcagtctcactggcatcagcatcggcgccggtgtcacctccacgcagaagatctggcatacgcttcaggcattcggagacatcgccttcgcctactccttctccaacatcctcatcgagatccaagacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcgtcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcagctgcctcctcgtctccgtggcggccgctgctggttccatcgccgacgtcatcgacgccctcaaggtgtaccggccattcagcggttaacctctctcgacgaatatagttagctctagatcgacacgcagcgatgaagaagaacattcatttttagatttcaatggactgatttggcctaaccgtcaaggatttgatctcaactatagaagaatgtgcgcaaagagaagaaatcatgcatatagctagactcgcactcagatccaaaactacacaacacttagcttgtggtttaattactgtggtgtttcttgtaactttatttttagcttcagaacaagacattgaagcatttattttctcttatttgcag

SEQ ID NO: 308 - DNA, 1844 bp, Zea mays
caggcacagcctctcgcgtcacctaggcacctagcaagcaagaagcactcgggagcacttgcttcctgcgctcttccactccgacagtccgacgaggaagaagagattcgattcgagggagggagggagggagctcgttgtctcagttggccatggcacccgcgccgcacaacggactgaacaacaaccacccggtcgcgcccatggatgtgtcggtggaggccgggaacgccggagccgccgagtggctagacgacgacggccggccgcgccgcagtggcacgttctggacggccagcgcgcacatcatcaccgccgtcatcggctcgggagtcctctccctggcgtgggccatcgcgcagctgggctgggtggccggccccgccgccatgctcctcttcgccttcgtcacctactacacggcggcgctgctcgccgagtgctaccgcacgggccacccggagacgggcaagcgcaactacacctacatggacgccgtgcgctccaacctcggcggcgtcaaggtcgtcttctgcggcgtcatacagtacgccaacctcgtcggcgtcgccatcggctacaccatcgcgtcggccatcagcatgaaggccgtcaggagggccgggtgcttccacgcccacgggcatgcggacccctgcaagagctccagcaccccgtacatggtcctgttcggcggtgtccagattctcttctcgcagataccggacttcgatcagatttggtggctctccattgtcgccgccgtcatgtccttcacttactcttccatcggactctccctcggcatcgcacagaccgtctccaatggtgggttcaagggcagcctcactggcatcagtattggcgccggcgtcacctccacgcagaagatctggcacacgctccaggcgttcggcgacatcgcgttcgcctactccttctccaacatcctcatcgagatccaagatacgatcaaggcgccgccaccgtcggagtcgaaggtgatgcagaaggcgacgcggctgagcgtggcgaccacgacagtattctacatgctgtgcgggtgcatggggtacgcggcgttcggcgacaacgcgccggacaacctcctcaccggcttcggcttctacgagcccttctggctgctcgacgtcgccaacgtggccatcgtcgtgcacctggtcggcgcctaccaggtgttctgccagcccatcttcgccttcgtggagcgccgcgccgccgcggcctggccggacagcgccttcgtctcccgggagctccgcgtgggtcccttctccctcagcgtgttccgcctgacgtggcggtccgcgttcgtgtgcgtcaccaccgtcgtcgccatgctgctgccgttcttcggcgacgtggtggggctcctcggcgccgtctccttctggccgctcaccgtctacttccccgtcgaaatgtacatcaagcagctccgcgtgccccgcggcagcaccaagtggatctgcctccagacgctcagcgtcagctgtctccttgtctccgtcgccgctgcagcaggatccattgccgatgtcatcgccgccctcaaggtctacaagccgttcagcggttagcttcgcaggcagaaggtgggagggatatatgcaaaaacgattgcggatactgtactgctccattagttggcaggatctagcaattaggtcttatacttttttgagatgagatgatgaattaggtataatctgctatacttttttgccactaacttgttacacggtcagctgatgaagcgcagcagatgtgcgtctgtacgtgagataaaatataatcatcaaaacaagttattttatttttct

SEQ ID NO: 309 - DNA, 1604 bp, Zea mays
ccgcctcaaaacggaggagtgaacagcaagcacctggtcccccccatggaggtgtcggcggaggccgggaacgccggtgccgccgagtggctagacgacgacggccgcccccgccgcaagggcacgttctggacggccagcgcgcacatcatcaccgccgtcatcggctccggcgtgctgtccctggcctgggccatcgcgcagctgggctgggtcgccggccccaccgccatgctcctcttcgccttcgtcacctactacaccgccacgctgctcgccgagtgctaccgcaccggcgaccccgacacgggcaagcgcaactacacgtacatggacgccgtgcgctccaacctcggcggcgccaaggtcgccttctgcggcgtcatccagtacgccaacctcgtcggcgtcgccatcgggtacaccatcgcgtcgtccatcagcatgaaggccatcaggagggcgggctgcttccacacccacggccacggcgacccctgcaagagctccagcacgccatacatgatcctcttcggcgctgcgcaggtcgtcttctcccagataccggacttcgatcagatatggtggctctccattgtcgctgcagtcatgtccttcacttactcgtctatcggactgtccctcggaatcgtacagaccgtctccaacggtgggttcaagggcagtctcaccagcatcggcttcggcgccggcgtgaactccacgcagaaggtctggcacacgctgcaggccttcggcgacatcgcgttcgcctactccttctccaacatcctcatcgagatccaggacacgatcaaggcgccgccaccgtcggagtcgaaggtgatgcagaaggcgacgcgcctcagcgtggcgacgacgaccgtgttctacatgctgtgcgggtgcatggggtacgcggcgttcggcgacgacgcgcccgacaacctgctcaccggcttcggcttctacgagcccttctggctgctggacgtggccaacgtggccatcgtggtgcacctcgtgggcgcgtaccaggtgttctgccagcccatcttcgccttcgtcgagcgccgcgccgccgcggcctggccggacagcgccttcgtctcgcgggagctccgcgccggcccgttcgccctcagccctttccgcctcgcgtggcggtcggcgttcgtgtgcgtcaccaccgtcgtcgccatgctgctgcctttcttcggcgacgtggcggggctcctcggtgccgtctccttctggccgctcaccgtctacttccccgtcgagatgtacatcaagcagcgccgcgtgcctcgtggcagcgccagatggatcagcctccagacgctcagcgtcacgtgcctcctcgtctccatcgccgccgccgccggttccatcgccgacgtcgtcgacgcgctcaaggtgtaccggccgttcagcggctaacttggaagggatctgtgtaaaacgcaggaccgtgaacaactcgatcgctgcaaaaaccagatgagattactaggcaagcagagcgaggcggcctggcgttattaattggttgaattaggcaggatccagctttaaacatttaggtctattcctaaaataag

SEQ ID NO: 310 - DNA, 1359 bp, Zea mays
gctgacaggctggacgacgacggccggccccggcgcaagggcacgttctggacagccagcgcgcacatcatcaccgccgtcatcggctcgggcgtgctctccctggcctgggccatcgcgcagctcggctgggtcgccggccccgccgccttgctcctcttcgccttcgtcacctactacaccgccacgctgctcgccgagtgctaccgcaccggcgaccccgacacgggcaagcgcaactacacgtacatggacgccgtgcgctccaacctcggcggcaccaaggtcctgctctgcggcgtcatccagtacgccaacctcgtcggcgtcgccatcggctacaccatcgcgtcgtccatcagcatgaaggccgtcaggagagccgggtgcttccacgtccacggtcacggcgatccatgcaggagctccagcaccccgtacatgatcctcttcggccttgtgcagatcctcttctcccagataccggacttcgatgagatttggtggctctccattgtcgctgcagtcatgtccttcacctattcttccatcggactgtccctcggaatcgtacagaccatctccaacggcgggttcatgggcagtctcaccagcatcagcttcggcgccggtgtgagctccacgcagaaggtctggcacaccctgcaggccttcggcgacatcgccttcgcctactccttctcgaacatcctcatcgaaatccaagacacgatcaaagcaccgccgccgtcggagtcgaaggtcatgcagaaggcgacgtgcgtcagcgtggcgacgacgaccatcttctacatgctgtgcgggtgcatggggtacgcggcgttcggcgacaacgcgccggacaacctcctcaccggcttcggcttctacgagcccttctggctgctcgacgtcgccaacgtcgccatcgtcgtgcacctcgtcggcgcgtaccaggtgttctgccagcccatcttcgccttcgtcgagcgccgcgccgccgcggcctggccggacagcgccttcatctcacgggagctccgcgtgggccccttcgcgctcagcttgttccgcctcacgtggcggtcgtcgttcgtgtgcgtcaccaccgtcgtcgccatgctgctgccgttcttcggtgacgtggtcgggctcctcggcgccgtctccttctggccacttaccgtctacttccccgtcgagatgtacatcaagcatcgccgcgtgccccgtggcagcaccaggtggatctgccttcagacgctcagcgtcacctgcctcctcgtctccattgccgccgccgccggttccattgctgacgtcatcgacgcgctcaaggtgtaccggccgttcagcggc

SEQ ID NO: 311 - DNA, 2000 bp, Oryza sativa
gatgcccaggtgcactgccatttgccaccggcctcagtggcagtggcagtgtcagttcatgttggaaaagcaaagctgtccacgcgtggcgcgccatggcgggaggaggaagacgaagacgaagcagccgcaaccctacacgcctctctcacctctcctctcctctcctctctctctatatatagctctcgtcttcttccacctctcactcactcaacccaagcaacgcgcagcacaccatcaccagccaagtgttcgacagagttcttggcgagctagaggtgtcgaacaccttcaagagaggagggatggggaaggcggcggcgatggaggtgtcggcgtcggcggcggcggaggcggggatgatggtgggtcatggggagtggcgcgacgacgacgggcgggcgcggcggatggggacggtgtggacggcgagcgcgcacatcatcacggcggtgatcggctccggcgtgctgtcgctggcgtgggcgatcgcgcagctcggctgggtggccggccccgccgtcatgctgctcttcgccttcgtcatctactacacctccacgctgctcgccgagtgctaccgctccggcgacccgtgcaccggcaagcgcaactacacctacatggacgccgtccgcgccaacctcggcggctccaaggtccgcctctgcggcgtcatccagtacgccaacctcttcggtgtcgccatcggctacaccatcgccgcctccatcagcatgctggcgatcaagagggcggattgcttccacgagaaggggcacaagaacccgtgcaggagctcgagcaacccgtacatgatcctgttcggcgtcgtgcagatcgtgttctcacagatcccggatttcgatcagatatggtggctgtccatcgtcgccgccatcatgtccttcacctattcgacgattggcctctcgctcggcatcgcgcagaccgtcgccaacggcgggttcatgggcagcctcaccggcattagcgtcggcaccggcgtcacctccatgcagaaggtctggcgcagcctccaggccttcggtgacatcgcgttcgcctactcctactccatcatcctcatcgagatccaggacacgatcaaggcgccgccgccatcggaggcgaaggtgatgaagcgcgcgacgatggtgagcgtggcgacgacgacggtgttctacatgctgtgcgggtgcatggggtacgcggcgttcggggacaagtcgccggacaacctgctcaccgggttcggcttctacgagccgttctggctgctcgacgtcgccaacgctgccatcgtcgtgcacctcgtcggcgcctaccaggtgttcgtccagccgatcttcgcgttcgtcgagcggtgggcggcggcgaggtggccggacggcggcttcatctcccgggagctccgcgtgggccccttctcgctcagcgtgttccgcctgacatggcgcacggcgttcgtctgcgccaccaccgtcgtgtccatgctcctcccgttcttcggcgacgtggtggggctcctcggcgccgtctcgttctggccgctcaccgtctacttccccgtcgagatgtacatcgcgcagcgcggcgtgcggcgagggagcgcgcggtggctctgcctcaaggtcctcagcgccgcctgcctcgtcgtctccgtcgccgccgccgccggctccatcgccgacgtggtcgacgcgctcaaggtgtaccggccgttcagcgggtagagagaatgtgagatcgatcggtgaccgtccgatcgaagtagtactagcactagcaaacatgtgtacgtcgtatgggcagcagagcaacactgccgttgccaggtggggcccaggtgtgagataaaaaagaacgaggtaaacaaaaaattatttactgagctttgtgtggtgttttgtcatgtaacaccttgtagattcttgtattatgagtttgattgggataacaaggctttaatggttagtgaagcacagcttactgta

SEQ ID NO: 312 - DNA, 1758 bp, Oryza sativa
acaaacactcgagctcacacctgctcgatcaaaatcctccaacaactcgatccattcgcagtagctgcgagctctgagcggcggcgaggtgtccgacatggcgtcggggcagaaggtggtgaagccgatggaggtgtcggtggaggccgggaacgccggggaggcggcgtggctggacgacgacgggcgggcgcggcggacgggcacgttctggacggcgagcgcgcacatcatcaccgccgtcatcggctccggcgtgctgtcgctggcgtgggcgatcgcgcagctgggctgggtggccggtcccgccgtgatgctcctcttcgccttcgtcatctactacacctccaccctcctcgccgagtgctaccgcaccggcgacccggccaccggcaagcgaaactacacctacatggacgccgtgcgcgccaacctcggcggcgccaaggtcaccttctgcggcgtcatccagtacgccaacctcgtcggcgtcgccatcggctacaccatcgcgtcgtccatcagcatgcgcgccatcaggagggccggctgcttccaccacaacggccatggtgacccgtgccgcagctccagcaacccttacatgatcctcttcggcgtcgtgcagatcgtcttctcgcagatcccggacttcgaccagatttggtggctgtccatcgtcgccgccgtcatgtccttcacctactccggcatcggcctctccctcggcatcgtccagacaatctccaatggcgggatccagggcagcctcaccggaatcagcatcggcgtcggcgtcagctcaacgcagaaggtgtggcgcagcctgcaggcattcggcgacatcgccttcgcatactccttctccaacatcctcatcgagatccaagacacgatcaaggcgccgccgccgtcggaggcgaaggtgatgaagagcgcgacgaggctgagcgtggcgacgaccacggtgttctacatgctgtgcgggtgcatgggctacgcggcgttcggcgacgcggcgcccgacaacctcctcacgggcttcggcttctacgagcccttctggctgctcgacgtcgccaacgtcgccatcgtcgtgcacctcgtcggcgcctaccaggtgttcgtccagccaatcttcgccttcgtcgagcgctgggcctcccgccggtggccggacagcgcgttcatcgccaaggagctccgcgtggggcccttcgcgctcagcctcttccgcctgacgtggcgctcggcgttcgtctgcctcaccacagtcgtcgccatgctcctccccttcttcggcaacgtggtgggtctcctcggcgccgtctccttctggccgctcaccgtctacttccccgtcgagatgtacatcgcgcagcgcggcgtgccacgtggcagcgcgaggtgggtctcgctcaagacgctcagcgcgtgctgcctcgtcgtctccatcgccgccgctgcgggctccattgctgacgtcatcgacgctctcaaggtgtacagaccgttcagcggatgattggaacgtgaggggcacgtgtgctcgttaaattatttcttactatctctgtaccaaaatatagcaaactagtataaataggacgaaattcgggtagttctcaggtacgaattcatcgtactaggaaatatctcacattgtattaagttgctatattttgggtcagcattagtacaatattacacaaagaggaaaaaaaaggaagaaatgtaacatgtggcgtttttcattgg

SEQ ID NO: 313 - DNA, 1797 bp, Oryza sativa
acaaacactcgagctcacacttcctcaaatcctccaacacctcgatccattcgcagtagctgcgaggtgtctgacatggcgtcggggcagaaggtggtgaagccgatggaggtgtcggtggaggccgggaacgccggggaggcggcgtggctggacgacgacgggcgggcgcggcggacgggcacgttctggacggcgagcgcgcacatcatcaccgccgtcatcggctccggcgtgctgtcgctggcgtgggcgatcgcgcagctgggctgggtggccggccccgccgtgatgctcctcttcgccttcgtcatctactacacctccaccctcctcgccgagtgctaccgcaccggcgaccctgccaccggcaagcgcaactacacctacatggacgccgtgcgcgccaacctcggcggcgccaaggtcaccttctgcggcgtcatccagtacgccaacctcgtcggcgtcgccatcggctacaccatcgcgtcgtccatcagcatgcgcgccatcaggagggccggctgcttccaccacaacggccatggtgacccgtgccgcagctccagcaacccttacatgatcctcttcggcgccgtgcagatcgtcttctcgcagatccctgacttcgaccagatttggtggctgtccatcgtcgccgccgtcatgtccttcacctactccggcatcggcctctccctcggcatcgtccagacaatctccaatggcgggatccagggcagcctcaccggaatcagcatcggcgtcggcgtcagctcaacgcagaaggtgtggcgcagcctgcaggcattcggcgacatcgccttcgcatactccttctccaacatcctcatcgagatccaagacacgatcaaggcgccgccgccgtcggaggcgaaggtgatgaagagcgcgacgaggctgagcgtggcgacgaccacggtgttctacatgctgtgcgggtgcatgggctacgcggcgttcggcgacgcggcgcccgacaacctcctcaccggcttcgggttctacgagcccttctggctgctcgacgtcgccaacgtcgccatcgtcgtgcacctcgtcggcgcctaccaggtgttcgtccagccaatcttcgccttcgtcgagcgctgggcctcccgccggtggccggacagcgcgttcatcgccaaggagctccgcgtggggcccttcgcgctcagcctcttccgcctgacgtggcgctcggcgttcgtctgcctcaccaccgtcgtcgccatgctcctccccttcttcggcaacgtggtgggtctcctcggcgccgtctccttctggccgctcaccgtctacttccccgtcgagatgtacatcgcgcagcgcggcgtgccacgtggcagcgcgaggtgggtctcactcaagacgctcagcgcgtgctgcctcgtcgtctccatcgccgccgccgcgggctccattgctgacgtcatcgacgcgctcaaggtgtacaggccgttcagcggatgattcttctgattctctcttgctgctttgagcagagcatccactggtaaaaagtggacagtaattttctttttttacagtctatggacgtagtacagtaaaaaagtgtgtacaactgtacaagggagcagtagaatccttgcaggggtaaaatactgagatgtaactactgagcattttgtagcgctcaaacaggtacagaggggaaaaaattgaacccagattgtatggaggttggcgtaatataattgagccgcagccaaaaaatgaaattcagaatttactggttactgaagc

SEQ ID NO: 314 - DNA, 2011 bp, Sorghum bicolor
atcacactccaccaccaccgctcaccaacaacaaccgagcagagcagcccatccatccccctctccgcacggctgctctccttcttctcctctgtgtccggccgccggtctcctctgctccagcgagctcccagttgtagacgaccgtacccacatggcgatggcgtcgcacaacggcggcaccaccaagcacctaccgccgatggaggtctccatggaggccgggaacggcgacgcggccgagtatctcgacgacgacgggcggccacgccgcaccggcacgttctggacggcgagcgcgcacatcatcaccgccgtgatcggctccggcgtgctctccctggcctgggccatcgcgcagctcggctgggtggccggccccgccgccatgctgctcttcgccttcgtcacctactacaccgccacgctgctcgcggagtgctaccgcaccggcgacccggacacgggcaagcgcaactacacctacatggacgccgtccggtccaacctcggcggcgccagggtcgccttctgtggctgcatccagtacgccaacctcgtcggcgtcgccatcggctacaccatcgcgtcgtccatcagcatgcaggctatcagtagagctggctgcttccataagcgaggccacgccgtgccgtgcaagagctcgagcaatccctacatgatcctctttggagctgtgcagatcctcttctcccagataccagacttcgatcagatttggtggttatccatcgtcgctgctgtcatgtctttcacctactccagcatcgggttgtcactcggcatcgcacagactgttgctaatggtgggttcaagggcagcctcaccggcatcagcatcggcgccgacgtcacctccacgcagaaggtctggcacagcctgcaagccttcggcgacatcgccttcgcctactcattctccaacatcctcatcgagatccaagacacgatcaaggcgccgccaccgtcggagtcgaaggtgatgcagaaggcgacgcgtctgagcgtggcgacgacgaccatcttctacatgctgtgcggatgcatggggtacgcggcgttcggcgacaaagcccccgacaacctcctcacggggttcggcttcttcgagccgttctggctgatcgacatcgccaacatcgccatcgtggtgcacctcgtcggcgcctaccaggtgttctgccagcccatcttcgccttcgtcgagcgccgcgccgccgcggcgtggccggacagcgccttcatcgcccgggagctccgcgtcggccccttcgcgctgagccttttccgcctgacgtggcggtcggcattcgtgtgcgtcaccaccgtcgtcgccatgctcctccccttcttcggcaacgtcgtcggcttcctcggcgccgtctcgttctggccgctcaccgtctacttccccgtcgagatgtacatcaagcagcgccgcgtgccgcggggcagcaccaagtggatctgcctccagacgctcagcgtcgggtgcctgttcgtgtccatcgccgccgcggccggctccattgccgacgttatcgacgcgctcaaggtctaccacccgttcagcagttaattgttgtttagctggagaggaggatggacgtatgtactgcatgcagtattcaatgcgttcaacgactttggtcaatcgtactacaaggggtcaaggggagggagagagaaaaaaaatgcagtgtgagatgtttctttgcatggaggcccttatagaacagtgacgcttaattaagtgaaaggtgtaggcacccttgtgcacatgctggtagcattccttggaagacaaaagacaaggggtgtggggccagaatggcaggaggtgggtgttgtgatgagtctactgtaggtgtatggagctaaaaaaaatgtttcttttaacttttttattaacaattttattttgtatatgttttcctcctgtaaggttatgtttgagaaatagcaaatgacaatcgagagttcctctctc

SEQ ID NO: 315 - DNA, 1866 bp, Sorghum bicolor
ctgagaggaggaagaggaagaagaaatccgagagagggatcagagctcgctcgctctcgctcagtggccatggcaccggcagcgcacaacggagtgagtaacatgcactcggttgcgcccatggaggtgtcagtcgaggccggcaacgccggtgccgccgcgtggctggacgacgacggccgccctcgtcgcaccggcacgttctggacggccagcgcccacatcatcaccgctgtcatcggctccggcgtgctctccctggcctgggccatcgcgcagctcggctgggtcgccggccctaccgccatgctcctcttcgccttcgtcacctactacacggccacgctgctcgccgagtgctaccgcacgggcgacccggagacgggcaaacgcaactacacctacatggacgccgtccgctccaacctcggcggcgccaaggtcgtgttctgcggtattatacagtatgctaacctcgtcggcgtcgccattggctacaccatcgcgtcgtccatcagcatgaaggccatcaggagagctgggtgcttccacagccatggacatgaggatccctgcaagagctccagcaccccgtacatgatcctcttcggcgttgtggagattctcttctcgcagataccggacttcgatcagatttggtggctatccattgtcgccgccgtcatgtccttcacttactccagcatcggactctccctcggcatcgcacagaccgtctcccatggtgggttcaagggtagcctcactggcgtcagcatcggcgccggcgtcacctcgacgcagaaaatctggcacaccctgcaggcattcggcgacatcgccttcgcctactccttctccaacatcctcatcgaaatccaagacacgatcaaggcgccgccaccgtcggagtcgaaggtgatgcagaaggcgacgcgtctcagcgtggcgacgacgaccatcttctacatgctgtgcgggtgcatggggtacgccgcgttcggcgacgccgcgccggacaacctgctcaccggcttcggcttctacgagcctttctggcttcttgacatcgccaacatcgccatcgtcgtgcacctcgtcggcgcctaccaggtgttctgccagccgatcttcgccttcgtcgagcgccgcgccgccgcggcatggccggacagcgccttcatctcacgggagctccgcgtgggccccttcgcgctcagcgtgttccgcctgacatggcggtcggcgttcgtgtgcgtcaccaccgtcgtggccatgctgctgccgttcttcggcgacgtggtggggctcctcggcgccgtctcgttctggccgctcaccgtctacttccccgtcgagatgtacatcaagcagcgccgcgttccgcggggcagcaccaagtggttgtgtctccagacgcttagcgtcacctgcctcctcgtctccattgccgccgccgccggttccatcgccgacgtcgtcgatgccctcaaggtctaccggccgttcagcggttagcttcggagaacgtggagggagattcgtgaaaaacgacagaggactgtgagcatctacaccaaatctctgctggaccatttccgaatactaacgagcgaggtgacctggcgactgtattgctccattagttggttcgattaagcaggatctagctctaagaaattaggtctatattcctaacttcgctggtagcgataagctgctatactttttgccacttacttgttatgatcatctgcagtgcacgggatgtgtgtgcgagtgagatcatgtggaattgctagtttgcgtctgtgaaccatccaaaactatgttagaaatgagaagatgctatacctgagacggatc

SEQ ID NO: 316 - DNA, 1828 bp, Sorghum bicolor
agcctctcagtcctcttctcagctctcactccactccagtcctcagagcatccaagaaaccagtcatctcatcagcgcttgccttgcctgccgcgctccatccctgagcagtcaatggcagtgcacagcggagtgaacaagcacgcggtggcgccgatggaggtctcggtggaggccggcaacgccggggacgccgcgtggctggacgacgacggccgcccacgccgcaccggcacgttctggacggccagctcccacatcatcaccgccgtcatcggctccggcgtgctgtccctggcctgggcgatcgcgcagctcggctgggtcgccggccccgccgccatgctcctcttcgccttcgtcacctactacaccgccacgctgctcgccgagtgctaccgcacgggcgacccggagacgggcaagcgaaactacacctacatggacgccgtccgctccaacctcggcggcgccaacgtcgtgttctgcggcgtcatacagtatgccaacctcgtcggcgttgcaatcgggtacaccatcgcgtcgtcgatcagcatgaaggcgatcaggagagcagggtgcttccacacccatggacacgctgatccctgcaagagctccagcaccccgtacatgatcctcttcggcgtcgtgcagattctcttctcccagataccagacttcgatcagatttggtggctatccattgtcgccgcagtcatgtccttcacctactcttccatcggactctccctcggcatcgcacaaaccatttctaatggtgggttcatgggcagcctcaccggcatcagcatcggcgccggcgtcacctccacgcagaaaatctggcacaccctgcaggccttcggggacatcgccttcgcctactccttctctaacatcctcatcgaaatccaagacacgatcaaggcgccgccaccatcggagtcgaaggtgatgcagaaggcaacgcgtctcagcgtggcgacgaccaccatcttctacatgctgtgcggatgcatggggtacgccgcgttcggcgacgccgcgccggacaacctcctgacaggtttcggcttctacgagccattctggctgctcgacgtcgccaacgtcgccatcgtcgtgcacctcgtcggcgcgtaccaggtgttctgccagcccatcttcgccttcgtggagcgccgcgccgccgcggcgtggccggacagcgccttcatcgcccgggagctccgcgtgggccccttcgcgctcagcgtgttccgcctgacatggcggtcggcgttcgtgtgcgtcaccaccgtggtcgccatgctgctgccgttcttcggcaacgtggtggggttcctcggcgccgtctcgttctggccgctcaccgtctacttccccgtcgagatgtacatcaagcagcgccgcgtggcacgcggcagcaccaagtggatttgcctgcagacgctcagcatcagctgtctccttgtttccattgccgctgcagcaggctccatagctgacgtcatcgacgccctcaaggtctaccggccgttcagcggttaacctctctagacgtatatagttagctctagaatgcaacgacgaagaggaacattctttttttttcctaagaactgatttggcgtagccgtcaaggatttgagctcaaatgcaacttagaaggatgtgcgtaatgagaagaaagcagaataactagactcgcactgagaaacacaaaacaatacatcacttggcttctagtttcattactgtggtgtttcttgtaactttcattttaggttcaaaaccaaagtttaaaatggccgtaatttttttc

SEQ ID NO: 317 - DNA, 1440 bp, Sorghum bicolor
gatccaatggcggcacatgaaggcaccaccaaccgcgtggcgccgatggaggtcacggtggaggccgggaacgctggggaggcggcgtggctggacgacgacggccgtccccgccgcgccggcacgttctggacggccagcgcgcacatcatcaccgccgtcatcggctccggcgtgctgtccctcgcctgggccatcgcgcagctcggctgggtggccggccccgccgccatgctcctcttcgccttcgtcacctactacaccgccacgctgctcgccgagtgctaccgcaccggcgacccggagacggggaagcgcaactacacctacatggacgccgtccgctccaacctcggcggcgccaaggtcgcgctctgcggcgtcatccagtacgccaacctcgtcggcgtcgccattggctacaccatcgcgtcgtccatcagcatgaaggccatcaggagagctggctgcttccacacccatggacatgaggatccctgcaagagctccagcatcccgtacatggtcgtctttggcgccgtccagatcgtcttctcgcagataccggacttcgatcagatttcgtggctctccatcgtcgccgccgtcatgtcattcacttattcttccatcggactctccctcggcatcgcacagaccatctctaatggtgggttcaagggcagcctcaccggcatcagcatcggcgccggcgtcacctccacacagaaggtctggcacagcctgcaggccttcggcgacatcgccttcgcctactccttctccaacatcctcatcgagatccaagacacgatcaaggcgccgccgccgtcggagtcgaaggtgatgcagaaggcgacgcgtctgagcgtggcgacgaccaccatcttctacatgctgtgcgggtgcatggggtacgcggcgttcggcgacgccgcgccggacaacctcctgacaggtttcggcttctacgagcccttctggctgctcgacgtcgcaaacgtcgccatcgtcgtgcacctcgtcggcgcgtaccaggtcttctgccagcccatcttcgcgttcgtcgagcgccgcgccgccgcggcctggccggacagcgccttcatctcccgggagctccgtgtcggtcccttcgccctgagccttttccgcctgacatggcggtcggcgttcgtgtgcgtcaccaccgtcgtcgccatgctgctgccgttcttcggcgacgtggtggggttcctcggcgccgtctcgttctggccgctcaccgtctacttccccgtcgagatgtacatcaaccagcgccgcgtggcacgaggaagcaccaagtggatttgcctccagacgctcagcatcagctgtctccttgtctccattgccgccgcagcaggctccattgccgacgttatcgacgctctcaaggtgtaccggccgttcagcggc

SEQ ID NO: 318 - DNA, 1446 bp, Sorghum bicolor
gcatcgccaccgcacaacggaggtgtgaatggcaagcacttgcctccgcccatggaggtgtcggcggaggccgggaacgccggtgctgccgagtggctggacgacgacggccgccctcgccgcaagggcacgttctggacagccagcgcacacatcatcaccgccgtcatcggctccggcgtgctctccctcgcctgggccattgcgcagctcggctgggttgccggccctaccgccatgctcctcttcgccttcgtcacctactacaccgccaccctactcgccgagtgctaccggaccggcgaccccgacaccggcaagcgcaactacacgtacatggacgccgtgcgctccaacctcggcggcaaaaaggtcgtgttctgcggcgtcatccagtacgccaacctcgtcggcgtcgccattggctacaccatcgcgtcgtccatcagcatgaaggccatcaggagagctgggtgcttccacacccacggtcatggggatccctgcaagagctccagcaccccgtacatgatcctcttcggcgttgtgcagatcctcttctcgcagataccggacttcgatgagatttggtggctctccattgtcgctgcagtcatgtccttcacctattcttctatcggactgtccctcggaatcgcacagaccgtctccaacggtgggttcaagggcactctcaccagcatcggcttcggcgccggcgtcacctcgacgcagaagatctggcacaccctgcaggcattcggcgacatcgccttcgcctactccttctccaacatcctcatcgagatccaagacacgatcaaggcgccaccaccgtcggagtcgaaggtgatgcagaaggcgacgcgtctcagcgtggcgacgacgaccatcttctacatgctgtgcggctgcatggggtacgcggctttcggtgacaacgcgccggataacctgctcaccggcttcggcttctacgagcccttctggctgctcgacgtcgccaacgtcgccatcgtcgtgcacctcgtcggcgcgtaccaggtgttctgccagcccatcttcgccttcgtcgagcgccgcgccgccgcggcgtggccggacagcgccttcatctcccgggagctccgtgtcggtcccttcgccctgagccttttccgcctgacatggcggtcggcgttcgtgtgcgtcaccaccgtcgtggccatgctgctgccgttcttcggcgacgtggcggggctcctcggcgccgtctcgttctggccgctcaccgtctacttccccgtcgagatgtacatcaagcaacgtcgtgtgcctcgtggaagccccaggtggatcagcctccagacgctcagcttcacctgcctcctcgtctccattgccgccgccgccggttccatcgccgacgtcgtggatgcgctcaaggtgtaccagccgttcagtggc

SEQ ID NO: 319 - DNA, 1858 bp, Triticum aestivum
  misc_feature (1835)..(1835): n is a, c, g, or t
  misc_feature (1843)..(1844): n is a, c, g, or t
ccacgcgtccgacaagaaccaccactccaagctcccgctagccgctagctaatcaaccccgccggcaaggcgagacacccgccagttgtcatcgtttccctgatggagaagaggcaggcgacctacgggaagggcgcggccaggatggcgcccatggaggtatcggtggaggccgggaacggcagggagtccgactggcttgacgacgacggccgcccgcgtcggtcgggcacggtgtggacggcgagcgcccacatcatcaccgccgtcatcggctcgggcgtcctctcgctggcgtgggccatcgcccagctcggctgggtggcgggccccgccatcatgctcctgttcgcgctcgtcatctactacacctccacgctcctcgccgagtgctaccgctccggcgacccggagaccggcaagcgcaactacacctacatggacgccgtccgctcctacctcccgggcaccaaggtgaagctgtgcggcgtcatccagtacgccaacctcgtcggcgtcgccatcggctacactatcgccgcctccatcagcatgcgggcgatcgggagggcggactgcttccactaccacgacgtcaggggccgcagcgggaaggacgagtgcaagagctccagcaacccgtacatgatcgtcttcggggtggtgcagatcctcttctcgcagataccggacttcgaccagatatggtggctctccatcgttgccgccgtcatgtccttcacctactccaccatcgggctcggcctcggcatcgcgcagaccgtcgccaacggcatccagggcagcctcaccggtctcagcgtcggcccgggcgtgacctccatgcagaaggtgtggcgcagcctccaggccttcggcaacatcgccttcgcatactcctactccatcatcctcatcgaaatccaggacacggtgaaggcgccgccgccgtcggaggcgaaggtgatgcagaaggcgacggggataagcgtggcgacgacgacggtgttctacatgctgtgcgggtgcatggggtacgcggcgttcggcgacgcggcgcccgacaaccttctcacggggttcggcttctacgagcccttctggctgctggacgtggccaacgccgccatcgtgctgcacctcgtcggcgcctaccaggtcttctgccagcccctcttcgccttcgtcgagaagtgggcggcggcgaggtggcccgacagcgccttcatcgcccgggagctccgcgtggggcccttcgccatcagcgtcttccgcctcacctggcgcacggccttcgtctgcctcaccaccgtcgtctccatgctgctccccttctttggcgacgtcgtggggctcctgggcgccgtcgcgttctggccactcaccgtctacttccccgtcgagatgtacatcgtgcagcgcggcgtgcgacgggggagcacgcggtgggtttgcctccagatgctcagcgccgcctgcctcgtcgtgtccgtggccgccgcggccgggtccattgccgacgtcatcggcgagctcaaggagtaccggccgttcagcggctgagcgatatttgtgtagggtggtgagtagcacagcggcacatgggagcacatgtgtgcgtacggcttgtgtgctgcatggagacggagacaaattaccgagcttcttgtgtgaacttctatcaagtagcaccttgtagatacttgtatttccgttgcaaaggacttctttcatgcatatcgttgcacccttacaatatcaatccaagtttattgtctttgccaatgtattgaaattagggttcgtttattgggagtgcctaaggcatcagttgncttaaaannaggggagccccgta

SEQ ID NO: 320 - DNA, 810 bp, Brassica rapa
ggtcgtcttattgcagagaaaaaaaaaattaaaagagcctcgaaaaattcacagacttgtctcccctcactctttagtagcttctgaaaatttcacagccctaaacaaacaaaaatgagcaagttctggactttcctcaccgctcttcactcaggcgctggtcccctggtgatgttggtgtatccattgtatgcatcggtggtggcaatggagagcacaacgaaagtagacgatgagcagtggcttgcctactggatcatttactccttcctcaccctcactgagctgattctacagtcgcttcttgagtggatcccgatctggtactcggtgaaactggtgttcgtcgcttggttggttctgcctcagttccatggcgcagctttcatctacaaccgtgtggtgagagagcagttcaagaaacacggcgtctttggctcctcctttcacaccaaacactccaaacccaacatcatccactccattttccaccgggagggacacgaggctcactctcactgacgccaaagcagaggagaagctcgaatagcattgtagtggagttggtggtggccgccccgtcttgtcttatgtctaatctttacttttgttttagttttatttaataatttgagaaatgtgatggatgatgactagtgaggtgtgtgattgttttaaattagaaatggcttcttcttgttgtattgctttagcttccacgcgtatcttccatttgggaacacaagtgttaaccgctattgtttcaatcgctttctaatgctaaatgacatgactgaaataattagtctt

SEQ ID NO: 321 - DNA, 847 bp, Brassica rapa
  misc_feature (842)..(842): n is a, c, g, or t
aagaatttttagagttgtctctctctctctctctctgttgctcactcttccagattttagtaccttctgaaagcttctaaaaaataagagaaaatgaccaagttttggactttggtcactgctcttcatacaggcgctgggcctgtggtgatgttggtgtatccattgtacgcatcggtggtagcgatggagaccgcaactaaagttgacgacgaacagtggctatcctactggatcatatactcgttcctcaccctcacagagctgattttgcaatctctccttgagtggattcctatttggtactcggtcaagcttgtgttcgtcgcttggttggttctgcctcagttccatggcgcagcgttcatctacaaccgtttggttagagaacagttcaagaaacacggtgtcttccctcaccaacagtccaagcccaagatcctccactccattttcccccaccgggagggacacgaggctcactctcactgacgcaagaacaaaaaaaaattaaagaaaagaggagtgagtagacacaagaagcttctttagctagtattgtaatggagttggtggtggtcccgtcttgtctaatcttacgtttagatttttgtttatacaaaaaagaatgggattggggaaggatatgaccatatgacgatgactgacgagttgtgtgatcgttttaaattagatgtgacttcttgttgttgtatggctttagctttcacgcgtaatttccatttgggaacacaagtgttacgctattgttgttcaaatcgttttcaaactttgtgaggatatagtgtcaccatgttaaaaaaaaattcaagcaaatatcntaccg

SEQ ID NO: 322 - DNA, 795 bp, Brassica napus
ggtcttcttgccgagaaaaaaaaaatttaaaagagcctcgaaaaattcacagacttgtctcccctctccctctctttctcactcttcagtagcttctgaaaatttcacagccctaaacaaacaaaaatgagcaagttctggactttcctcaccgctcttcactcaggcgctggtcctctggtgatgttggtgtatccattgtacgcatcggtggtggcaatggagagcacaaccaaagtagacgatgagcagtggcttgcctactggatcatttactccttcctcaccctcactgagctgattctgcagtcgcttcttgagtggatcccgatctggtactcggtgaaactggtgtttgtagcttggttggttctgcctcagttccatggtgcagctttcatctacaaccgtgtggtgagagaacagttcaagaaacacggcttcttcggctcctcctttcacaccaaacactccaaacccaacatcatccactccattttccaccgggagggacacgaggctcactctcactgacgccaaagcagaggagaagcacgaatagcattgtagtggagttggtggtggcccccgtcttgtcttatgtctaatctttacttttgttttagttttatttaataatttgagaaatgtgatggatgataactaatgaggtgtgtgatcgtttaaaagtagaaatggcttcttgttgtttttgttkktgttgtaatgctttagcttccacgcgtatcttccatttgggaacacaagtgttaacgctatttgtttcaatcgctt

SEQ ID NO: 323 - DNA, 779 bp, Raphanus sativus
gtcgtcttcttgcagagaaaaaaaaaattaaaagagcctcgaaaaattcacagacttgtctccctctctctttcagattttagtagcttctgaaaaatttctctaaaagaaaaaaatgagcaagttctggactttcctcactgctcttcactcaggcgctggcccactggttatgttggtgtatccattgtacgcatcggttgtggcaatggagagcacaacgaaagtagacgacgagcagtggcttgcgtactggatcatttactccttcctcaccctcacggagctgattctgcaatcccttctcgagtggatcccgatttggtattctgtgaaactggtgttcgtggcttggttggtcctgcctcagttccatggcgcagctttcatctacaaccgcgtggtgagagaacagttcaagaaacacggcgtcttcggctcctcctcctcctctcacaccaaacactccaagcactccaaacccaacatcatccactccattttccaccgggagggacaagaggctcactctcactgacgccaaagcggacgagaagctcgaatagcattgtaatgggagttggtggtggccccttcttgtcttcatgtctaatcttacttttgctttagtttttcatttaataatttgagaaatatgataatgactgaggaggtgtgtgatcgttttaaattagaaatggcttcttgttgttgtattgctttgattccacgacgacgtattttccatttggaacacaagtgttaacgctattgtccca

SEQ ID NO: 324 - DNA, 793 bp, Raphanus sativus
ataaatttaggcttttcctttcgcatcgcttgtcgtcttcttgcagataaaaaaattaaaaagagcttcgaaaaaaaatccacagacttgtctctctctctctctctctctctctctctcctctttcagactatagtagcagcttctgaaaatttcacagtccctaattaaacaagaaaaatgagcaaattctggactttcctcactgctctccactcaggcgctggtcctctggttatgttggtgtatccattgtacgcatcggtggtggcaatggagagcacaacgaaagtagacgatgagcagtggcttgcctactggatcatttactctttcctcaccctcacggagctgattctgcaatcgcttcttgagtggatcccgatttggtattctgtgaaactggtcttcgtagcctggttggtcctgcctcagttccatggcgcagctttcatctacaaccgcgtggtgagagaacagttcaagaaacacggcgtcttcggctcctcctcctcctctcacaccaaacactccaagctctccaaacccaacatcatccactccattttccaccgggagggacacgaggctcactctcactgactccaaggctgaggagaagctcgaatagcattgtaatgggagttggtggtggccccttctcgtcttcaagtctaatcttacttttgctttaatctttaatttaagtctttaatttaataatttgagaaaaaatatgataatgactgaggaggtgtgtgatcgttttaaattagaaatggcttgttgttgt

SEQ ID NO: 325 - DNA, 711 bp, Raphanus sativus
gtcgtcttcttgcagagaaaaaaaaaagagcatcgaaaatttcacagacttgtctccccctctctcttccagattttagtagcttctgaaaaatttcactaagaaaaaaaaatgagcaagttctggactttcctcactgctctccactcaggcgctggtccactggttatgttggtgtatccattgtacgcatcggtggtggcaatggagagcacaacgaaagtagacgacgagcagtggcttgcgtactggatcatttactccttcctcaccctcacggagctgattctgcaatcgcttctcgagtggatcccgatttggtattctgtgaaactggtgttcgtagcttggttggtcctgcctcagttccatggcgcagctttcatctacaaccgcgtggtgagagaacagttcaagaaacacggcgtcttcggctcctcatcctcctctcacaccaaacactccaagcactccaaacccaacatcatacactccattttccaccgggagggacacgaggctcaatctcactgacgtcaagggggaggagaagctcgaatagcattgtaatgggagttggtggtggccccttcttgtctttaagtctaatcttacttttgctttagtctttcatttaataatttgagaaaaatatgataatgactgagaggtgtgtgatcgttttaaattagaaatggcttgttgttgttg

SEQ ID NO: 326 - DNA, 897 bp, Raphanus sativus
ggggagaagagtgtgaatcaactgtagcgcaaacccgtacaaatgatgtctccaaagatatttttttctataaatttaggctcttcctttcgtatctgttgtcgtcttcttgcagagaaaaaaaattaaaagagcctcgaaaaaattcacagacttgtctccccctctctctttcagattttagtagcttctgaaaaatttcactaagaaaaaaaatgagcaagttctggactttcctcactgctctccactcaggcgctggtccactggtgatgttggtgtatccattgtacgcatcggtggtggcaatggagagcacaacgaaagtagacgacgagcagtggcttgcgtactggatcatttactcctttctcaccctcacggagctgattctgcaatcgcttcttgagtggatcccgatttggtattctgtgaaactggtgttcgtagcttggttggtcctgcctcagttccatggcgcagccttcatttacaaccgtgtggtgagagaacagttcaagaaacacggcgtcttcggctcctcctcctcctcctctcacaccaaacactccaagcactcctccaaacccaacatcatacactccattttccaccgggagggacacgaggctcactctcactgactccaaggctgaggagaagctcgaatagcattgtaatgggagttggtggtggccccttctcgtcttcaagtctaatcttacttttgctttagtctttaatttaagtctttaatttaataatttgagaaatgtgataatgactgaggaggtgtgtgatcgttttaaattagaaatggcttcttgttattgttgtattgcttagcttccacgacgcgtattttccatttggaaacacaagtgttaacgctattgt

SEQ ID NO: 327 - DNA, 825 bp, Thellungiella halophila
gatgttctctcagagaaaaattaaagagcctcgaagattccacagagttgtctctctctctctctgtctctcactcttgcagattttagcttctgaaaatttcacagccctaaacaaagaaaagatgagcaaattctggactttcctcactgctcttcattcaggcgctgggcccctggtgatgctgctgtatccattgtacgcatcggtggtagcaatggagagcgcgacgaaagtagacgatgaacagtggctagcgtactggatcatatactcgttcctgacactatcggagctgattctgcaatcgctgcttgagtggattccaatctggtactctgtgaaactcgtgttcatcgcttggcttgttcttcctcagttccaaggagccgcttttatctacaaccgtttggtcagagaacagttcaagaaacacggcgtcttccgctcctcttcccaccattccaagcacaacaacaagcccagcctcctccaatccattttcccccatcgggagggacatggacacgaggctcactctcactgacgcaaaaaaatgaggagtaagttgacgtaagaagctttgccgaagtattgtaatggagtttgtggtggtccctgtcatgtctaaagtctaatctcacttttgcttttgttttattttatatttataaaaaatgtgtttgggaatgatgactgatgaggagtgtaatcgtattaaattagagatgggatctagacttgttgttgtatcgcttcgcttccacgcgtattaggaagtatttaatctctaatgtaattctaagcttctaatacgttttctcc

SEQ ID NO: 328 - DNA, 880 bp, Malus domestica
gaacccatacaaacggaacaattcttgcttcagctagcgacttccatcagagagagtgcgagtgaggctcgagaaagttccgagtcgactcagtgagcgaagcgaagatggcgaatgagccaactcggataatgctgggagtgaacgagtcgaccatcaagggctacccgcacccctcgatcagtagcaggaaggcgttcgagtggacgctccagaagatcgtgcgctccaacaccagtggcttcaagctccagttccttcacgtccaagtccccgacgaagacggttttgacgacatggacagtgtgtatgcatcgccggaggattttaaaaacttgaagaacagagaccgagctcgagggcttcatctgctggagttctttgttgacagatgtcatgcaatcggggttgcttgtgaagcatggatcaaaagaggggatgccaaggaagtaatctgccgcgaggtgaagcatgtgcagccagaccttctggtggtgggctgtcggggtcttggtcctttccagagggtttttgttgggaccgtgagcgagttttgcgtgaagcatgctgagtgtccggtcatcacaatcaagcgcagtgcagaggaaacaccccaggatcctgtcgatgactgaatgttaccggaatgtgtatgttttgtttctttaattccgtcagtacacttccggcaccagacccttgtacctaaaaaccaactgggaataaattacatgtatcgcttcggtcgtgtgaattttagttctttcaaatcgcatgcagagggaattacactaatatgtccgatgaaacttgaatattttgcgttgtattgcaattagtttgggagctcgttttcgagctttcttgttcataaaaaaaa

SEQ ID NO: 329 - DNA, 753 bp, Malus domestica
gcctacggctgcgaacccacaaaacgaagcaagtcatccttcggttaccgccttcatcagagagagagagagtactgtggttccagaaagttcgaatcagcaagcgagtcgactcagtgtcgtgagcgaagcgaagatggcaagcgagccaactcggataatgctggcagtgaacgagtcgaccatcaagggctacccgcacgcctccatcagcagcaggaaggcgttcgagtggacgctccagaagatcgtgcgctccaacaccagtggtttcaagctccagttcctgcacgtccaagtccccgatgaagacggttttgatgacatggacagtgtctatgcatcgccggaggattttaaaaacatgaaggacagagaccgcgccagagggcttcatctgctggagttcttcgttgacagatgtaatgcaattggggttgcttgtgaagcatggatcaaaagaggggatgccaaggaagtaatctgccgtgaggtgaagcgtgtccggccagactttctggtggtgggctgtcgggggcttggacctttccagagggtttttgttgggactgtgagcgagttctgcgtgaagcacgctgagtgccccgtcatcacaatcaagcgcagcgcagaggaaacaccccaggatcccgtcgatgactgagtatcatcggaatgtgtattctctgtttccttgttccgtcaatacactcttccsacaccaamcccttgtacctaaaaaccaaccgggaa

SEQ ID NO: 330 - DNA, 867 bp, Prunus armeniaca
tggcacgaggtcaccagagagtgagagagattggaagcgagcgagcgagtgactcagtgagcgaagaagatggagggtgacccaactcggataatgctggcagtgaacgagtcgacgatcaaggggtacccgcacgcctccataagcagcagaaaggccttcgagtggactctgcagaagatcgtccgctccaacacctctggcttcaagctcctcttccttcatgcccaagtccctgacgaagacggttttgatgacatggatagtgtctatgcatcacctgaggatttcaaaaatctgaggaatagagaccgcgccagagggcttcatctgctggagttctttgttgaaagatgtcatgcaattggggttggttgtgaggcatggatcaaaaaaggggatcccaaggaagtaatctgtcatgaggtgaagcgtgtgcatccagactttctggttgtgggctgccggggtcttggtcctttccagagggtttttgttgggacagtgagtgaattttgcgtgaagcatgctgagtgccctgtgatcacaatcaagcgcagcgcagaggaatcacctcaggatcctgttgatgactgagttttcctggaatgtgtatgcttgaattctttaattctgtccagtcaytttctacatcagacccttgtacctaaacaccaactgggaacaaattgatgcattgcttctgtttgcaattatgcgcagacgaagaattacggtgaaatgtacgaaggaacttggatattttgtgttgtattactattagtttgggagttcattttaggagctttcttgtttatcatataatattaggagctttcttgtttatcatataatattggcttaata

SEQ ID NO: 331 - DNA, 631 bp, Brassica oleracea
gggcggaggactctgcttgattgccttttcaccgccttcttcctctagagaacttcagagatggagagcgagccaactcgagtgatggttgcggtgaacgagtcgacgatcaaaggctacccgcacgcgtcgataagcagcaaaaaggcgttcgagtggacactgaggaagatcgttcgctccaatacctctggcttcaagcttctcttgcttcacgctcaagtccaggacgaagacggttttgatgacatggacagcatatatgcttcccctgatgatttccgaaacatgagggaacgtaacaaggctaatggacttcaccttcttgagttcttcgttaataaatgtcatgagattggggttcggtgtgaggcctggatcaggaaaggtgatcccacggaagtgatatgccatgaagttaggcgtgtcaggccagattttctggttgtcggaagtcgtggtctcggtccattccagaaggtatttgttggaacggtgagtgagttttgtgtgaagcatgcagagtgcccagtcatcataatcaaacgcagtgctgaagaragtcyacaagatccagctgatgactaaatttcaaaagcaagacaatccatgcggtgttcttttgtctgtg

SEQ ID NO: 332 - DNA, 848 bp, Brassica rapa
ctattttcaaaggactttgcgaatccaccctgcttgattgcctctagagaacgacgacggagacgacgatttcagaaatggagagcgagccaactcgagtgatggtggcggtgaacgagtcgacgatcaaaggctacccgcacgcgtcgataagcagcaaaaaggcgttcgagtggacactgaagaagatcgttaggtccaacacctctggcttcaagctcctcttgcttcacgctcaagtccaggacgaagacggttttgatgacgtggacagcatatatgcttcccctgatgacttccgaaacatgagggagcgtaacaaggctaatggacttcaccttcttgagttcttcgttaataaatgtcatgagattggggttaggtgtgaggcctggatcaggaaaggtgatcccacggaagtgatatgccatgaagttaggcgtgtgaggccagattttctggttgtgggaagtcgtggtctcggtccatttcaaaaggtatttgttggaacggttagtgagttttgtgtgaagcatgcagagtgcccagtcatcataatcaaacgcagtgctgaagagagtccacaagatccagctgatgactaaattccaaaagcaagacaatccatgcggtgttcttttgtctctgagagacaacaaactaaccgtatgttgcagtacatgagaagggaaaaaggataaacagaactcttttgaattatctagtatgtggtgcgtctctagttgttgtagaactcgattcacatgatatatatttgtgtggtcaatgccttcgtctttcattctctaaaacatccaaacagaagttctattattcggtgtgtaatc

SEQ ID NO: 333 - DNA, 856 bp, Theobroma cacao
cgggggagagaaagagagagagagagagagagagagagtagttaccaagtgagtgagtggttcagtgagttgggagtgaaaagatggcaacaagtgaggcaaccgcaacacggataatgttggcagtgaaccagtcaacgatcaaagggtaccctcacgcttcgataagcagcagaggagctttcgagtggactcttcagaagatcgttcgatcaaacacttccggtttcaagcttctcttcctccatgttcaagttcccgatgaagatgggttcgatgacatggacagcatatttgcctctcctgaagatttcaagagcatgaggcacagggacagggcaagagggcttcatytgctggaatrctttgttacaaagtgtcatcagattggggttgcttytgaagcatggatcaagaaaggtgatccaaaggaggttwtytgtcatgaagtgaagagggtccagcctgatctccttgttgtgggtagtagaggactcggtcctttccagcgggtgtttgttggaactgtgagtgaattttgcgtgaagcatgctgagtgcccagttgtcacgatcaagcgcaatccggatgaagctcctcaggaccctgtggatgactaaatttgattcgatgcatatggatttttttgtttcattytgttaatgggtgtggrgaytytggaacttcctaattcatatatcagtggggataacaaatgaattgcttttgcttttggaaaaaccccctggggatgtgttgatgtatgcaaaaaaaaaaaccctactgctattggcctgtccttttatgtaaggtgsggtttgattgwattacttgcacaaaccttttttttgcccta

SEQ ID NO: 334 - DNA, 993 bp, Brassica napus
gagttattgtaaagaggactctacttgattgccttttcaccgccttcttcctatagagaacgacaatggagagcgagccaactcgagtgatggtggcggtgaacgagtcgtcgatcaaaggctacccacacgcgtcgataagcagcaaaaaggcgttcgagtggacactgaagaagatcgtgaagtccaatacctctggcttcaagcttctcttgcttcacgctcaagtccaggacgaagacggttttgatgacatggacagcatatatgcttcccctgatgatttccgaaacatgagggaacgtaacaaggctaatggacttcaccttcttgagtttttcgttaataaatgtcatgagattggggttcggtgtgaggcctggatcaggaaaggtgatcccacggaagtgatatgccatgaagttaggcgtgtcaggccagattttctggttgtcggaagtcgtggtcttggtccattccagaaggtatttgttggaacggtgagtgagttttgtgtgaagcatgcagagtgcccagtcatcataatcaaacgcagtgctgaagaaagtccacaagatccagctgatgactaaatttcaaaagcaagacaatccatgcggtgttcttttgtctgtgagagacaacaaaccgtatgtagcagcacatgagaagagaaaaaggataaacaaaactcttttgaatggtctaaaacatccaaacagaagttctattattcggtgtgtaatcttttgactcttatgtcttaaatgtatggtttatataagtgcctatgttgtgcgtctcttgttgtagtagaaactcgattcacatatatttaatygtgtgtggtcaatgccttcgtctttcattctctaaaacatccaaacagaagttctattattcggtgtgcaatctttcgactcttatgtcttaaatgtatggtttatataagtgcgtatgttgtgcgtctctagttgtagtagaaactgtgtg

SEQ ID NO: 335 - DNA, 915 bp, Brassica napus
gagaatacatctttctattttcagaggactttgccaatccaccctgctggattgcctcttcaccgccttcttcctctagagaacgacgacagagacgaagatttcagaaatggagagcgagccaactcgagtgatggtggcggtgaacgagtcgacgatcaaaggctacccgcacgcgtcgataagcagcaaaaaggcgttcgagtggacactgaagaagatcgttaggtccaacacctctggcttcaagctcctcttgcttcacgctcaagtccaggacgaagacggttttgatgacgtggacagcatatatgcttcccctgatgacttccgaaacatgagggagcgtaacaaggctaatggacttcaccttcttgagtttttcgttaataaatgtcatgagattggggttaggtgtgaggcctggatcaggaaaggtgatcccacggaagtgatatgccatgaagttaggcgtgtcaggccagattttctggttgtgggaagtcgtggtctcggtccatttcaaaaggtatttgttggaacggtgagtgagttttgtgtgaagcatgcagaatgcccagtcatcattatcaaacgcagtgctgaagagagtccacaagatccagctgatgactaaattccaaatgcaagacaagccatgcggtgttcttttgtctgtgagagataacaaacaaaccgtatgttgcagtacatgagaagagaaaaaggataaacataactcttttgaatggtctagtatgtggtgcgtctctagctgttgtagaaactcgattcacatgatatatgactgtgtggtcaatgccttcgtctttcattctctaaaacatccaaacagaagttccattattcggtgtgtaatctttcgactcttctgttttaaatatatggtttata

SEQ ID NO: 336 - DNA, 818 bp, Manihot esculenta
gggagagaaaacccgcttttgcatttgctagacaaagcgtgagagagagggggacgacagagagcaactcagtgagttaagttgaaaatggaaggtgaaccgactcggataatgataggagtgaacgagtcaacaatcaaagggtatccacacccttcgattagtagcaaaggagctttcgactggactcttcagaagattgttcgctctaacacttgtggtttcaagcttctcttccttcatgtccaagtccctgacgaagacggttttgatgatatggatagcatatatgcatctcctgatgattttaaaagcatgaaacagagggacagagtgcgaggacttcatcttctggagtactttgtcaatagatgtcatcagattggggttgcttgtgaagcgtggttgaagagaggtgatcccaaggaagaaatctgccgtgaagtgagacgagtccagcctgatctcctggttgtcggaagtcgtggtcttggtcctttccagagggtttttgttggaactgtgagcgaattttgccagaagcatgctgagtgcccagtaatctcaatcaaacgtagggctgaagaaactccacaagatcctgttgatgactgaatttctattgctctatgtgattagttccattatgttgagaggcgctgaacattaggaatgcttatgcataaggtgaatggtggaaactggaaaaatcaagtggatgtttctgttaatatgttctcattgctacacagtactcgtgtaaaagaaatatacattacctatttgttggaaatataactaatttttctctgagcatc

SEQ ID NO: 337 - DNA, 715 bp, Catharanthus roseus
  misc_feature (616)..(616): n is a, c, g, or t
agacaaagagcagtagctcgagagaacgggtagagatcggcgcgcaatcaattagaggtccgacggtaggattcgccgcagaatggagagcgagccgactcggattatgatcggagtgaaccagtcgacgatcaagggttacccgcatacatcaataagtagcaaaggagccttcgattggactctgaagaagatcattcgttcgaacatctctggcttcaaacttctcttcctccatgtycaagttccagatgaagatggttttgatgacatggatagcatatatgcctcaccggaagattttaaaagaatgaatcgcagagacaaaatcaggggacttcatttgttggagtattttgtgcaccaatgtcatgagattgggattgcttgtgaagcatggatcaagaaaggcgatcccaaggaagtaatctgccatgaagttaaacgcgtccagccagacatccttgttgttgggagtagaggactaggtccattccagagggttttcgkgggtaccgtgagtgaattttgtgcaaaacatggtgaatgccctgtcatcacgatcaaacgcagtgcagccgagtccccacaagaacctgtcgatgattagattatntccgatgtatataccctatctgtgtcatcctaccatcctgtcgaaagagatgaatccagtgtgaaaatgatatcctatgaaacttttcccatttcttga

SEQ ID NO: 338 - DNA, 826 bp, Citrus sinensis
tgtcagagagaaaagagagtgtctgagttgaattgagttggtcacactgagcgagtgaaaatggaaggcgagccgactcggataatagtggcggtgaacgagtcgacgataaaaggttacccgcacgcgtcgattagcagcagaggagcgttcgagtggagcgtgcagaagatcattcgctctaacacttctggcttcaagcttctctttctccacgtccaggttcccgatgaagatggttttgatgatatggatagcatatatgcatctcctgaagatttcagacgcatgcagcacagggacaaagtgagaggacttcatcttctggagtattttgtcaacagatgtcatgagattggggtagcttgtgaagcatggattaagaaaggagatcccaaagaagtaatctgccgcgaagtgcaacgtgtccagccagatctcctggttgtgggaagtcggggacttggtccttttcagagggtctttgttgggactgtgagtgaattttgtgtgaagcatgctgagtgccctgtgataaccattaaacgtagggcagatgaaactcctgaggaccctgttgatgactgaactgatcactatctcaatatttttcatcctgttgataaactttggacagaaaacgttagttgggggagatattaaatgtactgcttagaaatacttgtctatttgttgagaatatattgcctggacgaatatgctttgtaatctgttaaatgggtccgcctaagttacattcaatgtaacttacggccagcatgtaaaaattcattcagccccccatattctatgttatttatatttt

SEQ ID NO: 339 - DNA, 782 bp, Coffea canephora
gactctagactcgtccaggggcttcacagaggaaaagctctagttccagtcctgttgagatttgagaaagagcgactcagtgagtgaggtagggacgaaaattagaactgagaaagatggagagcgagccaactcggataatgatgggagtgaacgagtcgacgatcaaggggtatccgcatgcatccatcagcagcagaggagcttttgattggactctgaaaaagatcattcgctccaacacttctggcttcaaaattcttttcctacrtgttcaagttcctgatgaagatggttttgatgatatggatagcatatttgcatcaccagaagattttaggagaatgaatcacaggaacaagatcagaggacttcatctgctagagtattttgtgaacagatgccatgaagttggggttgcttgtgaagcatggatcamgaaaggtgatccgaaggaagttatctgtcatgaagttaggcgtgttcaaccagactttctcgttgttggaagtagaggacttggtccattccagagagttttcgtaggaacagtcagtgaattttgtgtgaagcatgccgaatgtcctgtcatcaccatcaaacgcagtgcagccgaatctcctcaagatcctgtagatgactagagcattcttgatgtatacgttaggtttccagctctgtctgtatagtaatttactggatttcggtgtgtgtggatgagattaagtgatatttgtttcccccacccttggttcctctgcttcttagttttctaatcgtta

SEQ ID NO: 340 - DNA, 933 bp, Gossypium hirsutum
tgcgcactttcccttttaacctccctcgccttggcatttcttgaagctagagacttcataaagcttaacagatcagagagagaactgttaccgagtgagtgactcagtgagttaggggtgacaagatggctacaagtgaggcatccgtgactcggataatggtggcggtgaatgagtcaacgatcaaaggttaccctcacgcttctataagtagtaagggagctttcgagtggactcttcagaagatcgttatgtccaacacttctggtttcaagcttctcttcctccatgttcaagttcccgatgaagatggtttcgatgacatggacagcatatatgcctctcctgaagatttcaagagcctgaagagcagggaccgggctagagggcttcatctgcttgaattctttgttacaaggtgccatgaaattggggttgcgtgtgaagcatggatcaagaaaggtgatccaaaggaagttatctgccatgaagtgaggaggatccagccagatcttcttgttcttggtagcagaggacttggtcctttccaacgggtttttgtcggaacggtgagcgagttttgcgtgaagcatgctgagtgccctgtcgtaacaatcaagcgtagatcggatgaaactcctcaagaccccgtcgatgactaaatttgtttcacagaccccttgattcattgctcttggttctgttaatagacttgaaactctacgactttaccaattccatatatcagtggggataagaaatgaattgcttctgttttggtggaaaaaatactctgttgtggattgcgtttgttgtgtgcaaagagaactgctattattagtctggcccgtatataaagttgtatttgctttaattacttccaaaaccctttctcgtgttcttttttttatttactagattttaccaagattc

SEQ ID NO: 341 - DNA, 811 bp, Cynara scolymus
gggcacgacataccagagacctcctcagaaagaaaacataacatcgagtttagaagcaggaagcaagcaagcatccatggcgacgatccgagttgactcggaagtgactcggataatgatgggagtgaacgagtcaagcatcaaaggttatccacatgcttcaattagtagcaaatcagctttcgaatggaccttgaacaaaatcattcgttcaaatacctctggttttaagctcttatttctccatgtccaagttcctgatgaagacggttttgatgatattgatagtatatatgcctcaccggaagattttagagatctcaatcgcaaggacaagattaatggatctcatcttcttgagtactttgtgaacagaagtcatgaaataggggttgcttgtgaagcatggattaagaagggtgatcccaaagaagtaatctgccatgaggttaaaagagtccaaccagacctccttgttgttgggaacaggggtcttggtcccttccagagggtttttgtaggaacggtgagcgaattttgtgtgaagcattgtgaatgccccgttgtaacaatcaaacgcagcgcagacgaaactccccaagatcccgtagatgactgaatgtttgttcatatatttacctgtgtatgttttatatttttcatcaaagatttggatatatcttccgagtcctttttcccgtcttttatgacccttttcgcctatatagttattgcgtgtttgttttaaaaacgataaatgttatttggccttgtgkttcgtgcaatggtcgatgaatatggatatcctacg

SEQ ID NO: 342 - DNA, 793 bp, Ipomoea nil
cataaaattaggatctacagcattccagatgctcggactccggagcaccttgctaagaagctaatcgttcatttcacagacagagagtgagagggagggagagagagagtctctgtgtgtgtgttttagtttggtggtgactcggcgatttcatagggaaatggcagacgaacagactaagattatgatcgcagtgaacgagtcgacgatgaaggggtatccacacccatctatcagcagcaaaggggccttcgaatggactctcgacaagatcgtccgctccaacaccgctggcttcaagctcttatttctccatgtccaagttcctgttgaagacggttttgatgacacggatagcctctttgcatcacctgaggatttcaagaacttgagacacaaggacaagataaagggactccatctgctggaatacttcgtcaaccaatgtcatgagcgtggggtatcttgtgaagcatggatcaagagaggagatcccaaggatgtcatctgccacgagattaaacgtgtgcatcctgatcttcttgtagttggctgccgtggtcttgggcctttccagcgggtattcgtgggaactgttagtgaattttgtgttaagcatgctgaatgtcctgttgtcacaatcaagcgcagtgcatcagagacccctcaggaccctgttgatgactaaaatgtttgtgctatctatctggcgtctattgatagatttaaaaattcaacaaagagttgtttcatttcattgtatatgaatatcgagtaaatatgtatatgctct

SEQ ID NO: 343 - DNA, 863 bp, Actinidia deliciosa
ttcagagcgatcgagcgagattcacaaagttgagagagagagwgagaggaatggaaggcggagcggaatcggtggcaactcggataatggtgggagtgaacgagtctaccataaagggctatccccacgcttccattagcagcaaaggagctttcgagtggactctgaagaagatcgtccgctccaacacctcctccttcaagctcctcttcctccatgtccaagtcaccgacgaagacggtttcgatgatatggacagtatctatgcatcacctgatgattttaagaccatgaaccgcaggaacaagataagagggctccatttgttggagtactttgtccataggtgtcatgagattggggytccttgtgaagcatggatcaagaaaggtgatcccaaggaagttatcttgcatgaggtcaaacgagtccaacccgattttctggttgtgggaagcaggggtcttggcccttttcagaaggtttttgttggcaccgtgagtgaattttgtgtgaagcacgccgattgtcccgtcatcacaatcaaacgcaagcctggtgaggctcctcaagacccagctgatgattgattgtatctgatgtgctttcataatcgttctgtcaataaacataaacaatggtagcggaactcgtccctgtagatgaagtatatgtgagtatctctctcatgtgtagtgaatttgggctccgtcattgtaacaactccaggtttggagatgcattcggagttgttttttgtagtggaaaatggagcctgtagctcatttgtattatttttagtcctgtgttttwtgtgaactagctatttcgwtcaaaattagtagtttctcgcggaaaaaaaa

SEQ ID NO: 344 - DNA, 888 bp, Prunus persica
ctatcgtacgctctgatgcgtggtgcgcgcactcgggtttatggcttgcaaattaaatacagaacggtgaaacaataaaccagtgtttcagcttgcgtaccgacatagtcaccagagagtgagagagagagatagagttggaagcgagcgagcgagtgactcagtgagcgaagaagatggggggtgagccaactcggataatgctggcagtgaacgagtcgacgatcaaggggtacccgcacgcctccataagcagcagaaaggccttcgagtggactctgcataagatcgtccgctccaacacctctggcttcaagctcctcttccttcatgtccaagtccctgacgaagacggttttgatgacatggatagtgtctatgcatcacctgaggatttcaaaaatctgaggaatagagaccgcgccaaagggcttcatctgctggagttttttgttgaaagatgtcatgcaattggggttggttgtgaagcatggataaaaaaaggggatcccaaggaagtaatctgtcatgaggtgaagcgtgtgcagcctgactttctggttgtgggctgccggggtcttggtcctttccagagggtttttgttgggacagtgagtgaattttgcgtgaagcatgctgagtgccctgtgatcacaatcaagcgcagcgcagaggaaacacctcaggatcctgttgatgactgaattttcctggaatgtgtatgcttgaattctttaattctgtccagacactttctacatcagacccttgtacctaaacaccaactgggaacaaattagatgtattgcttctgtttgcaattatgtgcagacgaagaattacggcgaaatgtacgaaggaacttggatattttgtgttgtattgcaa

SEQ ID NO: 345 - DNA, 682 bp, Capsicum annuum
attgaaggcgaggtagggatggaaggcgagtcaaccctggtgatggtagcagtgagtgagtcgacgatcaacggttatccacatgcttccattagcagtaaaggagcattcgagtggactcttaacaagatcgttcgttccaacacttctggtttcaaactccttttccttcatgtacaagttcccgatgaagatggttttgaagatatggatagcatatttgcatcacctgaggatttcaagggcatgaaaaacagggacaagattagaggactccatctgctggagtgctttgttaaccgctgtcatgaaattggggttccttgtgaagcatggacaaagaaaggtgatcccaaggaaatcatttgccacgaagtcaaacgtgtacagccagatcttcttgtggttggttgccgtggtcttggtccttttcagagggttttcgtgggaactgtaagcgagttctgtgtcaagcatgctgaatgtcctgttgttacaattaagcgcagtgcagctgagactcctcaggaccccatagatgattaattcatttggtgtatttgaccgcttcatgttcaacgatgcatgcatattagatgtctacttgtcacagcgtgaaaagattgtggggattttcattttggtgctgtttctgtagcctatatctgtctgccttcttgtt

SEQ ID NO: 346 - DNA, 715 bp, Catharanthus roseus; identical to SEQ ID NO: 337
  misc_feature (616)..(616): n is a, c, g, or t

SEQ ID NO: 347 - DNA, 811 bp, Petunia hybrida
agaaatcaatcaakcaaagcaaagcaaagcaatggcaaatgaaggagagataacaaagataatgttaggagtaaatgaatcaacgatcaaaggatatccacatgcttcaattagcagtaaaggcgcatttgaatggactcttaacaagctcgttcgtaacaatactkctggttttaagctgctttttcttcatgttaaagttcctgatgaagacggttttgatgacatggacagcatatttgcatcacctgatgatttcaaggtcatgaaacacaagggacaagatcagagggctccatctgctggaatactttgttaaccgatgtcatgaaatatgggattccttgtgaagcatggatgaagagaggtgatcccaaggaagtcatctgccatgaagtcaaacgtgtacagccagatcttcttgtggttggctgccgtggtcttggtccttttcagagggttttcgtgggaactgtaagtgagttctgtgttaagcatgctgaatgccctgttgtcacaatcaagcgaagtgcagctgaaactcctcaggatcctattgatgactaaatctattgatgtgtttgatagcgcttaatgtccatagacgcttagataatcgacttgtggtgtagataaactgcatggattttcattctggttcttctacagcctatatctgctctgctgtgggattcatgattgttgcttgcatgtgtagtagagacgtctcgtgtaaatgtgtgagatttgagtactcctggagcctgtatgtgctgaatgttggtctgaaagaagattttcgcttgctgcc

SEQ ID NO: 348 - DNA, 844 bp, Populus trichocarpa
gcctcccctgtgcttatatgaagtgagagagagagagagagagagagagaagaggagagtgagtgagttacctagagaagatggaaggtgctgaggcaactcggataatgatgggagtgaacgagtcaacaataaaagggtatccacacgcatcgattagtagcagaggagcttttgattggactcttcaaaagatcgttcgatccaatacctctggttttaagcttcttttcctccatgttcaagtccctgacgaggatggttttgatgacatggatagtttgtatgcctcacctgaggattttaaaaacatgaagcatagggataggaccaggggacttcatctgctggagtactttgtcaatagatgccatgagattggggttgcctgtgaagcatggatcaagaaaggagatcccaaggaagtaatttgccatgaagtaaaacgagtccagccagatctcctggttgttggaagtcgcggtcttggcccttttcagagggtttttgtgggaacagtgagtgaattttgccagaagcatgctgaatgtccagtgatctcaattaagcgtagagctgatgaaactcctcaggatcctgttgatgactgaatttgtctcgattgtgaatcgtcttttttccctgtattaaaagatcatgaacgctatgaacatgcacatgtgaatgttgtcctgtttgagtatatgtcttgccgatgctgatgataaatggaagtcaatgcccttgttgaaactgtcgtacctttcgcagtttcatggtcaatgtcttgagcctagccttccatttttggtttcctcggctgatttggatggtaagctttgtt

SEQ ID NO: 349 - DNA, 1018 bp, Prunus persica
aggaacagaagcgcgcatattagcattcttttgtaaatatccactatcgtacgctctgatgcgtggtgcgcgcactcgggtttatggcttgcaaattaaatacagaacggtgaaacaataaaccagtgtttcagcttgcgtaccgacatagtcaccagagagtgagagagagagatagagttggaagcgagcgagcgagtgactcagtgagcgaagaagatggggggtgagccaactcggataatgctggcagtgaacgagtcgacgatcaaggggtacccgcacgcctccataagcagcagaaaggccttcgagtggactctgcataagatcgtccgctccaacacctctggcttcaagctcctcttccttcatgtccaagtccctgacgaagacggttttgatgacatggatagtgtctatgcatcacctgaggatttcaaaaatctgaggaatagagaccgcgccaaagggcttcatctgctggagttttttgttgaaagatgtcatgcaattggggttggttgtgaagcatggataaaaaaaggggatcccaaggaagtaatctgtcatgaggtgaagcgtgtgcagcctgactttctggttgtgggctgccggggtcttggtcctttccagagggtttttgttgggacagtgagtgaattttgcgtgaagcatgctgagtgccctgtgatcacaatcaagcgcagcgcagaggaaacacctcaggatcctgttgatgactgaattttcctggaatgtgtatgcttgaattctttaattctgtccagacactttctacatcagacccttgtacctaaacaccaactgggaacaaattagatgyattgcttctgtttgcaattatgygcagacgaagaattacggtgaaatgtacgaaggaacttggatattttgtgttgtattactattagtttgggagttcattttaggagctttcttgtttatcatataatattaggagctttcttgtttatcatataatattggcttaata

SEQ ID NO: 350 - DNA, 783 bp, Carthamus tinctorius
cgggggattatttagatagcaaatggaaggaaggaaggaaggaaggaaggaagcaagcattcatccatggcgacgacgatccgagttgactcggaggtgactcggataatgatgggagtgaacgagtcgagcatcaaaggctatccacatgcttccatcagtagcaaatcagcattcgaatggaccttgaacaagatcattcggtccaatacctctggtttcaagctcttattcctccatgttcaagttcctgatgaagacggttttgatgaggtcgatagcatatatgcgtcaccagaagattttagagatgccaatcgcagggacaagattaatggatctcatcttcttgagtactttgtgaacagaagtcatgaaataggggttgcttgtgaagcatgggttaagaagggtgatcccaaggaagtaatctgccatgaggtcaaaagagtccaacctgacctccttgttgttgggaacaggggtcttggtcccttccaaagggtttttgtaggaacggtgagcgaattttgcgtgaagcactgtgaatgccccgttgtaacgatcaaacgcagtgcagatgaaactccccaagatcccgtagacgactaattgtttgttcatatttttacctgtgtgtgtttcatattcccgtcgaagcgttagatgcatcttttctttgatgtttgaatattatgagtttctttagaaaacgatgaatgttgttattygstcgragtgwytyacgtamtcgtacacaaacsgtgttttactggaacttaa

SEQ ID NO: 351 - DNA, 956 bp, Glycine max
gatcaaagaacaaagagagtgaattgactcggggtgagttgactcagcgatggcggaagaggtgactcgggtgatggtggcagtgaacgagtcgagcatgaagggataccctcatccttcgatcagcagcaaaggggctttcgaatggaccatcaacaagatcgttcgcaacaacgtctctgccttcaaccttctttttcttcacgttcaagtccccgatgaagatggttttaatgacatggatagtatctacgcatcgcctgacgattttaagaacatgaatcagagagatagaattagaggggttcatctgatggaatacttcgtcaataggtgtcatgaaattggggtggtttgtcaagcatggataatgaagggtgatcccaaagaagtaatatgtcatgaagtgaaacgactaaggcctgatcttctggttgtgggtagccgaggtcttggaccttttcaaaaggtttttgttggcactgtgagtgaattttgttggaagcatgctgaatgccctgtcattagtatcaaacgcaagccagatgaaactccccaggaccctgttgatgactgatatttattttgtaatacaccagacattgaagatagtttacctatgctcccatgctttgtgtagtcaaaagaaagaaaaaatatcattcaagattagtatatggagatttacaatgtgggaacacgagcaggaaatccaacttttggtgcttttttgcctttgttccttttgtccagtttgtaattccaagatgtgttgatttcttttagtgtacaaatctatccgcttaagtcaatgttgtttgtaattctgaaagttggatgctgtaatattgctcttcaatgtgatgcatgcattatttattttaccaagccatactcaattgttcttcaatggatggtgtagtaatatttctcttaacgtgtctcgacttcttaat

SEQ ID NO: 352 - DNA, 961 bp, Glycine max
ggagtggagcgaagtgaattgaaattgaagtgactcggggtgagttgactcagcaatggcggaagaggtgactcgggtgatggtggcggtgaacgagtcgagcattaagggataccctcatccttcgatcagcagcaaaggggctttcgactggaccatcaacaagatcgttcgcgacaacgtctctgccttcaaccttctttttcttcacgttcaagtccccgatgaagatggttttgatgacatggatagtatctttgcttctcctgacgattttaagaacatgaatcagagagatagaattagaggagttcatctgctggaatacttcatcaataggtgtcatgaaattggggtggtttgtcaagcatggataatgcatggtgatcccaaagaagtaatatgtcatgaagtgaaacgactaaggccagatcttctggttgtgggtagccgaggtcttggaccttttcaaaaggtttttgttggcactgtgagtgaattttgttggaaacatgctgaatgccctgtcattagtatcaaacgcaagccagatgaaactcctcaggaccctgttgatgactgatatcttgtcatacaccagacattgaagatagatcacctatgctcccatgctttatgtagtaaaaagaagaaaagaaaagaattgaatatcattcaagattagtatatggagattttcaatgtaggaataggagcaggaaatccaacttttgatgcttttattgcctttgttccttttatctagtctgtaattctatgatgtgttgatttcttttagtgtacaaatctatctgcttaagtcaatgttgtttgtaattctgaaagatggatgccgtaatattgctcttcaatgtgatgcatgcattaatttaccaagccataatttcttcaatggatggtgtagtaatattgctcttcatgtgtctcggcttcttgatat

SEQ ID NO: 353 - DNA, 937 bp, Euphorbia esula
  misc_feature (4)..(6): n is a, c, g, or t
gaannnctcctactgaactttacagagagaagagagacgactggttttgcgagggaaaaagaattctcattctggaagctcgaactcgtggtctcaactcagtgtgtttggcataaaaatggaaggtgagccgactcggataatgatagctgtgaacgagtcaactatcaaaagctatccacatccttccattagtagcaaaggtgctttcgaatggactcttgaaaagatcgttcgttctaactcgcctggttttaagcttctcttcctccacgtccaagtccccgatgaagacggttttgatgatatggatagtatatatgcatctccagaggattttaagagcatgaagaagagggataagatcagaggaatccatctcctggagtattttgtcgataaatgtcaccacatggggattacgtgtgaatcatgggttaagcacggggatcctaaggagataatctgccatgaagtgaagagagtgcagccggatcttctggtggtgggatgtagggggcttggtcctttccagagggtgtttgttggaacagtgagtgaattctgccaaaagcatgcagagtgcccagttctctccatcaagcgtagagctgaggaaactcctgaggatcctgtcgatgactgatattttatgtttgctttcttctgaacaacagtaataataatatgaacaccttatctgtggaactttagtgctagtattgttgtattttgcctaggattatatatcaactgtgctgtgtgtaaagagagtgcttgcttattagttggatatagtatccatctttcttgacagtcatttctttggttgcctcaagttagttacaagtactaatctcaaatatgtaattcatctaaacattacgttttattttcatgctatgaagtaatctaaaatttaagttcttataacttc

SEQ ID NO: 354 - DNA, 739 bp, Fragaria vesca
gcgaaaacgagtgagagcgagtcagtgagttgaagatggcgggtgcggcaccgactcgggtactgatgggagtgaacgagtcgacgatcaatggttacccgcacgcctccataagctcccgcaaagccttcgagtggactctcgacaagatcgtccgctccaacacctccggcttcaagcttttcttcctccatgtccaagttcctgacgaagacggttttgacgacatggatagcatctatgcatcaccggaggattttaaaagcttgaagcgtagagaccaggcaagaggggctcatctgctggagttctttgttgagagatgtcatgcaattggggttgcttgtgaagcatggatcaaaagaggtgatcccaaggaagtaatctgccatgaggtgaagcgcttgcagccagatcttctggttgttggctgccgtggtcttggtcctttccagagggttttcgtggggactgtgagtgaattttgcgtgaagcatgctgaatgccctgtcatcacaatcaagcgcagtgctgaagagacaccccaggatcctgttgatgactgaagccagtctttgtacctaaaagtatgaaaccaactgaaaagaactacattgatttcattgtaggaatttgaattctttgtattgttgaggtattgtgctatgtaaggatgagcttggatgttccctggtgtgttgaatgtgttttgaactagttgatgagttttctttgtcgt

SEQ ID NO: 355 - DNA, 708 bp, Helianthus annuus
cttggcgggggtccgttagaaccgaacgtaacaatggcgacaacgactgttgactcggacgtgactcggataatgctgggagtgaacgagtcaagcatcaaaggatatccacacgcttcaatcagtagcaaatcggccttcgaatggactctcaacaagatcattcgcaacaataccgctggattcaagctcctttttctccatgttcaagttcctgatgaagacggatttgatgaagttgatagtatatacgcctcgcctgaagattttaaagacgccaatcgtagggacaagattagaggatctcatctgctggaattctttgtgaagagatgtcatgaaataggggttgcatgtgaagcatggattaagaagggggatgccaaagaagtaatctgccatgaggttaaaagagtccagccagatctccttgttgtcggaaacaggggtcttggtcctttccagagggtatttgtaggaactgtgagcgagttttgtgtgaagcattgtgaatgcccggtcgtaacaatcaaacgcagcgtggacgagactccccaggaccctgtagacgactgatgaatacactctcgctgaagactatattgctgtaaaattttagagtttgctttatgtttttacgtgcgactgtggtctttgtggaggataatgtgagtttgttttcaatgatgactcatctgttaaaaccaa

SEQ ID NO: 356 - DNA, 847 bp, Thellungiella halophila
ccgccttcttcctttcgaaaacaacagagtcgacgattgcaggaaatcagtgaagaaaatggatagcgagccaactcgagtgatggtggccgtgaacgagtcgacgatcaaaggctatccacacgcatcgataagcagcaaaaaggcattcgagtggacattgaagaagatcgttcggtccaatacatctggcttcaagattctcttgcttcacgcacaagtgggggacgaagacggttttgatgacatggacagcatatatgcttcccctgatgatttccgacaattgagggagcgtaacaaggcaaaaggacttcacctacttgagtttttcgttaacaaatgtcatgagattggggttgggtgcgaggcttggatcaggaaaggcgatcctacagaagtgatatgccatgaagtgaggcgggtcaggccagattttctggttgtgggaagtcgtggtctcggtccattccaaaaggtgtttgttggaactgtgagtgaattttgtgtgaagcatgcagaatgcccagtcatcacaatcaaacgcagtgctgaagaaagtccacaagatccagctgatgactaaactccaaaagcagtcacacagaccatgtgtgtgatttgcagtacagaaaaagaaataaacaaaactctttcgattggtctagtaagtgcgtctgtagttgtggtagatactcagatgattcacacatcatatttataattgtgtgcgcaatgccttagtcttcattccccaaaacatcaaaacaaaagttccattattcgttgtgtaatccatcaactcttctagacctttcatatatccaatgtgttctatattattatc

SEQ ID NO: 357 - DNA, 970 bp, Nicotiana tabacum
ggccattacggccgggggtaacgaaatagatacagaacacgataaaataggtggagcagcgaaagaaaacactcctaaatcaatcaatcggcaaagaaaaacccctaaaatcgatttctcgagaaatggaaggcgaggcaatcacccggataatggtaggagtgaacgagtcaacgatcaaaggttatccacatgcttccattagyagtaaaggcgcattcgagtggactcttaagaagatcgttcgtaacaacactyctggcttcaaactcctcttyctccatgttcaagttcccgatgaagacggttttgaagacatggatagcatatttgcatcacccgaggatttcaaggtcctgaaacacagggacaagattagagggctccatctgctggagtactttgttaaccgatgtcatgaaattggggttccttgtgaagcatggataaagcaaggtgacccaaaggaagtcgtctgccatgaagtcaaacgtgtacaaccagatcttcttgtggttggctgccgtggtcttggtccctttcagagggttttcgtgggaactgtgagtgagttctgtgttaagcatgccgaatgtcctgttgtcacaattaagcgcagtgcagctgagactcctcaggaccctatagatgactaattcatttggtgtatttgttagtgcttaatgttcattgatgcatattagatgtcgacttgtgttgtagatagattttgcagattttcattctggttatatagctgtatctgctgtgttgtgggtttcgtgtttgcacatgattgttgtttgcatgtgtagtaacaatgtcccgtgcacatgtctgagctttgagtacttctgggcatgcgtgtgctctttagtaatatgttggttttgtagaagattttcgcttggcgtcagtcttttttgtacatacatcttatgatgaatgtgtgttgcctagcgccgcatga

SEQ ID NO: 358 - DNA, 1274 bp, Solanum tuberosum
gtagtagtcttctcttctctcccgcttttgctttactttctggttaccctttttttactcactctctctgtttacttcaactctcagaaacagatacaattttgtgatgacccttttaaggaattgactaaaacaagaggaaattatggagtgggaaaaacagcagcagcagcagcagccggtgtcggcgccgcagcagacggtggaggaattgaacggagcagttagtggtgggatgtttgtgaaagtgatgacggatgagcaaatggaagttttaaggaagcaaatcgctgtttatgctactatttgtgaacaacttgttgatttgcataaatccatggcttcacaacacgatcttgctggagccaggctgggaaatttgtactgcgatccactagtgacatccgctggccataaaatcactggtagacaacgctggactccaacgcctatgcaacttcagattcttgagcgcatatttgaacaaggcaatggaactccaaccaaacagaagatcaaagatataacttctgaattatctcaacatggacaaatttctgaaacaaatgtgtataattggtttcaaaataggcgtgctcgatcaaaaaggaagcaacaggttgcagcaacaaacaccactgaatcagaggtggagacagaggttgagtcgcccaatgaaaagaaaacaaagccagaggatctgcagtcttctcacatgcctacttcaatggctgaagatcttggctatgagaaccctgacgtgagctctggcatgcattcactagatccacgaaccagtaaacccgagcctatgtttccatcagacggtagttcaaaacctgctgcaagttatggccaaatgtccttctatggaatgtctaatccaagaatggaccagctaatgggaaagatggaagtgccagggagctatcatccatatctacatgcagatgactacaacatgaccggctaactaccaatttggaaactaagtttcatgcgcatttcaacaatttagaatgagactagaagccccaaaactctagccagagtttttgatcctactgtgcgttagccactgattgatgattatattacagaatgattctgagtatgaaaaaaatgtacttatggaccacgcttataggaactatatagtaaatagtattttcgttttgatttctccatttgctttgtaatttttacttttggagtgaagattttgttaaagcataatgcagggtcgtattttgaagtttcaaagaaatgttttt

SEQ ID NO: 359 - DNA, 1237 bp, Solanum tuberosum
actcactctctctgtttacttcaactctcagaaacagatacaatattgtgatgacccttttaaggaattgactaaaacaagaggaaattatggattgggaaaaacagcagcagcagcagcagccaccggtgtcggcgccgcagcagacggcggaggaattgaacggagcagttagtagtgggatgtttgtgaaagtgatgacggatgagcaaatggaagttttaaggaagcaaatcgctgtttatgctactatttgtgaacaacttgttgatttgcataaatccatggcttcacaacacgatcttgctggagccaggctgggaaatttgtactgcgatccactggtgacatccgctggccataaaatcactggtagacaacgctggactccaacgcctatgcagcttcagattcttgagcgcatatttgaacaaggcaatggaactccaaccaaacagaagatcaaagatataacttctgaattatctcaacatggccaaatttctgaaacaaatgtgtataattggtttcaaaataggcgtgctagatcaaaaagaaagcaacaggttgcagcaacaaacaccgctgaatcagaggtggagacagaggttgagtcgcccaatgaaaagaaaacaaagccagaggatctgcagtcttctcacatgcctacttcaatggctgaagatcttggctatgagaaccctgacgtgagctctggcatgcattcactagatccacgaaccagtaaacccgagcctatgtttccatcagacggtagttcaaaacctgctgcaagttatggccaaatgtccttctatggaatgcctaatccaagaatggaccagctaatgggaaagatggaagtgccagggagctatcatccatatctacatgcagacgactacaacatgaccggctaactaccaatttggaaactaagtttcatgcgcatttcaacaatttagaatgagactagaagccccaaaactctagccagagtttttgatcctactgtgcgttagccactgattgatgattatattacagaatgattctatgtatgaaaaaatgtacttatggaccacgattataggaactatatagtaaatagtattttcgttttgatttctccatttgctttgtaatttttacttttggagtgaagattttgttaaagcataatgcagggtcgtgttctaaatttcaaagaaatgtttttaagtggttctcactgtgc

SEQ ID NO: 360 - DNA, 1190 bp, Solanum tuberosum
gttgagtagtaagtagtagtcttttcttctctcccgcttttgctttactttctggttaccctttttttactcactctctctgtttacttcaactctcagaaacagatacaatattgtgatgacccttttaaggaattgactaaaacaagaggaaattatggattgggaaaaacagcagcagcagcagccaccggtgtcggcgccgcagcagacggcggaggaattgaacggagcagttagtagtgggatgtttgtgaaagtgatgacggatgagcaaatggaagttttaaggaagcaaatcgctgtttatgctactatttgtgaacaacttgttgatttgcataaatccatggcttcacaacacgatcttgctggagccaggctgggaaatttgtactgcgatccactggtgacatccgctggccataaaatcactggtagacaacgctggactccaacgcctatgcaacttcagattcttgagcgcatatttgaacaaggcaatggaactccaaccaaacagaagatcaaagatataacttctgaattatctcaacatggccaaatttctgaaacaaatgtgtataattggtttcaaaataggcgtgctcgatcaaaaaggaagcaacaggttgcagcaacaaacaccactgaatcagaggtggagacagaggttgagtcgcccaatgaaaagaaaacaaagccagaggatctgcaatcttctcacatgcctacttcaattgttgaagatcttggctatgagaaccctgacatgagctctggcatgcattcactagatccacgaaccagtaaacccgagcctatgtttccatcagacgatagttcaaaacctgctgcaagttatggccaaatgtccttctatggaatgcctaatccaagaatggaccagctaatgggaaagatggaagtgccagggagctatcatccatatttacatgcagacgactacaacatgaccggctaactaccaatttggaaactaagtttcatgcgcatttcaacaatttagaatgagactagaagccccaaaactctagccagagtttttgatcctactgtgcgttagccactgattgatgattatattacagaatgattctgtgtatgaaaaaattgtacttatggaccacgcttataagaactatatagtaaatagtattttcgttttg

SEQ ID NO: 361 - DNA, 1381 bp, Brachypodium distachyon
gtcactgtacgctccgattgctcaatcaatctcgagcagcaagagatcccacaagctaattcggttccgccgccggcgttcgattcgtataccatggggctcgacaaggaggcgagctcctcgtcctcccggctcgacgcgggggcgccgctgctgctgccgcagcacggcgggagcggcggcggcggcgcgcacctatcgtcgcagcccaagacctttcgccaacgtcttcatcgcggtggtcggctccggcgtgctggggctcccctacaccttctcccgcacggggtgggcggcggggtcgatcctcctcttcgcggtcgccgcgctcaccttccactgcatgatgctgctcgtggcctgccgccgccgcctggccgacgagcaccccaagatcgcctccttcggggacctgggcgccgccgtctacggcgccgcgggccgccacgtcgtcgacgccatgctcgtgctcagccaggccagcttctgcgtcggctacctcatcttcatcgccaacaccctcgcgcacctctaccccatcgccgtcggggattcctcgtcctcttcctccccgctcctcacggccaaggcgctcttcatctgggccatgctgccgttccagctcgggctcaactccatcaagacgctcacgctcctcgcgccgctcagcatcttcgcggacgtcgtggatctgggcgccatgggcgtcgtcctcggccaggacgcgtccacgtggctcgccgagaggccccccgtgttcgccttcggcggcctggccgagatcctatacggcctgggggtcgccgtgtacgccttcgagggcatcggcatggtcctgccgctggaggcggaggccgcggacaagcgcaagttcggcggcacgctcgccatgtccatggcgttcatcgccgtcatgtacgggctgttcggcgccatgggctacctcgcgttcggcgcgtccacgcgggacatcatcaccaccaacctcggcgccggctggctgtcggtggccgtgcagctgggcctctgcatcaacctcttcttcaccatgccggtcatgatgaaccccgtctacgaggtcgccgagcgcctgctctacgggaagcggtacgcctggtggctccgctggctactcgtcgtcttcgtcgggctcatggcgatgctcgtgccaaacttcgccgacttcctttcgctcgtcgggagcagcgtctgcgtcctgctcgggttcgtgctgccggccgcgttccacctcaaggtgctaggcgccgagatcgggtggcctgcgcttatcggcgacgcggctgtcatcgtcgtcggcgtcgcgctttccttgtccgggacatggacatcgctggcgcaaatgtttggttcttccgacgca

SEQ ID NO: 362 - DNA, 1959 bp, Zea mays
aaaacgcacggcacgaggctccccaaattccccatttttacggacaccagcaagccacgccacactcccaatcgccgcagcagctggtcccctgctcggctcgtctgatccagcggctgaatccgcaggccatggggttcgacaaggaggcgagctcctcctcctcgcggctcgacgcggcgccgctgctcccgcagcacggcggcggcggcgcgggcgggcacctgtcctcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgccggatcgcggacgcgcaccccaagatcgcctccttcggggacctgggccacgccatctacggcgcgcccgggcgccacgcggtcgacgccatgctcgtgctcagccaggccagcttctgcgtcggctacctgatcttcatctccaacaccatggcgcacctctaccccatcgccatcggggcccagtccccggcgtcgccgctcctaacggccaaggcgctcttcatctgggccatgctgccgttccagctcggcctcaactccatcaggacgctcacgctcctcgcgccgctcagcatcttcgccgacgtcgttgacctcggcgccatgggcgtcgtcctgggccaggacgcctccgtctggctcgccgacaggccccccgtgttcgccttcgctggccccgcccagctcctctacggcctcggcgtcgccgtctacgccttcgagggcatcggcatggtcctgccgctggaggcggaggccgccgacaagcgcaggttcggcgccacgctcgcgctgtccatggcgttcatcgccgtcatgtacgggctgttcggcgccatgggctacctcgccttcggcgccgccacgcgggacatcatcaccaccaacctcggcaccggctggctctcggtcctcgtgcagctcggcctctgcatcaacctcttcttcaccatgccggtgatgatgaacccggtctacgaggtcgcggagcgcctgctctgcggcaagcgctacgcctggtggctgcgctggatcctggtcgtgctcgtcgggctcctggcgatgctcgtgccaaacttcgccgacttcctctcgctcgtcggcagcagcgtctgcgtcgtgctcggcttcgtgctgcccgccgtgttccacctcaaggtcttcggcaccgagatcgggtgggccggcctcgtcgccgacgtggccatcatcgtcaccgggattgcgctcgcggtgtccgggacatggacgtcactcgtacagatcttcagttcttccgacctgtaagcatcgacagtctgatatgtgcaatgggagggctcaaattggttccaatagattgagacacaattcagcgaccgggataacactgcatgcatttgtggacgtccgatcccgcaggcgatggttcagatccgatggttgaacagcaatttcttaaacactagccgcagtaccgactgcattttatccagctgccatgtcgattgagcattttatccgatggtaaagtatgggaacaaactattgttgggagctctctgaaatctacattggtttggttcagatagagccatatagattccagctgtaccaggcagcagatccatgtgtaaagcctatatgatgttgtattgaattgaatcgatgactgctttatgcaagattcttttgtccaagagtgactgctttatgcaagattcttttgtccaaggggtttgtagttctctattgttagtatcaccttataagatgttttagtttttctaaatatttttttactacacatctaaacataatgtacaagttacacaatacaagagtgactgctttatgc

SEQ ID NO: 363 - DNA, 2157 bp, Oryza sativa
agcaactgcagcaataatcagatcctccatcccgcggcggccgtgagcaccaacactcacgcattccttcctactccgcgagatctccggattcgtttcggtgttttgcgagtcgcgcccggagaagaggagaggaaatccggtcaatcgcggcgtcggcgtgccgtcgcttggggtggtgttggtggttctgaattttgattgcttcgtgcttttcgtttgggggagggcagtggtcgccatgggattggggaacgaggcgagctcgtcgtcgtcgcggctgctggatccggcgcctctgctgccgcaccacggtggagatggcgccgggaagctgtcgtcgcagcccaagaccttcgcgaacgtcttcatcgcggtggtcggcgccggcgtgctggggctgccgtacacgttctcgcggaccgggtgggcggcggggtccatcctcctgctctccgtcgcggcgctcaccttctactgcatgatgctgctcgtcgcctgccgccgccgcctcgccgacgagcacccgaagatcgcctcctttggggacttgggggacgccgtgttccgcggtccggggcgcctcgccgtggacaccatgctggtgctcagccaggccagcttctgcgtcgggtacctcatcttcatctcgaacaccatggcgcacctttaccccgtcttcgcgccctcctccaacgcgctcctctccccaaaggcgctcttcatctgggccatgctgccgttccagctcgggctcaactccatcaagacgctgacgctcctcgcgccgctcagcatcttcgccgatgtggttgacctcggcgccatgggcgtcgttctcggggaggacgtgtccgtctggctcgccaaaccaccacccgtcttcgccttcggcggcctgagcgcgatcctgtacggcatcggcgtgtccgtgtacgccttcgagggaatcggcatggtccttccgcttgaggcggaggccgccaacaagaagaagttcgggaccacgctcgggctatccatggggttcatcgccgtcatgtacggcctgttcggcgccatggggtacatcgctttcggcgacgccacgcgcgacatcatcaccaccaacctcgggaccgggtggctctcggccgccgtgcagctcgggctgtgcatcaacctcttcttcaccatgccggtgatgatgcaccccgtgtacgaggtcgccgagcggctgctccacggcaaacgctactgctggtggctgcggtggctgctcgtcctggccgtcggcctctcggccatgtacgtgcccaacttcaccgacttcctggcgctcgtcgggagcagcgtctgcgtcctgctcggcttcgtgctgccggcctcgttccacctcaaggtgttcggcgccgagatgtcctggtccggggtgctcagcgacgtcctgctcgtcctgctcggcctctcgctcgccgtcttcggcacctacacgtccctgctgcagatcttccattcctccagcgcttaatctctggagaatctttacggatagctgcgccgatgattgatttgctcatttgcttcgcgcgcgggtgtcagcctgtcaggtacgctggttgcattcttcgtgtacagagaaggtgatcggtcgatcagaggggcaatgcccaattcagcttgctgttgatttgggcatggacagcgtgcatcggccgcattctttcgattacaagtcagatggtttgtacaagttagcgtggatggcatggagaaatctgtatggttttgcaacgacagattcccatagctactcgtgtcagttaatatttatgtgtatgtcttggatgtttcagctgctgcattgcacggtggaatcgatgaaaggacatagtaagtttcagtctaagtttaagcctatttagttgataaataaagtgtctagttgaggttgcagcttgtgtgcggtactgcgggttgtgtcaattaggaaggcaagcaatcgggacgacttggcaaagtatacattctattctgttcattctgttttgtcccaagcaagtaaacttgtaatgccccaactaccaatcgaaatatcgaatcttctttcagcttgcctgttattaccaatgttgcacatataattctatcacgaaagaactcaaattagattcaaca

SEQ ID NO: 364 - DNA, 2340 bp, Sorghum bicolor
ccgcggcctcgccgccggccggagtgccggcgagcaagctcatcgccgccactacagattacagaatacagagtagatgagtagtccacagcacagtgggggcatgcccgtgcgccgacagtccaacaccctcgcctcccgtgcaccacacacgcggcgtgtactactgattgattgctaactgtgcggccgtgaaccatgtccacgacgctgctcaaagaaaggtccacggcgctgcctcctcctccgactgcatctgcctctacaaaacgagaaagcgcacggcacgagattcccaaaatcccccatttttgcggacaccagctagccacgccacactcccaatccccgccgcagctggttccctgctccgttcgtctgatccagcggctgaatccgcagaccaccatgggattcgacaaggaggcgagctcctcgtcctcgcggctcgacgcggcgccgctgctcccgcagcacgggctgcacggcggcggcggcggcggcgggcacctgtcgtcgcagcccaagacgttcgccaacgtcttcatcgccgtcgtcggctcgggcgtgctgggcctcccctacaccttctcccgcacgggctgggcggcggggacgctgctcctcctcgccgtcgccgcgctcaccttccactgcatgatgctcctcgtcgccacacgccgccggatcgccgacgagcaccccaagatcgcctccttcggggacctgggccacgccgtctacggcgcgcccgggcgccacgcggtggacgccatgctcgtgctcagccaggccagcttctgcgtcggctacctgatcttcatctccaacaccatggcgcacctttaccccatcggggccgagtccccggcgtccccgctcctcacggccaaggcgctcttcatctgggccatgctgccgttccagctgggactcaactccatcaagacgctcacgctcctcgcgccgctcagcatctttgccgacgtcgttgacctcggagccatgggcgtcgtccttggccaggacgcctcaatctggctcgccaacaagccccccgtgttcgccttcgctggccccgccgagctcctctacggcctcggcgtcgccgtctacgccttcgaggggatcggcatggtgctgccgctggaggcggaggccgcggacaagcgaaggttcggcgccacgctcgcgctgtccatggcgttcatcgccgtcatgtacgggctgttcggcgccatgggctacctcgcctttggcgccgccacgcgggacatcatcaccaccaacctcggcaccggctggctctcggtccttgtacagctcggcctctgcatcaacctcttcttcaccatgccggtgatgatgaacccggtgtacgaggtcgccgagcgcctgctctgtggcaagcgctacgcctggtggctgcgctggatacttgtcgtggtcgtcgggctcctggcgatgctcgtgcccaacttcgccgacttcctctcgctcgttggcagcagcgtctgcgtcgtgctcggattcgtgctgcccgctacgttccacctcaaggttttcggcgcagagatcgggtggactgggctcgtcgccgacgtggccgttatcgtaatcgggactgtgctcgcggtgtccgggacatggacgtcacttgtacaaatcttcagttcttccaacctgtaagagtcgacagtttgattagcaccatgtcttgctaatgcattggtaagcatcgacattctgatatggatcatgccttgctgatgcaatgggagcgctcaaatggttgcacattggttcttgtggattgagagcttgagacccaattcagctgccgtgttgatttgggcatgctttgcatctcttaaaagtatgggataacatacacaaattgttgggagctttctgaaatcttacatggttttggtcagatagagccatgtaggttccagctgtaccaggcagcagatccatgtgtaaagcccagaacgaggaattgaatccatgcgaatatgtacaatataagagtacctactttatgtaagattcttttgttcgaggagtttgtagcatgtttctgggtctatattgtctcatgtcctcgccataggtgtctttattgatctaaagtatgtgcacggtttaggtttgttggtcatactagttttgaatgattcgcataggttggcaaatggcaagtggcttaaccttcatggaaatgttgccgtgcacttcatagaggtggaaaatctctacttcattgacgaaggaaaaccaaatgctccattatttcctttgttccatcagctgtcaaactaaaaaaatggttcgttt

SEQ ID NO: 365 - DNA, 4744 bp, Oryza sativa
tccgtttcggtatagagacgatcgatcactggatgttcttacacgtctttgattaaaattcttgaatccccctgaaccgaattgaagaacgcaccatgcgtaagatcacaagcagaaacatcatcaacaataatattcacaagagaaggaaaagccacaccaccgtgaagcccgaacgactagtagcgtttttttcggtgaccgactgattttttttttatacgcgtcgacggctaacgacaatggagacggtagcgacggagcccgggacatgtctccgtcgcttgccggatgacctcgtcgccgacgagatcctcacccggctgccggcgaggtccctcgcgcggttcgcctccgtctgcggcgcgtggcgcgccgccatctccggcgacccctcctccttcctccgccgccgccgcaagaaggagcactcctcctccttcctcctcctcctgtacgcgttggtggaggacgccgagaggcggctcgccttctccaaccacgtccccttctatcgcctccggtggccggacgacggcggcgacggcgccccgcagctcgtgcacgtgtcggtgttcggcgacggcggcgaggagcccaccctgtcgctgccccgcacctgcgacggcctcgtgctgctccccaacggcgacgacgtccacgtcatcaacccggccaccggcgacgtcctcacgctgcctcaaagcagccgtgtcgccgccgccgccgaccactcgaccgggctgggccttgacactcgcacaaacacctacaaggtcgctcgctacatccacctctccaccgccgccgccgccgccgccgccgaagacgacggcgccgctgtcatggaggtgttcacgatcggccacggcgacgccgccgcctggagggagacgacgacgccgccgccgccgtcgtacccggtctgccacgtgcgaaccgccatccactcccgcggaaacctcttctggaaactccaactccgacgatcgccggcggcggcggcggcgggcagcttcctcctcctccgcttcaatctagctcacgaaacgttcaccgtcgtccaccatccacggccaccatctcatctaccatcggccgatcagaacggagagccgccaccaccaccaccgccattgctgtccgagctcgacggcgagctgtgcctcgggctgctcgtgtcaggtcggcaagagctctggctgtacagcaacaatggcggcggcggcggcggcgatgatcggtggcaatgggagcagcggttcagcatcgccgtgtcggggccggacgccatgtacctgccattgggggtgcttcgccgccatgatcgactgcttcttcagaagggtgtacacctgtaccaccatgactcgggtggtggcgaggagagtgtcagagaagtggcgcgaatggatgagttcgaatttgaatggagtttcccgggagagccctacgcgttcatggtgatcccctacacggagagccttgtccgggttactgccgcgaggcccattaacaagacagcggcggcgacggcgatggcgggggagacggcggcgacgatgatggcgacaccggaaaggcccaagcgtgcgcgtcgagccaacagccgttacattggcgacatgtgggatgtgtagaccaatgatatttccgtgcacaccaattatcaaatatcacatcaaattctaggaaaaaattagacacatacttccaatgagtattacacatacttgtgaatcttatcttaaatttattatattttagccgtaacaaagaaaagataaacttctgacaaatttttgctgctaaaactgtcagatttttcacttttttttgttacagctaaaatataataaatttgaatattagactttacggatatgtataatactattatgagtaaatgtctaaattttttataaaattttacgtaacatttcctagttggtgcgcatggagtgtgtatgtaaagcttgtatgcataggatatgttccctatataaacattacacatagagaataagtgggatgcaagtgggatgggcaagcgtttttttttcactccactgtttccgtctcttggagcatgtgttaggggacgcattcacggggtgtgagtgtggtgttgcgtgtgtagttatgtgtgtgcgtgttcgtctgccatgcaatctaaaaatataaaaaaacaattttgttattgttttcttctaaatttatgctaacaagtgcaaaatatactatgtaacgagtttttatgtgggtagcaggattcttacttagcttacaatatcgatgttagaattatatgaagctattcccccactttaatacaagttttgtctccttcaccctcacactcttctctcctttccataactcaaatttctctcttgactctttggctttctagagagccttgtccgagttaccaagctatgatttgtaaggttgtttaatactctctctgtttcacaatgtaagtcattctagcatttctcaaatttatattggtgctaatgaatctagacatatatatctatctagattcattagcaccaatatgaatgtgggaaatgctaaaatgacttacattgtgaaacggaggaagtatgttttgaagccctccctagaagctacggctgttattccatgtaaaacacgttgtaaagtgggtgaaattcacccaaaaggactcacatgtgtacgtaggaggtgataaaatgcaaccatgtaatagccctatataattttgtttgaggtatatgaaatcctcttcttttttttttataagtttcatatctcacgaacaaaattgactgtttacttttcaaattttacatcatctcttgtatagcaagttacttttaatttaaggctttaatggtgtgcttacgtgaatttacacctgcaccaaaaactattttaacatatatatgctccatgtgtagatgagcaggtttgatctgggcattgaactatcaaactcaaaatcctgcccagttcgtgataggaatttaaattgaattcgtgcagcaagttgttcaaatttaatgtgtacaacatttttttacgtagtggctggctgggcgacgtgggtttaaaggaagagtgacctgctcaagtgctcagtagattaattaagggatttgaattctggtcgtacgataaattaacttgagttcaaaaatacaagaaacatcagtttatatttcatttcgtgtaggacctctatcaatccaattcgtacaagaggaattgcatatttcaactcatagtcttaacaaaccattcaaattgatatttgcacgatgatgattgtctggtatagatttgactttttgggaactgaatcaaatccagcatgattcatgcaagaaacttgaattcaactcatacaagaaacatattcaatttcaagctgtgcaataatgcacgtatcttaagcaaagagtagtacgtctgcatcatatagtactcatgcaagattgaaacagctaagaacttgatcaaattcaaagtttttttgtgatcgaagtttaaatccagttcatacaagaaacgcattaaaaataatcgatttaaatatgagcaataatgcatctactttaagcatagggtttgacatcacggtatggaagcaaatttgaattagacgcaaacttggatctcatttttccagaaactttgttcgattggtaattagaacagtgcaacctttgcacgcaaccaactatataaaaatcactggttgctaggactgttgtaatcctgacaattttcctctaatcttaatacacttgggtcggctttctttgccaacccggcgaaaaaaaactatataaaaatcgtaattattactaccttcatttcagattataagactttctagcattatccatatttatatatatgttaatgaatctagacatatatgtgtgcttggattaattaacatctatatggatgtggacaatgctagaaagttttataacctgaaacggagaaagtatatttttttgggtacttatgtcatattgtcatgtcatcaatgtgtatagtactaaggttcaatgagaaatgatacaattgcaagccaaacaaattgccgttacagaaatctgacgtcaacgacattctggcaagataatgcttgatataatttgtgtagctatgctactataaatagggggggttatatctgcactgagttcatatcaagctttcaatctctcattgcatacaagttcctgaagagtttacaagagacccagaagatcaagatgtcgtgcggtggaagttgcaactgcggttcttgcggctgcggcggtggctgtggaaagatgtaccctgacctggctgagaagatcaacaccaccatcactactgcaaccactgtcctcggtgttgcacctgagaaggggcattttgaggtgatggttggcaaggcaggtgagtctggtgaggctgcccatggctgcagctgtggctccagctgcaagtgcaacccctgcaactgctaaggccaagatgatctatgactgaattgccaatgcaccagcctgtctacatgatgaataaataaagagtccatccagtgtgatggctcatgcctgtgtgtgtgtgttttgtctcaaccatgtgtgaatcaggtgtcaaaagtccgtggctggaaatccatgtggtttctggctttatgtaaatgttgtttgtgaaatataaatattggtttgtctatgaattt

SEQ ID NO: 366 - DNA, 689 bp, Oryza sativa
ttttgccctaccttatcacttgagcccctataaatagaggcattatattgaacaaatgcattgcactcatctcaagcttttctctctctctctctctttgcactacattcttgaattcacaacctacaaacaatccaagaagatgtcttgctgcggaggaagctgcaactgtggctctagctgcaagtgcggcagcggctgcggaaacatgtaccctgacctggcagagaagaccacaaacacttcagcaactatggtcctcggggtcgcacctgcgaaggagcaatttgagggggttggcaaggcagcagagtctggtgaggctgcccatggctgcagctgtggctccagctgcaaatgcaatccctgcaactgctaaaggagatggtgatctgcatcagcatgctgatgatatgtacaagtaaataaagaagccatttgatgcaatggctcctgtgtgtgtgtgtgtgcgacagtgtgagtcagcttgtgttcttcatcctgatgtactaatgtggcctgtgaatattgtgaggtgtctcctgctttactctcttgtcagaatgtaattagaggctatatatcatggccttgtgattggagcacctgaagtttttacagacaacattatgtttgtgtaatataatatggtttacttgtgcatgtatatggcatgttctttcagttcc

SEQ ID NO: 367 - DNA, 1204 bp, Oryza sativa
aagcaccaaccaaaaccaaagcagagaagaggcaagaacaactagctgcatggcaatggcgggagagagtaggaggaggaggagggcggcggcggaggcggtggcgtggtgcttggcgctgggcgtggtggcgctgctgctggtggggtcggtggagaaggaggaggaggtggtggtggtgcgcggggcgcggctggcggcggcgcggccgtgcgaggagatatacgtggtggaggaaggggagacgctgcacagcatcagcgacaggtgcggcgacccgtacatcctggagcagaacccgcacgtccacgaccccgacgacgtcttccccggcctcgtcatcaagatcacgccgcgccccggccgccgcaactgaactgaacttgctgatcgatcaacgcgttgatctatctctgatcgatcgagagatcgatcaacctgtacagtggacaccgatcgacgcgaatgtatggcggaatgcagagatggttcttgtttgtttgtgttttttcttgctttgaagtttgaaagattctgaccaaagaagggcgccgtatccgggagtttgtttcgtcgtcgtttgcttcgtttgacgatgatgaaccagaaccacacgtactggaacagaggacgctgcgagtggctactggctagtaagtggctagtagtgtagtggtagtagttaggcaggcaaccttgcctggtgtgtgtgtgctttgttcattccgttatactagaggctagttgtcagttggttacctgaagtgaactgatgcagtggttggtaaaagaaaaaactgagactgatgtttgttagatgcgtaagcaagcttgccgtaattgtggcgtgttgataaaagtgcggctaagaaatagttaagtgtaatatagttaagctttcaattgaagaatttaccatttgtcactctaccaaaatactagtgctcaaatgccactctcccaaatattcattcctaaatgtcacccggacctcaccacttatgtttgaatgaaaagtgaggctgacatgtgcgttcggatggcatttgggaatgaaaatttaggagagtggtatttgagtgctatcattttggtagttgcaaatagtaaattctccccctattttctatgacactaaactcagcccaatactataaattggactaaaatatattttgaaacggaggtagtagtataacatata

SEQ ID NO: 368 - DNA, 2294 bp, Zea mays
cggcaacggcatcctcccttcgcaaattgcaagcaagccggcaagggacggcaccaacaagagcgcgatcgacctaccaagctagctagcgaattaaccttctcctcccatggctccgacgacggccacggcggcggcggtggggacgaaggcgacggcgctgggggtggcggcgtgcgagcgcgacgtggagaagctggagttcatcgaggacaagaccaggaacttcgacgcggagcaggtgcgcgtgctcgcggagatcctggcccgcaacaacggcgccgagtacctgcggcggcacggcatggaggggcgcacggaccgcctggcgttcaaggcgtgcgtgcccgtggtcacgtacgaggacctccgcccggagatcgagcgcatcgccaacggcgaccgctccaacatcatctcctcccaccccatcaccgagttcctcactagctcggggacgtcggcgggggagaggaagctaatgccgacgatcgaggacgagctcaacaggcgccagatgctctacagccttctcatgcccgtcatgaacctgtacgtgcctgggctggacaagggcaagggcctctacttcctgttcatcaagtcggagacgaagacgcccggggggctcccggcgcgccccgtgctgaccagctactacaagagcgaccacttcaagcaccgcccctacgacccctacaacgtgtacaccagccccaccgccgccatcctctgcaccgactccttccagtccatgtactcgcagatgctgtgcggcctggtggcccgcgccgaggtgctccgcgtcggcgccgtcttcgcgtcgggcctgctccgcgccatccgcttcctgcagctccactggcaggagctcgcgcacgacctccggacgggcaccctgagcgccaaggtcacggagccgtccatccgggaggccgtggccgaggtgctgaggcccgacgccggcctcgcggacttggtggaggccgagtgcggcaaggagagctgggagggcatcatcacccgggtgtggcccaacaccaagtacctggacgtgatcgtgacgggcgccatggcgcagtacatcccgacgctcaagtactacagcggcgggctgcccatggcgtgcaccatgtacgcgtcctccgagtgctacttcggcctcaacctccgccccatgtgcgacccgtcggaggtgtcctacaccatcatgcccaacatgggctacttcgagctgctgccgcacgacccggacgctgtgccgccgtccagggacgacccgccgccgcggctgctggacctggcggacgccgaggtgggcagggactacgagctggtgatcaccacctacgcggggctctgccgctaccgcgtcggcgacatcctgcacgtcaccggcttccacaacgcggcgccgcagttccgcttcgtgcgccgcaagaacgtgctcctcagcgtcgattccgacaagacggacgaggcggagctgcaggccgccgtggagcgcgcggcgcgcctgctggcgccctacgacgcggccatcgccgagtacacgagccaggcggacgccaccaccatcccgggccactacgtcgtgtactgggagctcatggtgcgggagggcggggcgtcgcccgacgcagccgtcttcgagcgctgctgcctggagatggaggaggccctgaacgcggtgtacaggcagggccgcaacggggacgccatcgggccgctggagatccgggtggtgcgcggcggcacgttcgaggaggtgatggactacgccatctcgcgcggcgcctctatcaaccagtacaaggcgccgaggtgcgtgtcgttcggacccatcatcgagctgctcaactccagggtggtgtccagccacttcagcccggcgtgccccacgtacagcccgcacaagaagtgatgacctaatagcattggccgtcggaggcccagactgagctactacacttctgctagtactattactacttgttgctctctacagtgcgtgtctttcggttccttctcgtgtacgtacaaggcagaggagtgaattagtcacgctcctgcttggttctgtggtaactcttactccactgctagttgttacatatacttgtgcgtgtcatgtcatttctcgaggagaaatgactagtgtttgtacctgtaagacggtatcacggtaacgtcattcttggcctaatatcataactggccttctcgatacctgtttatggtcgcatgcctgaatgttttatgctttgaattcggggagcgaatgacactgctat

SEQ ID NO: 369 - DNA, 2327 bp, Sorghum bicolor
atcctctccttccctcacaagttctgcaagcgacgagacagagagaattgcaagcaagagcccccctagcgtaccgagctaggtagccagccaaagagacccggccggccggcctcgttcagtttgatcagtttctccgatcctcccgatccatggctccgatggccacggcggcggcggcggcggcggtggggagggtgacggcgctgggggtggcggcgtgcgagcgcgacgtggagaagctggagttcatcgaggacaagaccaagaacttcgacgccgagcaggtgcgcgtgctggcggagatcctggcacggaacaacggcgccgagtacctgcggcggcacggcatggaggggcgcacggaccgccaggctttcaaggcgcgcgtgcccgtggtgacgtacgaggacctccgcccggagatcgaccgcatcgccaacggcgaccgctccaacatcatctcctcccaccccatcaccgagttcctcactagctcggggacgtcggccggggagaggaagctaatgccgacgatcgaggacgagctcaacaggcggcagatgctctacagccttctcatgcccgtcatgaacctgtacgtgcctgggctggacaaggggaagggcctctacttcctgttcatcaagtcggagacgaagacgcccggcgggctcccggcgcgccccgtgctgaccagctactacaagagcgaccacttcaagcaccgcccctacgacccctacaacgtgtacaccagccccaccgccgccatcctctgcaccgactccttccagtccatgtactctcagatgctgtgcggcctggtggcgcgcaccgaggtgctccgcgtcggcgccgtcttcgcgtccggcctgctccgcgccatccgcttcctgcagctccactggaaggagctcgcgcacgacctccgcacgggcaccctgagcgccagggtcgtggagccctccatccgggacgccgtggccgaggtgctgacgaagccggacgccggcctggccgacctcgtggaggccgagtgcggcaaggacaactgggagggcatcatcacccgggtgtggcccaacaccaagtacctggacgtgatcgtgacgggcgccatggcgcagtacatcccgacgctcaagtactacagcggcggcctccccatggcgtgcaccatgtacgcgtcgtccgagtgctacttcggcctgaacctccgccccatgtgcgacccgtcggaggtgtcctacaccatcatgcccaacatgggctacttcgagctgcttccgcacgacccggaggacaagccggcggtgtcgtcgtcgtcggcggcgtcggccatggaccacgaccgcctgctggtggacctggcggacgccgaggtcgggaaggagtacgagctggtgatcaccacctacgcggggctctgccgctaccgcgtcggcgacatcctgcacgtgacggggttccacaacgcggcgccgcagttccggttcgtgcgccgcaagaacgtgctcctcagcatcgactccgacaagacggacgaggcggagctgcagtccgccgtggagcgcgcgtcgcggctgctggcgccctacgacgcgcgcatcgtggagtacacctcgcaggcggacgccaccaccatcccgggccactacgtggtgtactgggagctgatggtgcgggacggcggcgcgtcgcccgagccggacgtgttcgagcgctgctgcctggagatggaggaggcgctgaacgcggtgtacaggcagggccggaacggggacgccatcgggccactggagatccgggtggtgcgaggcggcacgttcgaggaggtgatggactacgccatctcgcggggggcgtccatcaaccagtacaaggcgcccaggtgcgtgtcgttcgggcccatcatcgagctgctcaactccagggtggtgtccaggcacttcagcccggcgtgccccacgtacagcccgcacaagaagtgatccacaggccggtcggattcggtgacggcccaggatgagctacagttctgctagtaggtagtactactagtgctttgcttgttgctcttacagtgcgtgtgtttcggttcctctcgtgtacgaggcagaggagtgaattagtcacggctcctagctgctttgcttgcttcctgccagctgctgcctggctctgtggtaactccaatgctagtatcgtaccgtagttatattacatacttgtgggtgatgtcgtcatttctggagtggagatgacgagtgttaatttgtacttgtataagacggtatcatggtaacgtcattcttggcccaata

SEQ ID NO: 370 - DNA, 2370 bp, Panicum virgatum
gcaagcgagacggagagagttgcaagccggcaaggctcagcaaccaccacgccatagcaaacaaagagccctcagctttgagctagtagcgagccgaagaaattaaaccccccgttccgttccgttccgttccgtttagcgttcttgcttccgggcatggctccgacggaggcggcggcggcgaacgggagggtgacggcgctgggggtggcggcgtgcgagcgcgacgcggagaagctggagttcatcgaggacaagaccaagaacttcgacgcggagcaggtgcgcgtgctcgcggagatcctggagcggaacggcggcgccgagtacctccgccggcacggcatggaggggcgcacggaccgcgccgcgttcaaggcgcacgtgcccgtggtcacgtacgaggacctccgcccggagatcgagcgcatcgccaacggcgaccgctccaacatcatctcctcccaccccatcaccgagttcctcaccagctcggggacgtcggcgggggagaggaagctaatgccgacgatcgaggacgagctcgacaggcgccagatgctctacagcctcctcatgcccgtcatgaacctgtacgtgcctgggcttgacaaggggaagggcctctacttcctgttcatcaagtcggagacgcagacgcccggcgggctgccggcgcggccggtgctgaccagctactacaagagcgaccacttcaggcaccgcccgtacgacccctacaacgtgtacacgagccccaccgcggccatcctctgcaccgactcgttccagtccatgtactcgcagatgctgtgcggcctgctggcccgcaccgaggtgctccgcgtcggcgccgtcttcgcctccggcctgctccgcgccatccgcttcctgcagctccactggaaggagctcgcgcacgacatccggacgggcaccctcagcgccagggtcaccgagccgtccatccaggcggccgtcgccgaggtgctcgcgccggacggcgacctcgccgacttcgtggaggccgagtgcgccaaggacagctgggagggcatcatcaccagggtgtggcccaacaccaagtacctggacgtgatcgtgacgggcgccatggcgcagtacatcccgacgctgaggtactacagcggcgggctgcccatggcgtgcaccatgtacgcctcctccgagtgctacttcgggctgaacctccggcccatgtgcgacccgtcggaggtgtcctacaccatcatgcccaacatgggctacttcgagctgctgccgcacgaccccgaggccggcgagccggcggccggcccgccgccgcggctggtggacctggcggacgccgaggtggggaaggagtacgagctggtgatcaccacctacgcggggctctgccgctaccgcgtcggcgacatcctgcaggtgaccgggttccacaacgcggcgccgcagttccggttcgtccgccgcaagaacgtgctcctcagcatcgactcggacaagacggacgaggcggagctgcaggcggccgtggagcgcgcggcggcgctgctggcgccctacggcgccggcatcgtggagtacacgagccaggcggacgccgccgccatcccgggccactacgtggtgtactgggagctgatggtgcgggagggcgcggggggcaggatgcccgaggcggccgtgttcgagcgctgctgcctggagatggaggaggcgctcaactccgtgtaccggcagctccggaacggcgacgcaatcgggccgctggagatccgggtggtgcgcggcggcaccttcgaggaggtgatggactacgccatctcgcgcggcgcgtccatcaaccagtacaaggcgccccggtgcgtgtccttcggccccatcatcgagctgctcaactccagggtgatgtccaagcacttcagcccggcgtgccccaagttcagcccgcacaggaactgagatcctctgattggatggattcgatggtcacggcccaagatcggggctggacgctatagcctgctagcactactactacttccttcttcccagtcgcgtttattatactgtgtgcgtcagtgtgtgtgttctccggttccttgctcgtgtgcaaggcagaggagctcctgcttgctactagctccagccagatggctgcttctttctttggtacgtattagatcaagctactccactgctggtagttacgtacttgtgcgtgatgtcattccttgagtggaaatgacgagtgtctgtaatcgtaagacagcagcgtcattcttggcccaatatatcataacaggccttctcgaagtacctgtttatgttgctcgaaaaaataaaaggaaaagtttggtttac

SEQ ID NO: 371 - DNA, 1203 bp, Sorghum bicolor
cggccgggcattctgctctccgtggcggccctcgccgttgcggcggtggcggcactggcgccggcgccggtggccgcgacaaagtacaacatcaccaagattctggcaccgtacaaggagtactccaagttcaacgagatgctgtccaagacgcggctggcgtacgacatcaaccggcggcagaccatcaccgtgctggccgtcgacaactctgccatgtcggcgctcgaccactactcgctgcagacgatccggcacatcctgtcgctgcacgtcctcgtcgactactacggggataagaagctcaagaagcttgcccacggcgccaccgcctcctcctccatgttccaggctaccgggtcggcgtccggcatgtcggggtacgtgaacatcacccgaaaagacggcaaggtgagtttcatgacggaggacgccgacgacacggcgaagccgtcccggtacgtcaagtccgtgaaggagtacccctacgacatcgcggtgctccaggtgagctccatcatctcgtcggcggaggcggaggcgcccgtcccggccccggcgcccgtggacctggtggagctcctctccaagcgctactgcaagtcgttcgcgtccctgctctccgccgacgccgaggcgttccgcgccgccaacgagagcaaggacaacggcctcacgctcttctgccccgtggactcggccgtcgcgtcgttcgcggccacctacaagaacctgacggccaaggccaagacggccatcctcctctaccacgccgtgccggactacttctcgctgcagctgctcaagtccaacaacggcatggtcaccacgctcgccaccgccagcgagaagaagatggactacagctacgacgtcaagaacaaggacgagacggtcacgctgcagaccagggtcgtcacgtccagcgtcaccgccaccgtcggcgacatggagccgctggcagtctacgccgtcgacaagttcctgcagcccaaggagctgttcaaggtcgtcgaggcgcccgcgccggcgccggagccgtcgtccaagaagaagaaggccggtcgcggcgggggtgacgacgacgacgattcctccgacgattccacggccgatgcggaaaagggcgacgccgcaccggctctgctcgcgcgatgggtagtcaccgcggccgccgcggcggtagctgcatatgcgttgatc

SEQ ID NO: 372 - DNA, 1251 bp, Saccharum officinarum
acgaacgagcgcggtctctctctctctctagcctccaacatctctcctacatccccctactgcctgtgtggtcgtcggcaacaatggcaagaagccggccgggcattctgctcgccctggccttcgccatggccgccgtggcggcactggcgccggcgccggtggccgcgaccaagtacaacatcaccaagattctggcaccgtacaaggagtactcmaagttcaacgagatgctgtccaagacgcggctggcgtacgacatcaaccggcggcagaccatcaccgtgctggccgtcgacaacgccgccatgtcggcgctcgaccactactcgctgcagacgatccggcacatcctgtcgctgcacgtyctcgtcgactactacggcgacaagaagctcaagaagctcgcccatggctccaccgcctcctcctccatgttccaggctaccgggtcggcgtccggcatgtcggggtacgtgaacatcacccgraaagacggcaaggtgagcttcatgacggaggacgccgacgacaccgcgaagccgtcccggtacgtcaagtccgtcaaggagtacccctacgacatcgcggtgctccaggtgagctccatcatctcgtccgcggaggccgaggcgcccgtccctcccccggcgcccgtggacctggtggagctcctctccaagaggtactgcaagtccttcgcgtcgctgctctccgccaacgccgaggcgttccgcgccgtgaacgagaccaaggacaacgggctgacgctcttctgccccgtggactcggccgtcgcgtccttcgcggccacgtacaagaacctgacggccaaggccaagacggccatcctcctgtaccacggcgtgccggactacttctcgctgcagctgctcaagtccaacaacggcatggtcaccacgctcgccaccgccagcgagaagaagatggactacagctacgacgtcaagaacaaggacgagacggtcacrctgcagaccagggtcgtcacgtccagcgtcaccgccaccgtcggcgacatggagccgctggccgtctacgccgtggacaagttcctgcagcccaaggagctgttcaaggtcgtcgaggcgcccgcgcccgcgccggagccctccaagaagaagaaggccggtcacggcgggggtgacgacgattcctccgacgattcgacggccgatgcggaaaagggcgacgcagcaccggctctgctcgcgcgatgggtrgtcaccg

SEQ ID NO: 373 - DNA, 1566 bp, Panicum virgatum
cagctagcctccgactcatctctctccctcgctctagtccccaatacctctccaacatactcgtattggttcgtgggcaacaatggcgaggagccgcccggccgtcctcttgtccctcgccgttgtggcgttggcggccacggcgctggctccggcgccggcggcggcgaccaagtacaacatcaccaagctgctggcgccgtacaagcagtactcgaggttcaacgagatgctgtccaggacgcggctggcgtacgacatcaaccggcggcagaccatcacggtgctcgccgtcgacaacgcggccatgtcggcgctggaccactactcgctgcagaccatccggcacatcctctcgctgcacgtcctcgtcgactactacggcgacaagaagctcaagaagctcgcccacggctccaccgcctcttcctccatgtatcaggccaccggcgccgcgtcaggcatgtccgggtacgtgaacatcacccgcaaggacggcaaggtcagcttcacgacggacgacgccgacgccaccgcgaagcccacccggtacatcaggtccatcaaggagtacccctacgacatcgcggtgctcgaggtgagctccatcatctcctccgccgacgccgaggcgcccgtgccgccgccggcgcccgtcgacctcgtcgagctcctctccaagaagtactgcaagtccttcgcgtccctcctctcggccaacgccgacgtgctccgcaccttgaacgagaccaaggacaacgggctgacgctcttctgccccgtcgactccgccgtcgcggcgttcgcggccacctacaagaacctcacggccaaggccaagacggccatcctgctctaccacggcgtgccggactacttctcgctgcagctgctcaagtccaacaacggcatggtcaccacgctcgccaccgccagcgagaacaagaaggactacagctacgacgtgcagaacaagggcgagacggtcaccctccagaccagggtcgtcacctccagcatcacggccaccgtcggcgacatggagccgctcgccgtctacgccgtgaacaagttcctcaagccgaaggagatattcaaggtcgtcgaggcacccgcgcccgcaccagagccgtccaagaagaagagcaaggcagctgacggcggagatgactcgtccgacgattccggcgacgtgacggccgacaagggcgacgctgcgccagccgccatgctcgctcggtgggtggccgcagccacaacagcggtagcggcatttgcgttgatgggctaaatagttgtttcaaatcttattattctttttattttcatggtaaattgttttcctatttaatggcgctcggcaaagggggaaaattgaaacacattgttctgcatgcgccctgtagcaagaaacgtggaggaaggaactcgggattgtggcttgtagtgctttgagttttcgtcaattagcttgatatcgatgtaattattttgtaattaatacagttgttgtcagagtttgaaaagaagtcaggaatggtttcacgtggttaaattacccatttc

SEQ ID NO: 374 - DNA, 1608 bp, Brachypodium distachyon
tccgtgtcagctctgctctctgcctgctaaacctcgcaacaaccccccgtgaggccgtgaccaactccccaccaaacctgctctccgagacgccaaccaacccccctggagatggccggcacggtgtccaagctcgccgcgccacggccggcggcgctccctgcgccgtcgtcctccctccggtctacggcgctcgccttcgccccctccgcccgccggttccgcgtctccctctccggccgcgccaggagccccgtcattgcgatggcttctggcaaggaaggtaacggcgccgcgacgaagaggaccacgcttcacgacctctacgagctccagggccagtccccttggtatgacaacctctgccggcccgtcaccgatttgctgccctatatcgccaacggtgtccgtggagtcaccagcaacccaacaattttccagaaagccatctcctcatccaatgcgtatgatgatcagttcaagcaacttatatcagctgggaaggatgcggagagtgcttactgggaacttgttataaaagatattcaagacgcgtgcaaactttttgagcccatctacgaccagactgatggagctgatggttatgtttctgtggaggtgtctcctagattggcaaatgacactcaaggaactgtcgaagctgcgaagtggttacacaaggtggtcaaccgccccaatgtgtacataaagatcccagctactgcagaatgtgttccttctatccgggaagtcatcgctaatggcattagcgtcaatgttactcttatcttctcgattgcaagatatgaggctgtgattgatgcttaccttgacgggcttgaggcttctggtttgagtgacttgtcccgagtgactagcgtagcatccttctttgtcagccgagttgacagcctgattgacaaaatgcttgagaagactggaacacctgaggctcttgccctgaggggaaaggcggctgtagcacaggcgaagctagcgaatcagctttacctgaagaaattctctggcccgaggtgggaggctttggtgaagaaaggtgccaagaagcagaggttgctgtgggcatccaccagcgtgaagaaccctgcctacgctgacactctttatgtggaccctctcattggacctgacacggtctctacgatgcctgaccaagctttggaagcgttcatcgaccatggcacagtttctaggacaatcgacgccaatgtgtcagaagccgaaggcatatacagtgccctgggtaagctgggcatcaactgggatgaggtcgggacgcagctggagcttgaaggcgtggattccttcaagggcagcttcgacagcctgctcacgagcttgcaggagaagggcaatgccctcaagcccgcgaccctgtaggcgcaaaattgatatgatgggatggtttggcaccggcaccagcaagcaaacgattactaaataaatgccagcttgctggctctactctttagtttggacgtgaaatgatcccaattttctgggtcacctttgtattctaggcgtgcctggctgtcattgtgtaactgaggcttgttccttgcaactgctatgcgcttttctgatcaa

SEQ ID NO: 375 - DNA, 1553 bp, Cenchrus ciliaris
cacccatccatccccacttcctcctccttgcagttctcaccaaccccccggcggcgatgaccggcacggtgtccaagctggcggcgcccgggccggcsgcsgcggcratgcttcccccggcgtccctccgctcagccgccctcgggtttgccccctccgcccgccggttcagcgtctccatcgccggccgcgccaggaaccccatcattgcaatggcttctgccaaggaagggaatggtgctccgagcaagaggacctcacttcatgatctctatgagctccagggcctgtccccatggtatgacaacctctgccggcctgtcactgacttgctgccccttattgctagcggtgttcgcggagtcaccakcwwycyywckatttyccmsammgccatttcgtcgtcaagtgcatawgawgatcaattcaagcagctcatttcagctggaaaggatgcagagagtgcttactgggaactcgttataaaggatatccaagatgcatgcaaactttttgagcctatctacaatgagacggacggagctgatgggtatgtctccgtggaggtgtcgcctaggttggcaaatgacactcaaggaactgttgaggccgcaaagtggttgcacaaagtggtcaaccgcccaaatgtctacattaagatccctgctactgcagaatgtgttccttctatccgggaagtgatctctaatggcattagtgtcaacgtcacacttattttctcgattgcaagatacgaggctgtaattgatgcttaccttgatgggctagaggcttctggtttgagtgacttatcccgagttaccagtgttgcatccttctttgtcagccgagttgacagccttattgacaaaatgcttgagaagattggaacacctgaggctcttgccyttagaggaaaggcggctgtagcacaggcgaaactagcaaatcagctytaccagaagaaattytctggaccaagatgggaggctttggccaagaaaggtgccaagaaacagaggttgctgtgggcatccactggtgtcaagaaccctgcttatcctgacaccctttatgtggatagtctgattggacctgacacggtcaacacgatsccykwycaarcattgcaggcattcatarrccrkggcamwrwwwmaaggacagttgatgcgaatgtatccgacgcagaaggtgtatacagtgccctggagaagcttggcatcaactgggatgaggtcgggaagcagcttgagctggaaggtgtggactcgttcaagaagagctttgacagcctgcttgtgagcctgcaggagaagggcaatagcctcaagacggcaagtgtgtaaaactgaaatgattttgtaccggctggtgaacgatcgctaaataaaatgctagcttgctggctctcctcttaattttgtaactgttgggtggccctttaattttttgaatcggctttgtattttaggcttgcctggctgtcattgtgtaaacaatgttcatggcttgtaactgctatgcgctgtccgataaataatttttgagca

SEQ ID NO: 376 - DNA, 1483 bp, Leymus cinereus x Leymus triticoides
cctccgctccaccgcgctcgccttcgcccccttcgcccgccgcttccgcgtctccctcgccgaccgcgccaggagccccgtcattgcgatggcttccgccaaggaagggaacggcgccgtgacgaagaggaccacgctccatgacctctatgagctccagggccagtccccgtggtacgacaacctctgccggcctgtcaccgatttgctgccctacatcgccaacggtgtccgtggagtcacgagcaacccaacgattttccagaaagccatttcatcatccaacgcgtatgatggtcagtttaaggagcttatatcggctgggaaggatgcggagaacgcttactgggaactagtcataaaggacatccaagacgcgtgcaaactgtttgagcccatctacgacgagaccaatggagctgatggctacgtttcagtggaggtgtctcctaggctggcaaatgacactcaaggaaccgttgaagctgcaaagtggttacacaaagtggtcaaccgccccaatgtgtacatcaagatcccagctactgcagaatgtgttccttctatcaaggaagtcattgctaatggcatcagtgtcaatgtcactcttatcttctcggttgcaagatacgaggctgtgattgatgcttacctagacgggcttgaggcttctggtttgagtgacttatcccgagtgaccagtgtagcatccttctttgtcagccgagttgacagtctgattgacaaaatgcttgagaagattggaacacctgaggctcttgccctgagggaaaaggctgctgtagcacaggcaaagatagcaaatcagctttacctgaagaaattctctggcccgaggtgggaggctttggtgaagaagggggctaagaagcagaggttgttgtgggcatccaccagcgtgaagaayccggcttactctgacactctttacgtcgatcctctcatcggacctgacacggtctctacgatgcctgaccaagctttggacgcattcatcgaccayggcacagttgctaggacaatcgacgcgaacgtatcagaagccgagggcatatacagtgccctggagaagcttggcatcgattgggaagaggttggcaagcagctggagcacgagggygtgagttccttcaaggggagcttmgacagcctgctcacgagcttggaggagaagggcaacgccctcaagacckcygccaacctgtaggcgctraaattatyagaktggtttggtaccggygctggccatcaaacgattaccgaataaatgccagsttgctggctctcctcttccatttggaaatgaaatgctaccagttatctgggtgagcttctttgtattctaggcgtgcctggctgtcattgtgtaactgtggcctgttgcttgcaactgctattcgtttcctkatcaattgtttttgagcaagccatatttgtgtacctttgggaaatgcatttctca

SEQ ID NO: 377 - DNA, 1813 bp, Zea mays
gtacaggtcgcaacaaccccaacgagcaaaccccccatttgccaccaaccccgacgagcggcgatgaccggcacggtgtctaagctggcggcgccccgtccggcggcaccgccgctccggccggcgtccctccgcaccgccgccctcgccttcgccccctccgcgcgccgggtccgcgtctccgtcgccgggcgagccaggagccccatcattgcgatggcttcggccaaggaaggaaatggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggctggaaaggacgcggagagcgcttactgggaactcgttataaaggatatccaagatgcgtgcaaactttttgagcccatctacgatgagactgatggggctgatgggtatgtctccgtagaggtgtctcctaggttggcaaatgacactcaaggaactgttgaagcggcaaagtggttacacaaagtggtcaaccgccccaatgtctacataaagatcccagctactgcagaatgtgttccttccatccaggaagttatcgctaatggcattagcgtcaacgtcacgcttattttctcaattgcgagatatgaggctgtgattgatgcttacctcgatgggctagaggcttctggcttgagtgacttatcccgagttactagcgttgcatccttctttgtcagccgagtggacacccttattgacaaaatgcttgacaagattggaacacctgaggcccttgccttgagaggaaaggctgcagtagcacaggccaaactagcaaatcggctctaccagaagaaattctctggcccaaggtgggaggcgttggccaagaaaggtgccaagaaacaaaggttgttgtgggcatccaccggtgtcaagaacccagcttatcctgacactctttatgtggacagtctcatcggacctgacacggtcaacacgatgcccgaccaagctttgcaagcattcatagaccacggcaccgtttcaaggacagttgatgcgaatgtgtctgaggcggaaggtgtatacagcgccttggagaagcttggcatcgactgggaagaggttggaaagcagcttgagctggaaggcgtggactccttcaagaagagctttgacagcctactcgtgagcctgcaggagaagggcaacagcctcaagatggcgagtgtgtaaagctgagaagattgggtacctgcgagtgaacgattttactaaataaaatgctagcttgctggctctcctcttagtttttacgctgtacctttgctctcaattttctgaatcggctttgtatcccaggcttgccagaacgtcattgtgtagccactgttcatggcttgtaattgctacggggtatccgataacgtcattgtggatgatgcctgtttgccctgactcttgaactcaatgtcgccatggtttgctatgcatttacgtgtgctctgcaataatctgtcattggtggcttgcaataggatgttcatagcacttttgcggcacttaggttttgagattcatcatgacataggctacaaccaccaccagacaatcactattgatcaggttgatctgtgtttccatccatgagctaccatttgcaaatataataaagattgagcaagcacattctagc

SEQ ID NO: 378 - DNA, 1637 bp, Zea mays
accaacacaaacgaaagagcctccaaaacctcgcaacaaccccgtgacacccacacccatccgccctgcccctcctcgcgctccccaccaaccccgacgagcggcgatgaccggcacggtgtccaagctggcggcgccccggcctgcggcgccaccgctccggccggcgtccctccgcgccgccgcaatcgccttcgccccctccccgcgccgggtccgcgtctccgtcgccgggcgggccaggatcccctccgtcattgcgatggcttctgccaaggaaggaaatggtgcaccgaccaagaaaacctcgcttcacgatctctacgagctccagggcctctccccgtggtatgacaacctctgccgacctgtcaccgacttgctgccccttatcgccagcggtgttcgtggagtcaccagcaaccctgcaattttccagaaggccatctcatcctccagcgcatatgatgatcagttcaagcagctcatttcgggcggaaaggacgcggagagcgcttactgggaacttgttataaaggatatccaagacgcgtgcagtctttttgagcctatctacgatgagaccgatggggctgatgggtatgtctccgtggaggtgtctcctaggttggcaaatgacactcaaggaactgttgaggccgcaaagtggttacacaaagtggtcaaccgccccaatgtctacataaagatccctgctaccgccgaatgtgttccttccatccgggaagttatcgctaatggcattagcgtcaacgtcacgcttattttctctattgcgagatacgaggctgtgattgatgcttaccttgatgggctagaggcttctggcttgagcgacttatctcgagttaccagtgtcgcatccttctttgtcagccgagtcgacacccttatcgacaaaatgcttgagaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaagcttggcattgactggggcgaggtcggaaagcagcttgagctggaaggtgtggactccttcaagaagagctttgacagcctactcgtgagcctacaggagaagggcaacagcctcaagacggcaactgtgtaaaactgagaagattgggtaccggcgggtgaacgattttactaaataaaatgctagcttgctggctctcttagtttttacgatgtacctttgctctccattttctgaatcgggattgtattctaggcttgcctggccgtcattgtgtgaccaacgttcatggcttgtaacaagggatcggacgtaaacggttggaaaacatctctgttactttctatacgatttttatttgccccgctct

SEQ ID NO: 379 - DNA, 1726 bp, Sorghum bicolor
gtctgctacttatggatgctgacgagcagcaaaacctcgcaacaacccccgtccccgtgagcgaccaacccacccatcccatctgctcttcccaccaacaacccccgacgagcggcgatgaccggcacggtgtccaagctagccgcgccccggccggcggcggcgccgctccgaccggcgtccctccgcaccgccgccctcgcgttcgccccctccccgcgccgggtcaccgtctccgttgccgggcgagccaggagccccatcattgcgatggcttctgccaaggaaggaaatggtgctccgaccaagaagaccgcgcttcatgatctctacgagctccagggcctgtccccgtggtacgacaacctctgccgccctgtcactgacttgctgccccttatcgccagcggtgttcgtggagtcaccagcaaccctacgattttccaaaaggctatttcatcgtccagcgcatatgatgatcagttcaagcagctcatttcgggtggaaaggacgcggagagtgcttactgggaactcgttataaaggatattcaagacgcgtgcaaactttttgagcctatctacaatgagactgatggggctgatgggtatgtctctgtggaggtgtctcctaggttggcaaatgacactcaaggaactgttgaagcggcaaagtggttgcacaaagtggtcaaccgccctaatgtctacataaagatccctgctactgcagaatgcgttccttccatccaggaagttattgctaatggcattagcgtcaatgtcacgcttattttctcgattgcaagatatgaggctgtgattgatgcttaccttgatggacttgaggcttctggcttgagtgacttatcacgagttaccagtgttgcatccttctttgtcagccgagtcgacagccttattgacaaaatgctcgagaagattggaacacctgaggcacttgccttgagaggaaaggctgctgttgcacaggccaaactagcaaatcagctctaccagaagaaattctctggaccaaggtgggaggcgttggccaagaaaggtgccaagaaacagaggttgttgtgggcatccaccggtgtcaaaaacccagcttatcctgacactctttatgtggacagtctcattggacctgacacggtcaacacgatgcccgaccaagctttgcaggcattcatagaccatggcactgtttcaaggacagttgatgcgaatgtgtccgaggcggaaggtgtatacagcgccttggagaagcttggcatcgactgggacgcggttggaaagcagcttgagctggaaggtgtggactcctttaagaagagctttgacagcctacttgtgagcctgcaggagaagggcaacagcctcaagacggcaagtgtgtaaaactgaaatgattgggtactggctggtggacgattactaaataaaatgctagcttgctggcgctcttagtttttttacgatgtacctttgctctcaattttctgaatcggctttgtattagaggcttgcctggccgtcattgtgtaaccaatgttcatggcttgtaactgctatgtgagtatccgataaataattttgatcaagttatttcttctgtccgtataagtcatgtttttttacggaattttgtctgagaatgtacagtttattttacccacgacattatatgtggctcgtgaatcacagtcgtggtttgatg

SEQ ID NO: 380 - DNA, 1641 bp, Saccharum officinarum
cgaccaacccacccgtcccatctgctcttcctcgcacttcccaccaacaaccccgacgagcggcgatgaccggcacggtgtccaagctagccgcgccccggccggcggcggcgccgctccggccggcgtccctccgcaccgccgccctcgccttcgccccctccccgcgccgggtcagcgtctccatcgccgggcgagccaggagccccatcattgcgatggcttctgccaaggaaggaaatggtgctccgaccaagaagaccgcgctccatgatctctacgagctccagggcctgtccccctggtacgataacctctgccgccctgtcactgacttgctgccccttatcgccagcggtgttcgtggagtcaccagcaaccctacgattttccaaaaggctatttcatcgtccagcgcatatgatgatcagttcaagcagctcatttcgtctggaaaggacgcggaaagcgcttactgggaactcgttataaaggatattcaagacgcctgcaaactttttgagcctatctacaacgaaaccgatggggccgatgggtatgtatccgtggaggtgtctcctaggttggcaaatgacactcaaggaactgttgaggcggcaaagtggttacacaaagtggtcaaccgccccaatgtctacataaagatccctgctactgcggaatgtgttccttccatccaggaagttattgctaatggcattagcgtcaacgtcacgcttattttctctattgcgagatacgaggctgtgattgatgcttaccttgatgggctagaggcttctggtttgagtgacttatcccgagttaccagtgttgcatccttctttgtcagccgagtcgacacccttattgacaaaatgcttgagaagattggaacacctgaggcacttgccttgagaggaaaggccgccgtagcacaggccaaactagcaaatcagctctaccagaagaaattctctggcccaaggtgggaggcgttggccaagaaaggtgccaagaaacagaggttgttgtgggcatccaccggtgtcaagaacccagcttatcctgacactctttatgtggacagtctcattggacctgacacggtcaacacgatgcccgaccaagctttgcaggcattcatagaccatggcactgtttcaaggacagttgatgcaaatgtgtctgaggcggaaggtgtatacagcgccttggagaagcttggcattgactggggtgaggttggaaagcagcttgagcttgaaggcgtggactcctttaagaagagctttgacagcctacttgtgagcctgcaagagaaaggcaacagcctcaagacggcaagtgtgtaaaactgaaatgattgggtaccggctggtgaatgattttactaaataaaatgctagcttgctggctgtcctcttagtttttacgatgtgatgtaccttgctctcaattttctgaatcggctttgtattttaggcttgcctggccgtcattgtgtaaccaatgttcatggcttgtaactgctatgcgggtatccgatatataattttgagcaagttattttaagtatgtatgcgtcctggttggtttatggaaatgttcatctgggaaatgtaaatttttattttatct

SEQ ID NO: 381 - DNA, 1603 bp, Panicum virgatum
caactccaaaacctcgcaacaaagcccgtgagcgaccaacccccacccccatccatcctctccttcctcgcagatcccaccaaccccggcggcgatgaccggcacagtgtccaagctggcggcgccccggccggcggcggcgctgctcccgccggcgtccctccgctccgccgccctcgccttcgccccctccccgcgccggttccgcgtctccatcgccggccgcgccaggagccccgtcattgcgatggcttctgccaaggaagggaatggtgctccgaccaagaagaccgcacttcacgatctctatgagctccagggcctgtcaccatggtacgacaacctctgcaggcctgtcaccgacttgctgccccttatcgccagtggtgttcgcggagtcaccagcaaccctacgattttccagaaagccatttcatcatcaagcgcatatgatgatcaattcaagcagctcattacagctggaaaggatgcagagagtgcttactgggaactcgttataaaggatatccaagatgcgtgcaaactttttgagcctatctacaacgagacagatggtgctgatgggtatgtctctgtggaggtgtctcctaggttggcaaatgacactcaaggaacagttgaggctgcaaagtggttgcacaaagtggtcaaccgccccaatgtctacataaagatccctgctactgcagaatgtgttccttctatccgggaagtcatctctaatggcattagcgtcaacgtcacacttattttctctattgtaagatatgaggctgtgattgatgcttaccttgatgggctggaggcatcgggtttgagtgacttatctcgagttaccagtgttgcgtccttctttgtcagccgagttgacacccttgttgacaaaatgctcgaaaagattggaacacctgaggcgcttgcccttagaggaaaggctgctgtagcacaggcaaaattagcaaatcagctctaccagaagaaattctctggcccaagatgggaagctttggctaagaaaggtgccaagaaacagaggttgttgtgggcatcaactggcgtcaagaaccctgcttatcctgacaccctttatgtggacagtctgattggacctgacacggtcaacacgatgcccgaccaagcgttgcatgcattcatagaccacggcactgtttcaaggacagttgatgcgaatgtgtcggaggcagaaggtgtatacagtgccctggagaagcttggcatcgactgggatgaggtggggaagcagcttgagctggaaggagtagactcgttcaagaagagctttgacagcctacttgtgagtcttcaggagaagggcaacagcctcaagacggcaagtgtgtaaaactgaaatgttttggtacctgcaggtgaacgattactaaataaaatgctagctcgctggctctcctcttagttttgtgactgtgcgggtgctcttgattctgtgaatcagctttgtattctagtcttgcctggcttgtgtaacgaggcttgtaactgctatgcgctatccaataaataatttttgagcaagtttattgagtttggatatattgtgttt

SEQ ID NO: 382 - DNA, 1613 bp, Panicum virgatum
cgcaacgacccccgtgagcgaccaaacccatcccatcctccccttcctcgcagttcccaccaaccccggcggcgatgaccggcacggtgtccaagctggcggcgccccggccggcggcggcgctgctcccgccggcgtccctccgctccgccgccctcgccttcgccccctccccgcgccggctccgcgtctccatcgccggccgcgccaggagccccgtcgttgcgatggcttctgccaaggaagggaatggtgctccgaccaagaagaccgcacttcacgatctctatgagctccagggcctgtccccatggtacgacaacctctgcaggcctgtcaccgacttgctgccccttattgccagcggtgttcgcggagtcaccagcaaccctacgattttccagaaagccatttcatcgtcaagcgcatatgatgatcaattcaagcagctcatttcagctggaaaggatgcagagagtgcttactgggaactcgttataaaggacatccaagatgcgtgcaaactttttgagcctatctacaacgagacagatggtgctgatgggtatgtctctgtggaggtgtctcctaggttggcaaatgacactcaaggaacagttgaggccgcaaagtggttgcacaaagtggtcaaccgccccaatgtctacataaagatccctgctactgcggaatgtgttccttctatccgggaagtcatctctaatggcattagcgtcaacgtcacacttattttctctattgtgagatatgaggctgtgattgatgcttaccttgatgggctagaggcttcgggtttgagtgacttatctcgagttaccagtgttgcatccttctttgtcagccgagttgacacccttattgataaaatgctcgaaaagattggaacacctgaggcacttgcccttagaggaaaggctgctgtagcacaggcaaaattagcaaatcagctctaccagaagaaattctctggcccgagatgggaagctttggctaagaaaggtgccaagaagcagaggttgttgtgggcatccactggcgtcaagaaccctgcttatcctgacaccctttatgtggacagtctgattggacctgacacggtcaacacgatgcctgaccaagcgttgcatgcattcatagaccatggcactgtttcaaggacagttgatgcgaatgtgtcggaggcagaaggtgtatacagtgccctggagaagcttggcatcgactgggatgaggtggggaagcagcttgagctggaaggagtggactcgttcaagaagagctttgacagcctacttgtgagtctccaggagaagggcaacagcctcaagacggcaagcgtgtaaaactgaatgatttggtaccggctggtgaacgattactaaataaaatgctagctcgctggctctccttagttttgtgactctgcggatgctcttgattatgtgaatcagtcattgtgtaaccaatgttcatggcttgtaactgctatgcgctatccaatgaataatttttgagcaagcttatagagtctggatatattgtgtttgttttatagaatttttatctgggaaggtacatcttattttacctgc

SEQ ID NO: 383 - DNA, 1758 bp, Triticum aestivum
agatcggtgcgtgtgaggcagccccgctccgctaaacctcgcaacaacccccgtgggcgaccaacccagcccagccgcccccctctcctcaccaacccccgagccggaagcagagccgcgatggccggcaccgtgcccaagctcgccgccccgaggccggcggccgcggggccgctcccctcgcagcccctccgcgccgccgcgctcgccttcgccccctccgcccgacgcttccgcgtctccctcgccggccgcgccaggagccccgtcattgcgatggcttccgccaaggaagggaacggtgcggtgacgaagaggaccacgctccatgacctctatgagcaacagggtcagtccccgtggtacgacaacctttgccggcctgtcaccgatttgctgccctacatcgccaacggtgtccgtggagtcaccagcaacccaacgattttccagaaagccatctcttcatcaaacgcctatgacggtcagttcaaggagcttatatcagctgggaaggatgcggagagcgcttactgggaactcgtcataaaggacatccaagacgcgtgcaagctgtttgagcccatctacgacgagactgatggggctgatggttacgtttcagtggaggtgtctcctaggctggcaaatgacacccaaggaaccgtcgaagctgcgaagtggttacacaaagtggtcaaccgccccaatgtgtacataaagatcccagctacagcagaatgtgttccttctatcaaggaagtcattgctaatggcatcagcgtcaatgtcactcttatcttctctgttgcaagatacgaggctgtgattgatgcttacctcgacgggcttgaggcttctggtttgagcgacttatcccgagtaaccagtgtagcatccttctttgtcagccgagttgacagtctgatcgacaaaatgcttgagaagattggaacaccggaagctcttgccctgaggggaaaggctgccgtagcacaagcaaagatagcaaatcagctttacctgaagaaattctctggcccgaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgcgaacgtatcagaagccgagggcatatacagtgccctggagaagctgggcatcgactgggaagaggttggcaagcagctggagcacgagggcgtgagctccttcaaggggagcttcgacagcctgctcacgagcttggaggagaagggcaacgccctcaagaccgccgccaacctgtaggcgctaaaattgttggatagaatggtttggtaccggcgctggccatcaaacgattacccaataaaaatgccagcttgctggctctccccttccattcggaaatgaaatgctcccagttatctgggtgagcttctttgtattctaggcgtgcctggctgtcattgtgtaactgaggtttgttgctcgcaactgctatcgttttctgatcaattgtttttgagcaagtgagccatatttgtgtatctttgggaaatgcatttctccttactgttgttatctgtatgttcgcaagattacaggaatgttggcaactttagctcagtaatgttttggaatatatca

SEQ ID NO: 384 - DNA, 1658 bp, Triticum aestivum
gagagatccgtcgtgcgtgtgaggcagccccgctaaacctcgcaacagcccccgtgggcgaccaacccagcccagccgcccccctcaccaaccccggagtcggaagcagagccgcgatggccggcaccgtgcccaagctcgccgccccgaggccggcggccgcggggccgctcccctcgcagtccctccgctccgccgcgctcgccttcgccccctccgcccgccgcttccgcgtctccctcgccgcccgcgccaggagccccttcattgcgatggcttccgccaaggaagggaacggcgccgtgacgaagaggaccacgctccatgacctctacgagcaacagggtcagtccccgtggtacgacaacctctgccggcctgtcaccgatttgctgccctacatcgccaacggtgtccgtggagtcaccagcaacccaacgattttccagaaagccatctcttcatcaaacgcgtatgacggtcagttcaaggagcttatatcagctgggaaggatgcggagagcgcttactgggaactcgtcataaaggatatccaagacgcgtgcaaactgtttgagcccatctatgacgagaccgatggagctgatggttacgtttcagtggaggtgtctcctaggttggcaaatgacacccaaggaaccgttgaagctgcgaagtggttacacaaagtggtcaaccgccccaatgtgtatatcaagatcccagctactgcagaatgcgttccttctatcaaggaagtcattgctaatggcatcagcgtcaatgttactcttatcttctccgttgcaagatacgaggctgtgattgatgcttacctcgacgggcttgaggcttctggtttgagcgacttgtcccgagtgaccagcgtggcatccttctttgtcagccgagttgacagtctgatcgacaaaatgcttgagaagattggaacaccggaggctcttgccctgaggggaaaggctgccgtagcacaagcaaagatagcaaaccagctttacctgaagaaattctctggcccgaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggggtgagctccttcaaggggagcttcgacagcctgctcacgagcttggaggagaagggcaacgccctcaagactgccgccaacctgtaggcgctaaaattatcggatagaatggtttggtaccggcgctggccatcaaacgattaccgaataaaaatgccagcttgctggctctctccttccatttggaaatgaaatgctcccagttatctgggtgagcttgcttcttgtattctaggcgtgcctggctgtcattgtgtaactgaggcctgttgcttgcaactgctattcgttctctgatcaattgtttttgagcaagtgagccatatttgtgta

SEQ ID NO: 385 - DNA, 1704 bp, Triticum aestivum
ccccgctccgctaaacctcgcaacaacccccgtgggcgaccaaccagccgtccccctcaccattcaccaaccccgccgagagtcggaagcagagccgcgatcgatggccggcaccgtgcccaagctcgccgccccgaggccggcggccgcggggccgctcccctcgcagcccctccgctccgccgcgctcgcctccgccccctccgcccgccgcttccgcgtctccctcgccgcccgcgccaggagccccgtcattgcgatggcttccgccaaggaggggaacggcgccgtgacgaagaggaccacgctccatgacctctatgagcaacagggtcagtccccgaggtacgacaacctctgccggcctgtcaccgatttgctgccctacatcgccaacggtgtccgtggagtcaccagcaacccaacgattttccagaaagccatctcttcatcaaacgcgtatgacggtcagttcaaggagcttatatcggctgggaaggatgcagagagcgcttactgggaactcgtcataaaggacatccaagacgcgtgcaaactgtttgagcccatctacgacgagaccgatggggctgatggttacatttcagtggaggtgtctcctaggctggcaaatgacacccaaggaaccgtcgaagctgcgaagtggttacacaaagtggtcaaccgccccaatgtgtacatcaagatcccagctactgcagaatgcgttccttctatcaaggaagtcattgctaatggcatcagcgtcaatgtcactcttatcttctccgttgcaagatacgaggctgtgattgatgcttaccttgacgggcttgaggcttctggtttgagtgacttatcccgagtgaccagtgtagcatccttctttgtcagccgagttgacagtctgatcgacaaaatgcttgagaagattggaacacctgaggctcttgccctgaggggaaaggctgctgtagcacaagcaaagatagcaaaccagctttacctcaagaaattctctggcccaaggtgggaggctttggtgaagaagggagccaagaagcagaggttgttgtgggcatccaccagcgtgaagaacccggcttacttggacactctttacgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggtgtgagctccttcaaggggagcttcgacagtctgctcacgagcttggaggagaagggcaacgccctcaagaccgctgccaacctgtaggcgctaaaattatcggatataatggtttggtaccggcgctggccatcaaacgagacccaataaaaatgccagcttgctggctctctccttccatttggaaatgaaatgctaccagttttctggttgagcttctcctgtattctaggtgcacctggctgtcattgtgtaactgaggcttgttgcttgcaactgctattcgttttctgatcaattgtttttgagcaagtgagccatatttgtgtatctttgggaaatgcatttctccttgctgttgttattcgtactttctacaagattatgagaat

SEQ ID NO: 386 - DNA, 1125 bp, Zea mays
gcaatggcgtccaggcagaccttcgcctgctacaccatggccctgctgttcgctgcggctgctgtctcggcgcagctctccaccgacttctacgacgacacatgccccgacgcgctcgacatcatcgagtccgcagtgagagctgccgtctccaaggagtcccgcatgggggcctccctcctccgcctccatttccacgactgctttggctgtgacgggtcagtgctgctcgacgacgcactgggctttaccggcgagaagacggcgcagccgaacaagaactctctccgcgggttcgacgtggttgacgacatcaaggcgcagctcgaggacgcatgcaaccagacagtctcctgcgccgacatcctcgcagtcgccgcccgcgactccgtcgtcgccctcggcggtcctacgtgggacgtggagctcggccggcgggacgggacgacggcgaacctggacgacgcgaacaacgacctcccagcgccgaccctggacctcggtgacctcatcaaggccttctccaagaaggggctgagcgcgagcgacatgatcgcgctgtcgggcggacacacgatcgggcaggcgcggtgcgtcaacttccgcggccgcctctacaacgagaccgccagcctggacgcgtcgctggcgtcgtcgctgaagccgcggtgcccgggcgcggccggcagcggcgacgacaacacgtcgccgctggacccggccacgtcctacgtcttcgacaacttctactacaggaacctgctgcggaacaagggcctgctccactcggaccagcagctcttcagcggcggcggctccgcggacgcgcagaccaccgcctacgcgtccgacatggctggcttcttcgacgacttccgcgacgccatggtgaagatgggcgccatcggcgtggtcactgggtccggggggcatgttagagtgaactgccggaagacgaactaactgatcgcgatcggtgtcaggcttcgacgtttcgtactgtcagctgtcacgatggagtgatcagtacgtgtctggtctgcgcagagttactgctccttctatgatggcgtagtctgcttcgaacggttgtagtactaccttttacaggaataaaaacgaagg

SEQ ID NO: 387 - DNA, 1435 bp, Oryza sativa
ttgcattgcagagttcagtgtaacaaagacactgaagctacagcctacagagagagagtatctggatacttaattgtgtgcttagcttgcggttaagcaatggcttattccaggcaaatcttcgtctgctctgccatggctgcgttgctcttctctgctgttgtttcggcgcagctctccactgatttctacgacgagacatgccccgacgcgctcgacatcatcgaatctgccgtcagagacgccgtttccaaggagtctcgcatgggagcttcgctgctgcgcctccatttccacgactgctttgtcaatgcaaatataattcagaagttcagagtggatgctgacgggtcagttaagcaagtggggtgtgacgggtcagtgctgctcgacgacacggcggccatcaccggcgagaagaacgcgaagccgaacaagaactccctccgcggcttcgaggtcgtcgacgacatcaagtcgcagctcgaggacgcctgcgagcaggtcgtctcctgcgccgacatcctcgccgtcgccgcccgcgactccgtcgtcgccctgggcgggccgacgtgggacgtcgagctgggccggcgagacgggacgacggcgagcctggacgcggcgaacaacgacctcccgccgccgacgtccgacctcgccgacctgatcaagtccttctccgacaagggcctgacggcgagcgacatgatcgcgctgtcgggcgcgcacaccatcgggcaagccaggtgcaccaactttcgcggccgcctctacaacgagaccaacctcgacgccaccctcgccacctcgctgaagccgagttgccccaaccccaccggcggcgacgacaacacggcgccgctcgacccggccacctcctacgtgttcgacaacttctactacaggaacctcctgaggaacaagggccttctgcactcggaccagcagctgttcagcggcggctccgccgacgcgcagaccaccgcctacgccaccgacatggccggcttcttcgacgacttccgtggcgccatggtgaagatgggcggcatcggcgtcgtcaccggctccggtggccaggtcagggttaactgcaggaaggtcaattaaagtggttgataccgtgatcagtgttaatgtggttggttagtgtcaggtttcttaataccgtgatcagtgttaatgtggtttgtacaagtgttcttctttccttcagcgatgtagtctgcttcgaacggttgtagcactactatacgcaaaaataatctgatgaaggaacaaagactggttcctactgaaaaatcgtgttgcacaagaccttgttttactggaattattatgtttgtaatcaaatagagataactagaaatgagatgacacagttgcatgggaatgggaatcactaattagtactgtcaaaattgcagattac

SEQ ID NO: 388 - DNA, 1143 bp, Sorghum bicolor
ctccagtcacagaagaactctctgtgcttagcgggcggcttatccagctccagctaccagcaatggcgccctgccggcagaccttcgcccgctacaccatggcgctgctgtttgctgcggctgctgtctcagcgcagctctccaccgacttctacggtgagacatgccccgacgcgctggacatcattgagtccgccgtgagagccgctatctccaaggagtcccgcatgggggcctccctgctccgcctccatttccacgactgctttggctgtgacgggtcagtgctgctcgacgacaccacgggcttcaccggcgagaagacggcgaagccgaacaagaactcgctccgtgggttcgacgtggttgacgacatcaaggcgcagctcgaggactcctgccagcagacggtctcctgcgccgacatcctcgccgtcgccgcccgcgactccgtcgtcgccctcggtgggcctacgtgggacgtggagctcggccgccgtgacgggacgacggcgagcctggacgacgcgaacaacgacctcccggcgccgaccctggacctcggcgacctcatcaaggccttcgccaagaagggcctgagcgcgaacgaaatgatcgcgctgtcgggcgggcacacgatcgggcaggcgcggtgcgtcaacttccgcggccgcctctacaacgagaccaccagcctggacgcgtcgctggcgtcgtcgctgaagccgcggtgcccgagcgcggacggcaccggcgacgacaacacgtcgccgctggacccggccacgtcctacgtcttcgacaacttctactacaggaacctgctgcggaacaagggcctgctccactcggaccagcagctcttcaacggcggctccgcggacacgcagaccacctcctacgcgtccgacaaggccggcttcttcgatgatttccgcgacgccatggtgaagatgggtgccatcggcgtcgtcactgggtccggagggcaggtcaggctgaactgccggaagacgaactaaatgcatggccggtgtcaggtttggtagtgttgtgatgggagtgatcagtgcgtgtagtgtgttgtggtctacagaagtgcagagttatctgttccttctatgatggcgtagtctgcttcga

SEQ ID NO: 389 - DNA, 1590 bp, Brachypodium distachyon
tcggtcggcttcgccatggccggggcagaaacggcggtggactccggcgagaagcgcctcaacgagctcggctacaagcaggagctccgtagggagatgacgctgttcaagacgctggcaatctccttctcgacgatgacgctcttcacggggatcacgccgctgtacgggagcagcctgcagtacgccgggccggcgcccctcgtgtggggctgggtcgtcgtctccttcttcacctggttcgtcggcattgcaatggccgagatctgctcctccttccctaccaccggttctctgtatttctgggctgctcatctggctgggccggtctggggtccattggcatcttggtgctgcgcttggcttgaggccattggcctcattgccggaatcggcacacaggcgtacgcgggatcccaggtgctgcagagcataattctgctgtgcaccggcacaaacaaaggcggcggctatctggcccctcgctggctgttcctcgtcatgtacctcgggttaacgttcatctgggccgtgctcaacactttcgcgctggaggtcatcgccgtcctcgacatgatctccatgtggtggcaggtgatcggcgggacggtcatagtgatcctgctgccgctggtggcgaaaaccacacaaccagcgtcgtacgtgttcacgcatttcgagacggcgccgtcggtgaccgggatcagcagcgtctcctacgcggtggtgatgtccttcctggtgagccagtactcgctgtacgggtacgacgcggcggcgcacctgacggaggagaccaagggcgccgacaagaacgggcccatcgccatcctctccagcatcggcatcatctccgtcttcggctgggtgtacatcctggcgctcaccttcagcatccaggacttcgcctacctctacgacccgaccaacgagacggccggcaccttcgtcccggcgcagatcctctacgacgccttccacgggcggtacaacagctccgccggcgccatcgtgctgctcttcgtcatctggggatccttcttcttcggcgggctctccatcaccaccagcgccgcccgcgtggtgtacgcgctgtcgcgtgaccgcggcgtgccgttctcgtcggtgtggcgccggatccacccgaagcacaaggtgcccgggaacgccgtgtggctgtgcgcggcggtgtgcgcgctgctggggctgccgatcctcaagatcaacgtggtgttcacggccatcacctccgtggccaccatcggctgggtcggcggatacgcggtgcccatcttcgccaggatggtgatgaaggaggagaacttccggcccggcccgttctacctccggggggccagcaggcccgtctgcctcgtggcgttcctgtggatctgctacacctgcgccgtgttcctgctccccaccgtgtaccccatcaagatggacaccttcaactacgcgcccatcgcgctgggagtcgtgctggggctcatcatgatctggtgggtcgtcgacgccagggagtggttcaagggccccgtcaggaacatcgacgagcacaataacggcgacgacaatggcaaggtctga

SEQ ID NO: 390 - DNA, 2532 bp, Zea mays
atataaattccacaccgctcgctgccgtgcccgcacctgtgctgtgcataacgaacgccagcaaacaaacagcgccgcaacccaccctatagcgcaggaggagaggagcccctcctcccgttcccataaatcccattcgcacggcgaggcgagacgaggcgagggcaactgggcctgggctgccggcagagcttggaccgctcgccatggccggcggcggggagagggagggcgcgcaggcgatggactccggcgagaagcgcctcaacgagctcggctacaagcaggagctccgcagggagatgacgctgttcaagacgctggccatctccttctccacgatgacgctcttcacggggatcacgccgctgtacgggagcagcctgcagtacgcggggccggcgccgctcgtctggggctgggtcgtcgtctccttcttcacctgcttcgtcggcgtcgccatggccgagatctgctcctccttcccgaccactggttctctgtatttctgggctgcacatttggcaggtccagtctggggtccgttggcgtcttggtgctgcgcttggctggaggccatcggcctcattgccgggattggcacacaggcatacgcaggatcccaggtactgcagagcatcatcctgctctgcaccggcaccaacatgggcggtggctacctggcccctcgctggctgttcctggtcatgtacatcgggctgacactgatctgggccgtgctcaacactttcgcgctcgaagtcatcgcgttcctcgacgtgatctccatgtggtggcaggtgatcggtggcaccgtcattgtggtgatgctcccgctggtggccaagacgacgcagccggcgtcgtacgtgttcacccacttccagacggcgcccgacgtgacggggatcggcagcagcgcctacgccgtcgtcctgtccttcctggtcagccagtactcgctgtacgggtacgacgcggcggcgcacctgacggaggagaccaaaggcgccgacaagaacggacccatcgccatcctctccagcatcggcatcatctccgtgttcggctgggcgtacatcctggccctcaccttcagcatccaggacttcagctacctgtacaacccgaacaacgagaccgccggcacgttcgtgccggcgcagatcctgtacgacgcgttccacgggcggtacaacagctcggccggcgccatcgtgctgctgttcgtcatctggggctccttcttcttcggcgggctgtccatcacgacgagcgcggcgcgggtggtgtacgcgctgtcgcgggaccagggcgtcccgctgtcgtcggtgtggcgccgtatccacccgcggcacaaggtgccggcgaacgcggtgtggctgtgcgcggcggtgtgcacgctgctgggcctgcccatcctgcgcatcaacgtggtgttcacggccatcacctccatcgccaccatcggctgggtgggcggctacgcggtgcccatcttcgcgcgcatggtgatgcgggaggacgacttccggccgggccccttctacctcggccgcgccagcaggcccgtctgcctcgtcgccttcctctggatctgctacacctgctccgtcttcctgctccccaccgtctaccccatcaagatggacaccttcaactacgcgcccatcgcgctcggcgtctgcctcggcctcatcatgctttggtggctgctcgacgcgcgcaagtggttcaaaggccccgtcaggaacatcgacgaccacaacaacggcaaggtctgaacacctacgcacgtcaagccaaggcctcaatcgactgacgccattctgtgctgtttgactccgggacttgggcgctgctgacaccgtctccctccctctcaccctctgtatgttttcgatgctgcatcagcagcacctgtggcctgtgggtgacaagtgacttacatggagaacagaggaaaaattgagcaaacacaaaaggaaaaaaatgaatgaccagtatttaagttattttagatggaaacatgtgaaatatttaagtttttgcaacagaaaagttcataatacataaataaatctatacaaaactgattcaaatagctaaatatgtccagtatatttaacttccggtcttcaggctgaacctttattcttaacctacatgtatatttatttttacaagcctacaatggatacatatgcagttcaggaagctcctatgggaataaaattcttcggcactgctaggaggctcaacgtgctgtatacttatatatctattcagcacatacattatgtgcttgattaaaaaactgacattacctgtctgacactttcgatttcaattcacgatggagctgctggtcatgttcatcatggatatggctcaattcaggcggtgttaagtttttttgaactagttaggatgacataggatcccatattcttgggtcctttgatgtctacaatctacattagtgagctgttgcatattactcatgatatataaaatttaccttggtttttt

SEQ ID NO: 391 - DNA, 2081 bp, Sorghum bicolor
aagacgtaacgcaacgaacgccaacaaacaaacagagccagcggcgcaaccgccgccgctgaaccgcgccgcaacccgcaggagatcgagcccctcctccattcctcggcgccggcagcttcggttgttcgttcgccatggccggcggggagagggacgacgcggtggcgatggactccggcgagaagcgcctcaacgagctcggctacaaacaggagctccgcagggagatgacgctgttcaagacgctggccatctccttctcgacgatgacgctcttcacggggatcacgccgctgtacgggagcagcctgcagtacgcggggccggcgccgctcgtctggggctgggtcgtcgtctccttcttcacctggttcgtcggcatcgccatggccgagatctgctcctccttcccgaccactggttctctgtatttctgggctgctcatttggctggtccagtctggggtcccttggcatcttggtgctgtgcttggctggaggccatcggcctcattgccggaattggcacacaggcatatgcaggatcccaagtattgcaaagcatcatcctactctgcaccggcaccaacaccggcggtggctacctggcccctcgctggctgtttctggtcatgtacatcgggttgacactgatctgggccgtgctcaacacttttgctcttgaagtcatcgcgttcctcgacgtgatctccatgtggtggcaggtgatcggtggcaccgtgatcgtgatcatgctcccgctggtggccaagacgacgcagccggcgtcgtacgtgttcacccatttccagacgtcgcccgacgtgacggggatcagcagcagctcctacgccgtcgtcctgtccttcctcgtgagccagtactcgctgtacgggtacgacgcggcggcgcacctgacggaggagaccaaaggcgccgacaagaacgggcccatcgccatcctctccagcatcggcatcatctccgtcttcggctgggcgtacatcctggcgctcaccttcagcatccaggacttcagctacctgtacgacgcgagcaacgagaccgccggcgcgttcgtgccggcgcagatcctgtacgacgcgttccacgggcggtacggcagctcggcgggcgccatcgtgctgctgctcgtcatctggggatccttcttcttcggcgggctgtccatcacgacgagcgcggcgcgggtggtgtacgcgctgtcgcgggacaggggcgtgccgctgtcgtcggtgtggcgccggatccacccgcggcacaaggtgccggcgaacgcggtgtggctgtgcgcggcggtgtgcgcgctgctgggcctgcccatcctgcgcatcaacgtggtgttcacggccatcacctccatcgccaccatcgggtgggtgggcggctacgcggtgcccatcttcgcgcgcatggtgatgcgggaggacgacttccgcccggggccattctacctcggccgcgcaagcaggcccgtctgcctcgtcgccttcctgtggatctgctacacctgctccgtgttcctgctccccacagtgtacccgatcaagatggacaccttcaactacgcgcccatcgcgctcggcgtcgtcctcggcctcatcatgctctggtggctgctcgacgcgcgcaagtggttcaagggccccgtcaggaacatcgacgaacacaacaacggcagcaaggtctgacacaccaccaacgtcgtcgtcgtcaagctcaagcaaagcctcgagccactcacgccatcctctctttttgaacaccatgggtgctgatgaacaccatgctctctccgtctgtgtgtatgatgctggatcagtggggtttagttagtttagattgtggagtgagacctctgggtgacatacaaggaaactagaggttgacccattgtggagaacagaggaaaaattgagcaaacagaaaaggaatatgaatgaccaacaaagtacaagcattggggacactgatgtatgctccctgtgtaactatgttattttaggcttgttctaagacaaacttcccaaacaatttaattttgatcaagtttttag

SEQ ID NO: 392 - DNA, 1644 bp, Glycine max
atggattcagcagagaagaggctcaatgagcttggttacaagcaagaactgagaagagaaatgactttgtttaagactctggcaatatcattttccacaatgacccttttcactggaattacacctctctatggttctagtcttcaatatgcaggccctgcaactcttgtttgggggtggatagtggtttctttcttcacttggtttgttgggattgcaatggctgagatatgctcatccttcccgacgactggttctctgtacttttgggctgcccatttagctggtccaaaatggggaccattttcttcatggtgctgtgcttggcttgagaccatagggcttatagctgggatagggactcaggcatatgcaggttcacaaacgttgcagagtataatcctactctcaactggcacaaataaaggtggaggatacttcgctccaaaatggctattcttatgtatgtatattggcctcactgttatatgggcagcactaaacacatttgcattggaagtgattgctttgatcgatatagtttcaatatggtggcaggttattggtggaattgtgatagtcataatgttacctctggtagcactgactacaaaatctgcttcatttgtattcacacacttagaattggcccctgaatcaacaggagtatcaagcaaaccatatgcagtcattctatcatttcttgtcagccagtattctctctatggctatgatgctgcagcacatttaactgaagaaaccaaaggtgcagacaagaacgggcctattgcaatactaggtagtattgggatcattacagtatttggatgggcttacatcttggcacttacattcagcattcaggattttggttacctttatgatccaaacaatgagactgctggagcatttgttccagcacaaatactctatgatgcattccatgggagatatcacaattctgctggagcaatcattctactatttgtcatttggggttcattcttttttggtgggctttcaattactacaagtgctgccagagtggtttatgctttgtctagagacaagggagttcctttttcacacttatggcggcaactgcacccaaagtacaaggttccttcaaatgcagtgtggctctgtgctgcaatctgcattcttcttggtctcccaattttgaaggtcaatgtagtcttcactgcaataacttcaatatgtactattggatgggttggtggttatgcagttcctatctttgcaaggcttgtgatgtctgagaagaacttcaagcccgggccattttatttaggcaaagcaagaagaccagtctgtctggtggcattcctatggatttgttacacatgttctgtattccttttgccaactctgtacccaattacttgggatactttcaattatgcaccagttgctttgggggtaggtttgggtctaataatgctttggtggcttttagatgctagaaaatggttcacagggccagttaggaatattgatattcaaaatggcaaagtctaacttttataagtttaaagaaggaataattggtggaatatcatttatctttttttcctgtgttgatctgacttcaatgttctattctatggtgaacaatattgttgg

SEQ ID NO: 393 - DNA, 546 bp, Populus trichocarpa
tacttgtgctctgcattgaagaaatggcaactccaatgaagaacatttgctttgttatgtttcttgcaactcttagcattgctttgttcaatcaagttgacggggctggtgaatgtgggaaaaccactactcctgacaaagaggcattcaagctggctccttgtgcatcagcagcacaggatgagaatgcttcagtttctagccaatgttgcgcccaggttaagaaaattgaacagaatccagcctgcctatgcgctgttatgctttcgaacacagctaagagctctggaatcgacccaaaaatcgcaatgacaattcccaaacgttgcaacattgctgatcgtcctgtgggttacaagtgtggagcttacactttaccctgaagaatgaatagcatgaacagcgctccccctgtaatgtacttctaccaacctgctggagttcacatccttgttgctagttcttctagctaccaaatttaatgtaacatccagacatctgaataataaataaactgttggtgtttaatctcctttggaccgatca

SEQ ID NO: 394 - DNA, 792 bp, Ricinus communis
atggcgaaaatcgctttaggaactcgccgagaggccacccagtctgactgcatcaaagcccttattgtcgagtttatcactaccttcctctttgtcttcgctggagtagggtctgccatggctgctaataaattattgggagattctcttgtgggtttgtttttcgtggctatggcacatacactagttgtggctgtgatgatatcagccggccacatttctggtggtcatctcaacccagctgtcactcttggcctccttgccggtgggcacatcaccgttgtccgatccatcctttactggattgatcaattgctagcatcttcagctgcttgtttccttctcaattatctcacaggaggaatggcaactccagtacatactctggcaagtggggtgggatatgttcaaggcatagtgtgggagattgtactgacattctccttactgttcaccgtatatgccacgattgttgaccccaagaaaggttccattgatgggctgggtccaacactgactgggttcgtagttggggctaatatcttagccggcggaccattctccggagcctctatgaacccggcaagatcttttggaccggctttggtgagctgggactggactgatcactgggtttactgggttggaccccttattggtggtgggctggctggatttatctatgagaatttcttcatcataagatctcatcgtcctcttccaaatgatgaagaaaactactaaactagtagcatctagttgtacttgtactttgcccactcttttttatct

SEQ ID NO: 395 - DNA, 1104 bp, Castanea mollissima
cgctgacttatgaatttatagccttgtcaatgcactagcaaagccaaaccaaagttaatagcttttcagtcttgagcttagggggtcccgataccaaatttcctcactgaaagggtgtttgatctccaggaaattatggcgaaaattgccttgggaaccaggcgagaggccacacagcccgactgcatcaaggcccttgttgtcgagttcattacaaccttccttttcgtctttgcaggagttgcatcggccatgactgccgataagctagcgggaggttcactggtgggcttgtttgctgtggctatagcacatgcactggttgtggcagtgatgatctctgctggtcacatatctggtggtcatcttaacccagccgtcactcttggcctcctagccggtggtcacatcactgtcttccggtccattctctattggattgatcagttattagcatctgcagctgcttgttttcttcttcagtaccttactgggggattgagtactccaatacatacactagccagtggagtgggctacttacaaggggttatatgggaggttgttctaacattctccttgttgttcactgtctatgctacaattgtggacccaaagaaggggcccaatggtttaggccctattattactggatttgtagtgggggccaacatcttagctggtggagctttctctggggcttcaatgaacccagctcgatcctttggtcctgctttggtgagctgggactggactgatcactgggtttactgggttgggccacttattggtggtgggcttgccggttttatttatgaaaatttcttcatcatcagatctcatgtccccattcccactgaggaagaaggttactaattgtccacagtgttgtactctctaggtactaaaaacttctacttagctgtgtttcctgtaatgcttcctgtggatacttttctcagatgtatttaaatctttctatttttctgtcttatctagttttcatcatcaacatcaatttggtgcaaatgcttgtattaaaatcttttgtgcaggtagttttttttatagaaatatcaatggtcaaatctagtcaagctaacc

SEQ ID NO: 396 - DNA, 1221 bp, Citrus sinensis
agatagctgaacattcgttctaggcaattaatcgcmgattagatacttatagtctccgattaatcgtccggcgatcatggcaaaaatagccctagggagccaccragaggccacgcagcccgactgcattaaggccctcgtcgttgagttcatcaccaccttcctttttgttttcgtcggagttggatctgccatggctgcagataagcttgtgggaaatgctctagtgggactgttctttgtggccgtggctcatgcttttgtggtggccgtcatgatctccgccggccacatttccggtggtcaccttaacccggcggttactcttggcctccttttcggtggccacatcaccttcttccgatccgtcctttattggattgatcaattgttagcttcttcagcagcttgttttctcctcagttatctcactggtggattgagtacaccagtccacactctggctagcggcgtaggctattttcaagggatcatatgggagattattctgacattctccttgctatttaccgtctatgccactatcgtggaccccaagaagggatcaattgatgggcttggcccattgcttactgggtttgtggtgggggcaaacatcttggctggtggacctttctccggggcctcaatgaacccggcacgatccttcggaccggctttggtcagcggagactggaccgatcattgggtttactgggttgggcctctcattggaggtgggcttgctggcttcatttatgaacatttcttcatcgtcaggtctcatgttcccattccgtacgaggaagccagattttaattaactaaccgaatccaatggcgtgatggaccatggtgttatctgtgggtcactattttgttaaattaagtgaatgatgtaccacgtgtgtcttatgtgtatgaatmctgtaatattacaagctgctgtttctctcttgatgtacttttagtctcggtgcaggtcttgttaattgatccgagaacttttttggctgctgtcattttggctgctctgttctaattttgtgataatctccctctccccaaaattggaataaaagaattttttttgattttttaaaaccccgtttggggaggggggagagggaattgggcggccaaaacccgtttatatagggggttgtgggaaaccttgttatggggggtttttgaaaattttaaaaaatttttttttttttt

SEQ ID NO: 397 - DNA, 925 bp, Vigna unguiculata
gtgatggcgaaaatcgctcttggaagcagcagagaggccactcagccagattgcattcaagccctcgtcgttgaattcatcgccaccttcctcttcgtctttgttggcgttgcttcttccatgctcactgagaagcttggtggggatgcactagtgggattgtttgttgtggccgtggcacatgcactggtggtggccgtcatgatctccgccgcacacatctccggtggccacctgaaccccgccgtgactatcggtctcctcgccggtggccacatcaccgtgttccgttccatcctgtattggattgatcagttagtggcatctgcagcagcttcttatctcctttacttcctctccgggggacagaaaactccggttcatacgctggccgccggagttgggtacggtcaaggggtaatttgggagattgtgttgaccttttctttgctgttcactgtctacgccaccatggtagatccaaagaagggaccacttgctgggcttggccccactctagttgggtttgtggtgggggccaacatcctcgctggtggggcttactccgccgcttccatgaacccagcacggtcttttgggcctgccttggttacaggcgactggaccgatcattgggtttactgggttgggcctctcgttggtggtgggcttgccggtttcatctatgaaactttcttcattgatcgatctcacgctcctcttcctcgtgatgaagaattctaatcagtaggactgtcagcttccgctttgctttcttcatcctgattatcaaacagtctttttttgtgtgtgtttatttgcatttaaatttaaaagttctctttattagtttcctttttgttcagctcttttgtaatgtatttcccaaaataagatcagcaatttagttaaaaaagaaaaaaaa

SEQ ID NO: 398 - DNA, 968 bp, Medicago truncatula
tcacacattgcaaatcagaaaccatggccaaaattgcgttaggaacaacccgagaggctactcaaccagattgcattcaggctctaattgttgaattcattgccacctttctctttgtctttgctggtgttggttctgcaatgactgctgataagctaagtggagatgccttagtgggtttgttttttgtggctattgcacatgctcttgtggtggctgtaatgatctctgctgctcatatttccggtggccatttgaatcccgccgtgactttgggcctccttgtcggaggccacatcactatcgttcgttcgatcctatattggattgaccaattgatagcatctgcagctgcttgttatcttcttcattatctctctggtggattgacaactccagctcatacacttgcaagtggagtagggtacactcaaggagtagtttgggagattgtgttgacattctctttgttgttcactgtgtatgcaaccatggttgacccaaagaaaggagcacttgctggccttggcccaaccttagttgggtttgtggtgggggcaaacatccttgctggtggggctttttcggcagcttcaatgaacccggcaagatcttttgggcctgctttggttagtggaaattggacagatcattgggtttattgggttggaccacttattggtggtgggcttgctggtttcatttatgagaatttcttcattaatagagatcatgttcctctagctgtagatgaagaaagctactaagaattaagattaggtttttccttgggaactttgcataaaatttgtgttactgtgctttaatgtacaagtgctttatttttgtgcttggtagagaaataaaatatgatttctagtattatatttgtgtgtagaataacatgtcaatactaataaagacttatcaatactagttgactaagagcaactttagttcatgatgat

SEQ ID NO: 399 - DNA, 889 bp, Arachis hypogaea
  misc_feature (1)..(1): n is a, c, g, or t
  misc_feature (711)..(711): n is a, c, g, or t
  misc_feature (882)..(882): n is a, c, g, or t
ngggatcggcattacggccgggacatcattcatcataaaacaaattaaaaatcacatattcagaaccaagaaggcatggccaacaagatcgctcttggaaccaccagagaggccacccagccagattgcattcaggccctcgtggtggagttcataaccaccttcctctttgtcttcgtcggcgttggttccgccatggccgctgacaagctgagtggagatgcgctggtgggcttgtttgccgtggccgtggcacatgcacttgtggtggctgtcatgatttcagccggtcatatctccggcggccacctcaaccctgccgtgacccttgggctgctggtcggcggacacatcacggtggtccgatcggtcctttattggatagatcagttggtggcatctgcagcagcttcttaccttctttactacctttccggaggactggcaactccggttcacactctagcaagtggagttgggtacactcaaggggtgatttgggaaatagtgttgactttctcgttgttgtttgctgtctatgcaactatggtggacccaaagaaaggagctctcgctggacatgggcccacacttgttgggttcgttgttggggccaacattctcgctggtggggccttctctgcggcctcaatgaacccagcaagatcttttgggcctgcattggtcgctggtaactggactgatcactgngttttattgggttggggcctctcaattggtggaggcccttgcaggtttcatctatgagcattttttcattgaccgtacccatgttctgatccctcgtgatgaagaaactaatatgaaaattgtatttttggatttcacttgcactttccttttacttgcttctatatctanaaagggg

SEQ ID NO: 400 - DNA, 967 bp, Glycine max
ggaggacagcatgtgcagtactagcaagcatgcaatgcattcagatgactggcacatgagaggatatgggaagcaagtaattgagcagagtagccatggccagaatcgcacttggaagcacccgagaggccactcagccagactgcattcaggccctcatcgttgaattcatagccaccttcctctttgtctttgttggcgttgcttcttccatggtcgttgacaagcttggtggggatgcactagtgggattgtttgctgtggccgtggcacatgcacttgtggtggctgtaatgatctccgccgcccacatttctggtggccacctcaaccccgccgtcacccttggcctccttgccggtggtcacatcaccatctttcgttccctgctctattggattgatcaattagtagcagctgcagctgcttcttatctcctttactacctctctggaggacaggcaactccagttcatacgctggccagtggtgtgggatatggtcaaggagtagtttgggagattgtgttgacgttttctttgttattcactgtgtatgcgaccatggtggatcccaagaagggagcacttgctgggcttgggcccacactggttgggtttgtagtgggggccaacatcctcgctggtggggcttactccgctgcttctatgaaccccgcaagatcttttgggcctgctttggttactggcaactggactgatcattgggtttactgggttgggcctctcattggtggtggccttgctggtttcatctatgagactttcttcattgaccgatctcatgttccacttcctcgtgatgaagaaagctaaacaatatgattggcaacttgcactttcttcattggccttgctgtattttcctacttaagttaataaaataacaatatttcttttgtgtgttgtgcatgtttgaaaaggtttatttatatataaccattgtt

SEQ ID NO: 401 - DNA, 1433 bp, Hordeum vulgare
ctcagttccaaaataaaaagaagccccgcacctcctcctcctcgccaacacgccaagcgaccaaatcgccgccgcagacgcagccgcctagggcttcgccgccgtcgcagatccctccttccgcctgctgctgcgggtcctccgtgttcgtgactgctgtgtcggcgccgagataaattttcctgccgtcactcagattttgtgagtgttcgatatgggtggaagcaactatgatgacgactgggtgttgcccagtgctgacatcactcttgttcttgttggaaaacttggctatggcaagagtgcaactggcaatagtatccttggacgggaagcatttgtatcagaatactctcatgctagtgtgacaaatacttgtcagatgggaagcaccatgctgacggatggccgcaccatcaatgttattgatacaccaggattatttgacatgaccgtaacccctgaggatgctggcaaagaaattgttaagtgcatgaacatggctaaagatgggatacatgctgtgttgatggttttttctgctacatctcgattttctcgagaagattctagtacaattgagaccattaaagtgttttttggagaaaaaatcgttgatcacttggtcttagttttcacttatggagatttagttggtgaaaatttattgaagaacatgttaagtaatgccccagagtatctacagaaagttgttcagctctgcaaaaacagagtggttcttttcgataacaagaccaaggaccctaggattcaagctaagcagctcgaaacgttgcttgatgtggttgattctgttagtgcaaataatggaggaaacccatttacagatcaaatgctcactcgccttaaggaggtgcatgatagagaaatggaggttcatgatgctatgggatattcagaggaccagataactgaattgaagaaggagatccacagaactcgggatgaacagcttgcaaacattactgccatggtggaggaaaagctgaatatcacggtggagaagctgcaagttcagctcatggaagaacagaatgcaaggctagaagcagagagggtggcggcagaggccagggtgaaatccgacgaggagatccgcaagctcaaggagaggctcgagagggcccaggaggaaaacgaggagttccggaggctggcggcgaccaacaagtgcgctattctgtaaacagctctcccctgggaaaaagttaccggatgtcttgttaatagggagggggtgaacttgagccagtctagtagtaacagataatactttggttgcatcgtctcgtatattagtagatgtgtagaacttgaatgcctggggagtcgggtaactatatattagctacagttatacttggttgcaatcgtctcgtatatcagtatcatctggcgatcttttttggttt

SEQ ID NO: 402 - DNA, 1062 bp, Brachypodium distachyon
caacttccgcaatgggtggaagcaactacgacgatgactgggtgttgcccagtgctgacatcactgtagttcttgttgggaaacttggctatggcaagagtgcaactggcaatagtatccttggacgggaagcatttgtatcagaatactcccatgctagtgtgactaatacttgtcagatgggaagcaccatgctgaaagatggccgcacaatcaatgtaattgatacaccaggattatttgacatgagcgtaacacctgaagatgctggcaaagaaattgtgaagtgtatgaacatggctaaagatgggatacatgcagtgttgatggttttttctgctacatctcgattttctcgagaagattctagtacaattgagactattaaggtgttttttggagagaaaattgttgatcatttgatcttggttttcacttacggagatttagttggtgaaaatttgttgaagaacatgctcagtaatgccccagaatatctgcagaaagttgttgagctatgcaaaaacagagttgttctttttgataacaagaccaaggatcaaaggattcaagctaagcagctcgaaatgttgcttgatgtggttgattctgttagtgcaaataatggaggaaaaccattttcagatcaaatgctcactcgcatcaaggaggtgcatgagagagaaaaggaggttcatgatgtcatgggatatacagaagagcagatatctgaactaaagaaggagatccatagaacccgggatgaacaacttgcaagcattaccgctatggtggaggataagctgaactgcactgtggagaagctgcaaaaccaacttatggaagaacaaaatgcaagattagaagcagagagggtggcgttagaggccagggtgagatcagatgaggagatacgcaagctcaaggagagcctgaaggaggcccagcgggaaaacgaggaattccggaggctggctcacaacaacaagtgcactattctgtaagcagtttcccattcggaaagttgttggttgcgtgctgatgcttttacgcattggtaac

SEQ ID NO: 403 - DNA, 1422 bp, Leymus cinereus x Leymus triticoides
agcctcctatctcctcctcgcgaacacgccgagtgaccaaatcgcmgccgcagccgcctagggcttcaccgccgtcgcagatccctccttccggttgctgcwgcgtccgtctgccgcgggtcctccgtgttcgtgactgctgtgtcggcgccgagagaaattttcctgccgtcagattttgtgagtgttcgatatgggtggaagcaactatgatgacgactgggtgttgcccagtgctgacatcactcttgttcttgttggaaaacttggctatggcaagagtgcaactggcaatagtatccttgggcgggaagcatttgtatcagaatactctcatactagtgtgacaaatacttgtcagatgggaagcaccatgctgggggatggccgcaccatcaatgttattgatacaccaggattatttgacatgaccgtaacacctgaggatgctggcaaagaaattgttaagtgcatgaacatggctaaggatgggatacatgctgtgttgatggttttttctgctacatctcgattctctcgagaagattctagtacaattgagactattaaagtgttttttggagagaaaatcgttgatcacttggtcttagttttcacttatggagatttagttggtgaaaatttattgaagaacatgttaagtaatgccccagagtatctgcagaaagttgttcagctatgcaaaaatagagtggttctttttgataacaagaccaaggaccctaggattcaagctaagcagctcgaaacgttgcttgatgtggttgattctgttagtgcaaataatggaggaaacccatttacagatcaaatgctcactcgccttaaggaggtgcatgatagagaaaaggaggttcatgatgctatgggatattcagaggaccagatatctgaattgaagaaggagatccacagaactcgggatgaacagcttgcaaacattactgccatggtggaggaaaagctgaatatcacggtggagaagctgcaagttcaacttatggaagaacagaatgcaaggctagaagcagagagggtggcggcggaggccaggctgaaatctgacgaggagatccgcaagctcaaggagaggctcgagagggctcaggaggaaaacgaggagttccggaggctggcggcgacgaacaagtgcgctattctgtaaacagttgtctcttgggaaaagttatcggatgctttgttaataggagggcgctgatgaacttaagtccgtctagtagtaaacagatatacctggttgcatcgtstcgtatattagaacttgawwrccctgkkgagtcggataactatayattagygasakatmtctactcctaaaaggggagtccgtacgtcgttcgttagtacccagcctgcctctagcgatcccataaaagaaaa

SEQ ID NO: 404 - DNA, 1300 bp, Pseudoroegneria spicata
ccggttgctgctgcgtccgtctgctgcgggtcctccgtgttcgtgattgctgtgtcggcgccgacagaaactttcctgccgtcagattttgtgagcgttcgatatgggtggaagcaactatgatgatgactgggtgttgcccagtgctgacatcactcttgttcttgttggaaaacttggctatggcaagagtgcaactggcaatagtatccttggacgggaagcatttgtatcagaatactctcatgccagtgtgacaaacacttgtcagatgggaagcaccatgctgacggatggccgcacaatcaatgttattgatacaccaggattatttgacatgaccgtaacccctgaggatgctggcaaagaaattgttaagtgcatgaacatggctaaagatgggatacatgctgtgttgatggttttttctgctacatctcgattttctcgagaagattctagtacaattgagactatcaaagtgttttttggagagaaaatcgttgatcacttggtcttagttttcacttatggagatttagttggtgaaaatttattgaagaacatgttaagtaatgccccagagtatctgcagaaagttgttcagctatgcaaaaatagagtggttctttttgataacaagaccaaggaccctaggattcgaactaagcagctcgaaacgttgcttgatgtggttgattctgttagtgcaaataatggaggaaacccatttacagatcaaatgctcactcgccttaaggaggtgcatgatagagagaaggaggttcatgatgctctgggatattcagaggaccaaatatctgaactgaagaaggagatccacagaactcgggatgaacagcttgcaaacattactgccatggtggaggaaaagctgaatatcacggtggagaagctgcaagttcaactcatggaagaacagaatgcaaggctagaagcagagagggtggcggcggaggccaggctgaaatccgacgaggagatccgcaagctcaaggagaggctcgagaaggctcaggaggaaaacgaggagttccggaggttggcggcgacgaacaagtgcgctattctgtaaacagttgtctcttgggaaaagttatcggatgctttgttaataggagggtggtgaactcaagtctgtctagtagtgacagatatacttggttgcttcgtctcgtatattagtagaacttgaatgcctggggagtcggagaactatatattagtggcagttatacttggttgcaatcgtctcatatattagtagtacttgcgagta

SEQ ID NO: 405 - DNA, 1513 bp, Saccharum officinarum
  misc_feature (1295)..(1297): n is a, c, g, or t
  misc_feature (1307)..(1307): n is a, c, g, or t
  misc_feature (1357)..(1357): n is a, c, g, or t
cctttttgcaccgggagataaaccgaccgcacccctgaccgcgacccgcagctgctcgctcctacttctctcgcccgccgcgcagcgccgccggttcttcgcgagcaattcttgtaaagcattgtcatcaccacttgtaatgggtggaagccagtatgatgatgagtgggtgttgcccagtgccgatatcactcttgttcttgttgggaaacttggctatggcaagagtgcaactggaaatagcatccttggacgggaagcatttgtatcagaatattcacatgccagtgttactaatacttgtcagttgggaagcactaccctgaaggacggccgcaccatcaatgttattgatacaccagggttatttgatatgagcattacatctgatgatgctggtaaagagattgttaaatgtatgaacatggctaaagatgggatacatgcagttctgatggttttttctgccacatctcggttttctcgagaggatgcaagtacaattgagaccattaaggtcttctttggggaaaagatcgtggaccacatgattttagtttttacttatggagatctagttggtgaatctaagttgaagaacatgctaaataatgcgccagagtatttgcagaatgttgttgagctatgccaaaacagagttgtcgtcttcgataacatgaccaatgaccgaaggctccaagcgcagcaacttgacaaattgcttgatgtagtggactcagtttgcgcaaacaatggaggaaaaccattttcagatcaaatgttcactcgcatcaaggaggtgcatgatagagaaaaagaggtgcataccttggggtattcagaagagcagatatctgagttgaagaaggagattcatagaactagggatgaacagcttgcacacataaccagcatggtcgaggaaaagttaaactgcactgtggagaagctgcaacagcaactcatggaagaacagaacgcaaggctggaagctgagaaggtggcgtatgaagctaggctgaactcagaagcggagatccagaagctcaaggagagcctcaagaaggctcaaatggaaaacgaggagttccgkaggatggcgcagagccagggcagcaaatgtgctatcctataggcagtagtagtacttgccagaagtttcggtggggctatcgtgctgacgcgtctcttatctgtagtagtaacttgaattttaacagtttattatgcgacaactgttaattagtcactggtattcgaatcttttcttcaatatattatcgttgtgcttcccnnnaaaaaaaaanaaaaaaaaaaaaaacaaaaaaaaaaaaaaaaaaaaaaaaaaaaaaaaaanaccggccccttgggtccacccggaaattccggaacgggtacctggaggggtaccacctttccccattagtgggtccttataaaagcttggggtaaacatggggcaaaccggttcccggggtgaaaattgttattccccccccaattcccccacaaa

SEQ ID NO: 406 - DNA, 1455 bp, Triticum aestivum
aaaaagaagccccgcagcctcctcctatctccccctcgcgcacacgccaagcgaccgaatcgccgccgcagccgcctagggcttcgccgccgtcgcagatccctccttccggccgtctgctgcgggtcctccgtgttcgtggctgctgtstcggcgccgacagaaatttccctgccgtcaggttttgggagtgttcgttaccaacttctgcaatgggtggaagcaactatgatgatgactgggtgttgcccagtgctgacatcactcttgttcttgttggaaaacttggctatggcaagagtgcaactggcaatagtatacttggacgggaagcatttgtatcagaatactctcatgccagtgtgacaaacacttgtcagatgggaagcaccatgctgacggatggccgcaccatcaatgttattgatacaccaggattatttgacatgaccgtaacccctgaggatgctggcaaagaaattgtkaagtgcatgaacatggctaaagatgggatacatgctgtgttgatggttttttctgctacatctcgattttctcgagaagattctagtacaattgagactatcaaagtgtttttttggagagaaaatcgttgatcacttggtcttagttttcacttatggagayttagttggtgaaaatttattgaagaacatgttaagtaatgccccagagtatctccagaaagttgttcagctatgcaaaaatagagtggttctttttgataacaagaccaaggaccctaggattcgaactaagcagctcgaaacgttgcttgatgtggttgattctgttagtgcaaataatggaggaaacccatttacagatcagatgctcactcgcctcaaggaggtgcatgatagagagaaggaggttcatgatgctctgggatattcagaggaccaaatatctgaattgaagaaggagatccacagaactcgggatgaacagcttgcaaacattactgccatggtggaggaaaagctgaatatcacggtggagaagctgcaagtccaactcatggaagaacagaatgcaaggctggaagcagagagggtggcggcggaggccaggctgaaatccgacgaggagatctgcaagctcaaggagaggctcgagaaggctcaggaggagaatgaggagttccggaggctggcggcgacgaacaagtgcgccattctgtaaacagttgtctcttgggaagagttgtcggatgtcttgttaataggagggggtgaacttaagtctgtctagtagcaacagatatactgtacttggttgcgtcgtctcgtatattggtagaagttgaatgcctggggagtcaaaggataactatatgttagtgacagttatacttgtcgtctcatattagtagcacttgcgacttgcgagtatcatctggcmatcttttttggttttgtttcaaaaaaaaaa

SEQ ID NO: 407 - DNA, 1443 bp, Triticum aestivum
gccccgcagcctcctcctatctcctcctcgcgcacacgccaagcgaccgaatcgccgccgcagccgcctagggcttcaccgccgtcgcagatccctacttccggctgcttctgcggccgtctgctgcgggtcctccgtgctcgtgactgctgtgtcggcgccgacagaagtttccctgccgtcagattttgtgagtgttcgttaccaacttctgcaatgggtggaagcaactatgatgacgactgggtgttgcccagtgctgacatcactcttgtccttgttggaaaacttggctatggcaagagtgcaactggcaatagtatccttgggcgggaagcatttgtatcagaatactctcatgctagtgtgacaaatacttgtcagatgggaagcaccatgttgacggatggccgcaccatcaatgttattgatacaccaggattattcgacatgaccgtgacccctgaggatgctggcaaagaaattgttaagtgcatgaacatggctaaagatgggatacatgctgtgttgatggttttttctgctacttctcgattttctcgagaagattctagtacaattgagactattaaagtgttttttggagagaaaatcgttgatcacctggtcttagttttcacttacggagatttagttggtgaaaatttgttgaagaacatgttaagcaatgccccagagtatctgcagaaagttgttcagctatgcaaaaatagagtggttctttttgataacaagaccaaggaccctaggattcgaactaagcagctcgaaacgttgcttgatgtggttgattctgttagtgcaaataatggaggaaacccatttacagatcaaatgctcactcgccttaaggaggtgcatgatagagagaaggaggttcatgatgctctcggatattcagaggaccaaatatctgaattgaagaaggagatccacagaactcgggatgaacagcttgcaaacattactgccatggtggaggaaaagctgaatatcacggtggagaagctgcaagttcaactcatggaagaacagaatgcaaggctggaagcagagagggtggcggcggaggccaggctgaaatccgacgaggagatccgcaagctcaaggagaggctcgagaaggctcaggaggaaaacgaggagttccggaggctggcggcgaacaagtgcgccattctgtaaacagtagtctcttgggaaagagttgtcggatgtcttgttaataggagggggtgaacttaagtctgtctagtagcaacagatatactgtacttggttgcatcgtctcgtatattggtagaacttgaatgcttggggagtcggataactatatgttagtgacagttatacttgtcgtctcatatattagtagcccttgcgacttgcgagtatcatctggccatcttttttggttttgtt

SEQ ID NO: 408 - DNA, 998 bp, Antirrhinum majus
tcgaattcggcacgagtttttctctctctaagactacttcacagttcacatccatttaagcgttgtttctcagtttttttcatctcattyctctctgctgctttctcgctctatatctayataaaacatatarttgacacacgtacatatacaaaggcttattcctagggtttatcgtagagagagaaagagacaaaaaaaaaatgggacagcaatcgttgatctacagcttcgtggcgcgtggaacggtgatccttgcggagtacacagagttcaccggtaatttcaacggaatcgccgctcagtgtcttcagaaacttccggcgacgaacaacaagttcacctacaactgcgatggtcacacctttaattacctcgtcgaggacggattcacttattgtgttgtygctgttgaatctgttggaaggcagattccgattgcgtttctcgagcgaactaaggacgattttactaagaaatatggtggaggaaaggctgctactgctgttgccaacagcctgaacaaagagtttgggcccaaactgaaggagcaaatgcaatactgtgtggatcatcctgaggaggtcagcaagattgctaaggtgaaagctcaggttacagaggtcaaaggggtgatgatggaaaacattgaaaaggttctggatcgtggagagaaaattgagcttctagtggataaaactgagaatcttcgatctcaggcgcaagatttcaggacacaaggaaccaagatgaggagaaggatgtggttgcagaacatgaaagtaaagctaatcgtccttgccatcattatcgctttgatccttatcatagttttgtcagtctgtggtggattcaattgttagtgtgtaccttcagaaaacctttcctcattatcagtctgatggatttgattttcattaatttgtatttgcataggctgtccttgtagactctcgtgttctttgccgtttgaagcattttttacccaaaaaaaaaaa

SEQ ID NO: 409 - DNA, 734 bp, Antirrhinum majus
aggttcaggtagagagagatggggcagcagtcgttgatctacgccttcgtggcgcgtgggacggtgatcctcgcggagtacaccgaattcaccggaaacttcaccggaatcgccgctcagtgcctccaaaaacttccggcgacgaacaacaagttcacctacaactgcgatggccacaccttcaactatctcgttgaagacggattcacatattgtgtagtggctgtggaatctgttggaagacagcttcctatcgcatttcttgagcgagttaaggaggattttagcaaaaaatatggtggaggaaaggctgctacagctgttgccagcagcttgaataaagagtttgggccgaaactgaaggagcaaatgcagtactgtgtggatcatccagaggagatcagcaaacttgctaaggtgaaagctcaggttacagaagtgaaaggggtgatgatggaaaacattgaaaaggtccttgatcgtggagagaaaattgagcttttagtggataaaactgagaatctccgctctcaggcacaagatttcaggacacaaggaacccagatgaggagaaaaatgtggctgcagaatatgaagataaagcttattgttcttgccattatcattgccctgatccttatcatagttttatctgtctgtggtggattcaaatgtcattagtgtgtgtttgcatgtgtggttgttttagacacttgtgttgtttcatcatatga

SEQ ID NO: 410 - DNA, 1080 bp, Malus domestica
agagagagagagacaaaaagggcgcttcacgcatcaaaacccaaaaaatccaacccaacccccaaaaattcgaaagaaaaaagcataaaaattacggaatcgctgtgcggctctctgaaacgagaacaagaacgcacagcggtaggcagagagcagaaggttggagcaaaaaatggggcagaaggcgctgatctacgcgttcgtggcgcgcggcactgtggttctcgccgagtacacggaattcagcggcaatttcaactccattgcgtttcagtgcctccagaagcttcctgctaccaacaacaagttcacctacaactgcgatggccacaccttcaattacctcgtcgacaatggctacacatactgtgtggttgcagatgaatcgagtggaagacaagtacctatygcttttctggagcgtgtcaaggatgactttgtygcraaatatggtgctggaaaggctgctacagctgctgccaacagccttaacaaggaatttgggtcaaaattgaaggaacatatgcaatactgtgttgatcatcctgaagaaataagcaagcttgcaaaggtgaaggcccaggtttcagaagttaaaggcgttatgatggagaatattgaaaaggttttggataggggggaaaagattgagcttttagtcgacaagactgagaaccttcatcaacaggcacaggattttcggactgtggggactaaaatgcggaggaagatgtggctgcagaacatgaaggtgaagctgattgttttaggaatcctgatcgccttaatccttatcataatactctccatttgccatggtttcaactgcggaaaatgagccctttgctgttgtcaagaaaatcatttggcctcgtcagtccaaacttctgcaattatattgccgtaattgttaagagaaagatcatatatctgttgcaactctgtacttagttaaaagtagtgatattcggacgtgtcatgaggcggaagatgtattttttgtgtgaaagaaactccctatatgatgctactactactactttggyataagaartgagtgcgttgcctaaaaaaaaaaaa

SEQ ID NO: 411 - DNA, 1076 bp, Malus domestica
actttgcttctttctcagcaacaaaaataaccctcagaacctccgccctctctctctctaatccgcaaccgaaatctccacctctctatcctagctttagggttcggggatcgaatcgatggggcagcaatcgttgatctacagcttcgtagcgcgcggcacggtggtcctcgcagagtacacggaattcaccggaaacttcaccagcatagcctcccagtgcctccagaaacttccggccaccaacaacaagttcacctacaactgcgacggccacaccttcaactacctcgtcgataatggcttcacatattgtgtagtcgcagttgaggcggttggtcgacaagttcctattgccttccttgagcggatcaaggaggattttactggtagatatggtgggggaaaagctgcaacagcagttgcaaatagcctgaacaaggaatttgggtccaaactgaaggagcacatgcaatactgtgtggatcatcccgaagagatcagcaagcttgcaaaagtgaaagctcaggtttccgaagtcaagggagttatgatggaaaatattgagaaggttcttgatcgtggggagaagattgagcttctggtggataaaacagagaacctccgctcacaggcacaagatttcaggcagcaggggacccagatgaggaggaagatgtggttgcagaacatgaaggtgaagctgatagttttgggaatcttaatcgcattgattctcatcatcgttctatccgtgtgcaatggcttcaaatgctgatgtgtccatagactcatactgcggactggatgacgttcgttcctcgcgctgatttctggtcgacgtataattatttttggcacatcctactttctgctatattttgcatcgtaagaccgtttgtatagcttgtattcgtgaattctttctataataggcccgctcggaagtgcgaatcgctctttgattccttttgttccgtggaacttatgttgtagcactttgtgaccgatttggcagaacaactgtgagtgtttctagatttgatattcaacaattgaaaagtgtcgaacatgtg

SEQ ID NO: 412 - DNA, 1174 bp, Malus domestica
gctgcgtggcattttcgttatttcctctaacgttggagggtaggttaacaaactcacaacgaagaccccctcgctaccgtacctagcttctcatctaagcaaaattctctctctctctctctctctctctctcatcacgataaaaccaccgcgactttggwtctctctctctctctccaataaaaaaacccccaaaccctccgctgcctctctctctccaataaaaaaacccccaaaccctccgctgcctctctctcatccgcaaccggaatcttcacttcctctctcatagggtaggcttcggggatcgaatccatggggcagcaatcgttgatctacagcttcgtggcgcgcggcacggtgatcctcgctgagtacacggaattcactggaaacttcaccagcatagcttcccagtgcctccagaaacttccggccactaacaacaagttcacctacaactgcgacggccacaccttcaactacctcgtcgataatggcttcacatattgtgtagttgcagttgaggcggttggtcgacaagttcctattgccttccttgagcgaatcaaggaggattttatcggtagatatggtggggggaaagctgcaacagcagttgcaaatagcctaaacaaggaattcgggtccaaactgaaggagcacatgcaatactgtgtggatcatcccgaggagattagcaagctttcaaaagtgaaagcacaagtctcagaagtcaaaggcgttatgatggaaaatatygaaaaggttcttgatcgtggggagaaaattgaacttctggttgataaaacagagaacctccgctcacaggcacaagattttaggcagcagggaacccagatgaggaggaagatgtggttccagaacatgaagatcaagctgatagttttgggaatcttaatcgctttgattctcatcatcgttctatccgtttgcaatggcttcaaatgctgatgtgtccgtaaactcttatcgggcacaggatggagtttgttcgtcgcgcttgtttctggtctacgtatatttattcttggttgcacatcctactttctgctataatttgtattgcaagaccgtttgtatagcttgtattcgtaaattttttcccataataggctctgtcggatgtgcgaatcgttcttgattccttttg

SEQ ID NO: 413 - DNA, 1102 bp, Malus domestica
cgaattccgttgctgtcgctttcgctctctaaaacaaaaaccagtgcgggaggacagatcatagagagagaaacaaaaggtgcgcttcacacatcaaaaacccaaaaaatccaacccctaaattcgaaacaaaaaacagcgaaaaaatcgaaacgcacagcagtaagcagagagagcggaaggttccagagaaaaatggggcagaaggcgctgatctacgcgttcgtggcgcgagggactgtggttctcgcggagtacacggaattcagcggcaatttcaactccattgccttccagtgcctccagaagcttcctgctaccaacaacaagttcacctacaactgcgatggccacaccttcaattacctcgtcgacaatggctacacatactgtgtggttgcggatgaatcaagtggacgacaagtacctatcgcatttctggagcgtgtcaaggatgactttgttgcaaaatatggcagtggaaaggctgctacggctgctgccaacagcctgaacaaggaatttgggtcwaaattgaaggagcatatgcaatactgtgttgatcatcctgaagaaataagtaagctcgcaaaggtgaaggcccaggtttcagaagttaaaggtgttatgatggagaatatcgaaaaggttttggataggggggaaaagatagagcttttagtcgataagactgagaaccttcatcaacaggcacaggactttcggactgtsgggactaaaatgcggaggaagatgtggctgcagaacatgaaggtgaagctgattgttttgggaatcctgatcgccttaatccttatcataatcatgtctgtttgccacggtttcaactgcggtaaatgagcccgttgccgttcttaagaaaatatkttcgccttgtcaccaaacttttgcaattatattgtagctttataagagaaagatcatatatctgttgcaactctgtacttagttaaaagtagtgattttcagatgtggcacgagtcggaagacgtattttttgtgcgaatggactccatatattgtgttactatgttataagaaatgagtgcgttgcttataaatgaagtgatwtttttttgca

SEQ ID NO: 414 - DNA, 1123 bp, Aquilegia formosa
cttcccgcacatttctctctctcttccacttccttagcgagaaaggaaaaaagataaacatttttttattttatcaaattctgtttatattaaatcattaatcaatcaaatctgttggttttaatttagggttagggtttgtagaatggggcaacagactctgatttacagtttcgttgcaagaggaacggtgatcctcgctgaatatacagagtttaaaggaaatttcacatcaatcgcttcacaatgccttcaaaagcttcctgcttcaaacaacagattcacctataattgcgatagtcacacatttaattatcttgttgatgatggtttcacatattgtgtagtggcagttgagtctgctggaagacaagttccgattgccttcctggagcgcattaaggatgagtttgccaagagatataaaggaggaaaagctgcaactgctgttgcaaacagcttgaacaaggagtttgggtcaaaattgaaggagcaaatgcaatattgcgtggatcatccagaggagattagcaaacttgcgaaagtgaaggctcaggtttcagaagtcaagggcgtgatgatggaaaatattgagaaggttcttgatcgtggtgagaaaattgaacttctagtggacaagacggaaaatcttcgctcacaggctcaagattttcgatcacaaggaaccaagctgagacggaaaatgtggtggcaaaacatgaagattaagttggttgttttgggtattatcattgccttgatattgattatcatcttatcggtttgccatggcttcaagtgtacttgattggaggtgcctacttccgaggctatcattatatggttgtttaggagtatcacattgatctttctctcctccctctttttytcctaacataccstttgttatcgggtttctttcctttttttttttgattaatttttcccttcattttttttctttggaawtttgtttagtatatacaatacttggtataggcatgtgtgtgtaactgcatgtgaaataccctaagattttgtggatgtgggagaagggcctcaggatcttgtgcacttgttatgttytggaaaagggtggaagaaaatattgtcagaactccta

SEQ ID NO: 415 - DNA, 1192 bp, Arabidopsis thaliana
aactttttcttctcccatgtccactttagtcctcgttttgttctttcatagtcttctagatctgtagtttttttccgcgaccgcccaaaaaattctctgatcagacggtcgattggatcggagatttaaggtaaagaaaaaatggcgcaacaatcgttgatctacagtttcgtagctcgcggcacggtgatcctcgttgagttcactgatttcaaaggtaatttcacctcaatcgctgctcagtgcctccagaagcttccgtcttcgaacaacaagttcacctacaactgcgacggtcataccttcaattaccttgtcgaagatggattcacctattgtgttgttgcggttgattctgctgggaggcaaattcccatgtcctttttggaaagagtaaaagaagattttaacaagcgatatggtggtggaaaggctgcaactgctcaagcaaacagcttgaataaggagtttggctctaaactgaaagagcatatgcagtattgcatggatcatcctgatgagattagcaagcttgctaaggtgaaggcgcaagtgtcagaagttaagggtgtaatgatggaaaacattgagaaggttcttgaccgtggtgagaaaattgagcttttggtggacaaaaccgaaaatcttcgctcacaggcacaagatttcagaacaacaggaacgcagatgagaagaaagatgtggcttcagaacatgaagataaaactcatagtgctcgccatcattatcgcactgattctcatcatcgtgctctcagtttgccatgggtttaagtgttaagcccagaaaattcaaaacttctgagatctttctcactcggtacatcgtagtgccttctcttttattgttcgatcttcaatctaatgtttctgcttgaattggttttgtatagatagacatatatgtatgctactcatttgctatattgcttgcatctgatgacattgatcccttgcgaaccagtcagtacttgacaagagatccgaaactattaaatgattttgttgactgaagattgcattgtggtggtgatgataaaaatttgagattgtattgacgattatacggcgtgatgtgtgctggttactttaaatttagataagagtagtgccctctctatatcgttactagggatggtagtacatatatatacgtacgtcatattccgacc

SEQ ID NO: 416 - DNA, 1198 bp, Arabidopsis thaliana
aaaactcaagggtttgatttttcttcttcaactacgttaagatttctcctacacttttctttttcaccgtattctcttttagtcctcgattctctacgcgtttcagcgtcaagtcttctagatctctaaagccttcgtgctcgccaatataaatctctgagatcggtcccgtaaaatcggattcgcgtcgtttttgagtaaaaaaaatggcgcaacaatcgttgatctacagtttcgtcgctcgtggtaccgttatcctcgttgagttcacagatttcaaaggcaatttcacatcaatcgctgctcagtgccttcagaagcttccttcttctaacaacaagtttacctacaactgcgatggtcacacgttcaattacctcgtcgaaaatggattcacctattgtgttgttgcagttgattctgctgggaggcagattcctatggctttcttggaacgagttaaggaggatttcaacaagagatatggtggtggaaaggctgcaactgctcaagcaaacagcttgaataaagaatttgggtcgaaactgaaagagcatatgcagtattgcatggatcatcctgatgagattagcaagcttgctaaggttaaagctcaagtgtctgaagttaaaggtgttatgatggaaaacattgagaaggttcttgaccgtggtgagaagattgagcttttggttgacaaaacagaaaaccttcgctcacaggcgcaagattttagaacacaaggaactcaaatgagaagaaagatgtggtttcagaacatgaagataaagctcattgtccttgcaattatcattgccttgattctcatcatcatcctctcaatttgtgggggattcaactgcggtaaataagtctggaacatttcttcccggcgttatcgactgcgctctgtgcttcccaagatctctgagaatatcttcattcagttcgttgtgctacctttttgttttgtttttgtttttgtgatttctatattctcatactatatgtttcttcttagattgtacttcttgaaatttgttttgtataggctatatatattatacatatatgtatgcatgttcgacaatctgcaatgttgctattgctggtactgacactaattcttgcaaaccaatatttggacgatacttgttcttggcaatttactaatttctttggtctgttgatgagactc

SEQ ID NO: 417 - DNA, 961 bp, Artemisia annua
ttccactttactctccaaaatcaaatcagatcacagatctagggcttgcttgctccaattaattaataataaaaaatggggcagcaatctttgatctacagctttgtatcacgaggaactgtaatccttgctgaatacactgaattcaccggtaatttcacttccattgcttctcagtgtctccagaagcttcctgctaccaataacaagtttacttataactgcgatggtcatacttttaattacctcgttgaagatggattcacatactgtgttgtggctgctgaatctgccggccgacaagttccaatggcatttctcgagcgaaccaaggatgactttagcaagaaatatggtggcgggaaagccaatacagctgctgcaaatagcctgaacaaagaatttggacccaagctgaaggagcagatgcagtattgtgtggaccatcctgaagaaatcagcaagctttcaaaggttaaggcacaagtttcagaagtcaaaggtgtgatgatggagaacattgaaaaggtcttggatcgtggcgagaagatagagcttcttgtggataaaacagaaaatcttcgctctcaggcacaagattttaggacacaaggtacacagatgaggaggaaaatgtggctgcagaatatgaagataaaattgatagttcttggaatcatcattgctttaattctcattatagttctctcagtctgtggcggtttcaattgtggcaagtgagagtacatatatcttgttttttcactcgtctcctagtttatttggctttcgatgtgttttggtgttactgtctgctattataaaccgtatgttgcgagactgtgtatattttgtaccttgagaccagggaaacaacttgattgcttcttggtctctaactattagtagaatgattttcgtctttcctatctacaaaaagggtgaacgatgaggttagatc

SEQ ID NO: 418 - DNA, 1026 bp, Artemisia annua
aacaaaccccctctccacctcttcaaaccactttctctctcacacactaaaaaaacacacacatatcaccatggggcaacaacaactgatctacagcttcgtagcacgcggcaccgtaatcctaacggaatacaccgagttcaccggtaacttcacttcaatcgctgctcagtgtctccagaagcttcccgctactaataacaagtttacctacaactgtgatggccatacctttaactatctcgttgaggatggattcacatactgtgttgtcgccgttgaatccgttggtagacaggttccaatggcttttcttgagcgagtcaaggaggacttcactaagaaatatggaggggggaaagctgcaacagctgttgccaatagcctgagcaaagaattcggtcccaagctgaaggagcagatgcagtactgtgtggaccatcctgaagagatcagcaagcttgcgaaggtgaaagcccaggtttcagaagttaagggcgtgatgatggaaaatatcgagaaggtccttgaccgtggagagaagatcgagcttctggttgataaaacagagaaccttcgatctcaggcacaagattttaggacgcagggcacacaaattaggaggaagatgtggttgcagaacatgaagataaagctgatagttctcgggatcatcattgcattgattctcattatagttctatcggcttgtggcggtttcaactgtggcaagtaaaagatgtctttgcttctgggatttaggatggtaaaaatctcttattcatggaaaaaaaaactcaaggtttcgtggtcccatgtttattttgtttgccgatgattttcttttgttagttactttttggggtggacacgggcctatcttttgtgatgaaaaagctttatattgtgatatagtggttgtatagcttgtaccttaagcaccattgacatcgacattttactaggaaaacaatttgattgctgttttgctattttctttaatagcgatgtttgcatatcctttcc

SEQ ID NO: 419 - DNA, 1099 bp, Persea americana
ggcaattagctgtctccatttcctttacacttcaaaaccctagaaatccctttctcttctctctctctttctctatcgctccctctctcgctgcttttgagagagagatctcagatcgctcgaacaagatcgatagagtaaaagaaagaaaaagagaatttgaaggaggagatccgcagaagaaatttagtgaaacatggggcagaaatctctgatctactcctctgtcgcacgcggcactgtaattcttgcagaatacacggaattcactgggaatttcacatcaatcgcagcgcaatgtcttgagaagctgccttccagcaacaacaagttcacttacaactgcgacggacacaccttcaactatcttgtcgatagcggctttacatactgcgttgttgcagatgaatctgttggaagacaggttcccatggcatttctggagcgcgtcaaggatgactttgtgtcaagatatggtggtggaaaggccacaactgctgtggccaacagcctcaacaaggaattcagaaataagcttaaggaacatatgcagtactgtgttgatcacccagaggagataagcaagcttgcaaaagttaaggctcaggtttcagaggttaaaggagttatgatggagaacattgaaaaggttcttgatcgaggggagaagatcgagcttttggtggacaagactgagaacctgcgttcacaggcacaagacttccgaactcaggggacacagatgcgaagaaagatgtggttccagaacatgaagatcaagttgattgtytygggaattgtgattgctttgattctyatcatagtcctctcagtttgccatgggttcaaatgtgggaactgatcatcaacaacaggggcaggaaagatctgaattacgatatcatatagaatctgtacgtgcatatatgcatagaaaagctgaagggattgcagtccctgattttaaatcagaaactagagcagtaggtatcttgctattttagtttgccgcaataccaacagattttagtgttaagtgaaaaggtggttgcatctagtatgcattagactttcatgaaacatggaatatcatcttcag

SEQ ID NO: 420 - DNA, 749 bp, Persea americana
cttttcttctcttcttccgatccgatcttcttcttcttccaaatcctcatcaaaatcaatcaaaatctagggttttagatgggacagcagtttctgatctacagcttcgtcgctcgaggaactgtaatcctcgccgaattcaccgaattcactggcaatttcaccagcatcgccgctcaatgccttcaaaagctccccgccaccaacaacaagttcacctacaactgcgattcccacaccttcaattaccttgttgaagaaggcttcacctactgtgtagttgcagttgagtctgttggcagacaacttccaattgccttcttggagcgggtcaaggatgatttcaacaagagatatggaggtggaaaagctgcgactgcagttgctaacagcctcaacagagagtttggcccgaaattgaaggagcacatgcagtactgtgtggataacccagaggaggtcagcaagcttgcaaaggtgaaggctcaggtttcagaagtcaaaggagtgatgatggaaaatattgagaaggttcttgatcgtggtgagaaaatcgagctacttgtagacaaaacagagaatcttcgctcacaggcccaagatttccggcaacaaggaacaasgatgaggaggacgatgtggtttcmaaatatgaagataaagctgatcgttttgggtatcatcattgctttgattctcattataatcttgtcggtttgccatggcttcaaatgctgataaaggaatga

SEQ ID NO: 421 - DNA, 801 bp, Brassica oleracea
gcaacaacaatcgctgatctacagcttcgtcgctcgcgggacggtgatcctcgtggagttcacagatttcaaaggcaacttcacctccgtcgctgcacagtgcctccagaagctcccctcttccaacaacaagttcacctacaactgcgacggccacaccttcaactacctcgtcgaagatggattcacstaytgtgttgttgcggttgawtctgctgggaggcagattccgatggcgtttttggagagagtgaaggaggattttaacaagagatatggtggtgggaaggctgcyactgctcargcwaacagcttgaataaagagtttgggtctaagctgaaagagcacatgcagtattgtatggatcatcctgatgagattagcaagcttgctaaggtgaaggcgcaggtgtctgaggttaagggtgttatgatggagaacatcgagaaggttcttgaccgtggtgagaaaattgagcttctggtggacaaaaccgagaaccttcgctcacaggcacaagatttcagaacaacggggacgcagatgagaagaaagatgtggcttcagaacatgaagataaaactcatagttctcgccatcattgtcgcgttgattctcattatcgtgctctcagtttgccatggcttcaagtgttaaaactctcttgtgggtacatggtacttccttttcttttattgttctatcgtcattatcattctaaatgttttccgcttgaattggtttttgtatagatagacatatatgtatgcttcatatttgctatattgcttgcacctggt

SEQ ID NO: 422 - DNA, 1143 bp, Brassica oleracea
gatgtcaaagttttttaattttcacaagttgacaaatagttttgctttttagtccttccttcaatctaagggtttctcatctttctctagttcaattccatttcttttcaccgtctctctctctttctcatttagtctctacgcgtttcagcgttaaagtcttttttctagatctcytctaccttcacgccgatataacaaaactctctgatcagtcaatagaaacccaccaatagagagagagaacacaaaaaaaaaaatggcgcagcaacaacaatcgctgatctacagtttcgtggctcgagggacggtgatcctcgtcgagttcaccgatttcaaaggcaatttcacatccatcgctgcacagtgcctccagaagcttccttcctccaacaacaagttcacctacaactgcgatggtcacaccttcaattacttggttgaaaatggattcacttattgtgttgttgcagttgattcagctgggaggcagattcctatggccttcttggagcgagttaaggaggatttcaacaagagatacggtggtgggaaggcagcaactgctcaagcgaacagcttgaataaggagtttgggtcgaaactgaaagagcacatgcagtattgtatggatcatcctgatgagattagcaagcttgctaaggtgaaagctcaagtttctgaagttaaaggtgtcatgatggaaaacattgagaaggttcttgaccgtggtgagaaaattgaacttttggtggacaaaaccgaaaaccttcgctcacaggcgcaagacttcagaacacaaggaacacaaatgagaagaaagatgtggtttcagaacatgaagataaagctcattgttcttgcaatcgtcatcgccttgatcctcatcattgtcctctcagtctgcggtggcttcractgtggcaaataagtctgggaacatttctgattcccgagaacatcctcattcagttcgttgtgctggtttttttctttttgtggtttaaaaattctcatggctatgtttcttctctgcttagatttgtacttctttaaattggttttgtataggtcatatatatatgtttgaaactgattcttgcgaaccattcacttggacctgatttgaacgcttgtgtttgc

SEQ ID NO: 423 - DNA, 1044 bp, Brassica rapa
ttgttgtttagtcttattagatctctattttctcgcgacagcaccattaaaatcctctgatcggatcgagccgaatcgaggatttagagttcgaaagaaaaaaatggcgcagcaatcgctgatctacagcttcgtcgctcgaggtacggtgatcctcgtggagttcaccgatttcaaaggcaacttcaccaccgtcgctgctcagtgcctccagaagcttccctcttccaacaacaagttcacctacaactgcgacggccacaccttcaactacctcgtagaagatggattcacttattgtgttgttgcggttgattctgctgggaggcagattccgatggcgttcttggagagagtgaaggaggattttaacaagagatatggtggtgggaaggctgctactgctcaagcaagcagcttgaataaagagtttgggtctaagctgaaggagcacatgcagtattgtatggatcatcctgatgagattagcaagcttgctaaggtgaaggcgcaggtgtctgaagttaagggtgttatgatggagaacatcgagaaggttcttgaccgtggtgagaagattgagcttctggtggacaaaaccgagaatctacgctcacaggcacaagatttcagaacaacgggaacgcagatgagaagaaagatgtggcttcagaacatgaagataaaactcatagttctcgccatcattgtcgcgttgattctcattatcgtgctctcagtttgccatggcttcaagtgttaaaactctcgagagatccttctcgctcggggtacatggtactactgccttttcttttattgttctatcatcattatcattttaaatgttttccggttgaattggtttttgtatagatagacatatatgtatccttcacatttgcttatattgcttgcacttggtaacgttaatccctagtgaactagtatttgccaagagatctaatatcgttaggcagctgattttgtggactaatgactgcttatgatgatgatatatattaatttgatattgatgatgat

SEQ ID NO: 424 - DNA, 937 bp, Brassica rapa
agtcctcgtttggttgctctctagtcctaaatagatctgtagttttaaacgcgacagcaaccataaaatcctctggtttagtcggtcgatcggatcgagtcgaatcgaggatctagggttcgaaaagaaaatggcgcaacaacagtcgttgatctacagtttcgtggctcgcgggacggtgattctcgtggagttcacagatttcaaaggcaacttcacgtcaatcgctgcgcagtgcctccagaagctcccgtcttccaacaacaagttcacctacaactgcgacggtcacaccttcaactacctcgtcgaagatggattcacctattgtgttgttgcggttgaatctgctgggaggcagattccgatggcgtttttggaaagagtgaaagaggattttaacaagagatatggtggagggaaggctgctactgctcaggctaacagcttgaataaagagtttgggtctaagctgaaagagcacatgcagtattgtatggatcatcctgatgagattagcaagcttgctaaggtgaaggctcaagtgtctgaagttaagggtgttatgatggaaaacatcgagaaggttcttgaccgtggtgagaaaattgagctcctggtggacaaaaccgagaaccttcgctcacaggcacaagacttcagaacaacggggacgcagatgagaagaaagatgtggcttcagaacatgaagataaaactcatagttctcgccatcatcatcgctctgattctcataatcgtgctctcagtttgccatggcttcaagtgttaaagccccaggaaaaaattcaaaactctcttgagatctttctcactcggtacatcgtactactgccctttttccctttattgtcctatcaccatcatcattctaatgtttctgcttgaattgttttttgtatagatagacatatat

SEQ ID NO: 425 - DNA, 1051 bp, Brassica rapa
atttcttttcaccgtctctctctctctctctctctctctctctctttctcattttagtctctacgcgtttcagcgttaagtctttttctagatctcttctaccttcaaacaaaactctctgatcagtcaataaaaacccatcgaaacagcgtcgttttcttttacccaacagagagagagagaacacacaaaaaaaaaatggcgcagcaacaacaatcgttgatctacagtttcgtggctcgagggacggtgatcctcgtggagttcaccgatttcaaaggcaacttcacatccatcgctgcacagtgcctccagaagcttccttcctccaacaacaagttcacctacaactgcgatggtcacaccttcaattacttggttgaaaatggattcacttattgtgttgttgcagttgattctgctgggaggcagattcctatggctttcttggagcgagttaaggaggatttcaacaagagatacggtggtggaaaggctgctactgctcaagctaacagcttgaataaggagtttgggtcgaaactgaaagagcacatgcagtattgtatggatcatcctgatgagattagcaagcttgctaaggtgaaagctcaagtgtctgaagttaaaggtgtcatgatggaaaacattgagaaggttcttgaccgtggtgagaaaattgaacttttggtggacaaaactgaaaaccttcgctcacaggcgcaagacttcagaacacaaggaacacaaatgagaagaaagatgtggtttcagaacatgaagataaagctcattgttcttgcaatcatcatcgccttgatcctcatcatcgtcctctcagtctgcggtggcttcaactgtggcaaataagtctgggaacatttctgattcccgagaacatcctcattcagtttgttgtgctttttttttttgtggtttaaaaatttctcatgctatgtttcttctctgcttagatttgtacttgttgaaattggttttgtataggtcatatatataatgtatgaaactgattcttgcgaaccaaaaaaaa

SEQ ID NO: 426 - DNA, 1000 bp, Brassica rapa
aacacttagtcctcgattctctacgcgtttcagagttaagtcttcttctctagatctctgccttcctccgatccatcgctctccgcgtcgtttttcatagaagaaaatggcgcagcaatcgtcgttgatatacagcttcgtcgctaggggcacagtaatcctcgtggagttcaccgatttcaaaggtaactttacgtccgtcgctgcacagtgcctccagaagcttccgtcctcgaacaacaagttcacctacaactgcgatggccacaccttcaattacctcgtcgaaaacggattcacttattgtgttgttgcagttgattctgctgggaggcagattcccatggcttttttggaacgggtgaaggaggatttcaacaagagatatggtggtggaaaggctgctactgctcaggctaacagcttgaataaagagtttgggtcgaaactgaaagagcacatgcagtattgtatggatcatcctgatgagattagcaagcttgctaaggtgaaagctcaggtgtctgaagttaaaggtgtcatgatggaaaacattgaaaaggttcttgaccgtggtgagaaaattgaacttttggtggacaaaactgaaaaccttcgctcacaggcgcaagatttcaggacacaaggaacacagatgagaagaaagatgtggtttcagaacatgaagataaagctcattgttctagcaatcatcattgccttgatcctcatcatcgtcctctcagtctgcggtggcttcaactgtggcaaataagtctgggaacatttcttcctcctagtgattttccgtcaacatcctcagtcacttcgttgtgctgctttcgctcttttttgtggtttctaaattctctcatgctatctttatctgcttagattgtacgtctttgaaattggktttgtataggccatatatatgtatgaatgttcgacattttgccaacatttgctattattggtggtatcaacacggattcttgcc

SEQ ID NO: 427 - DNA, 877 bp, Brassica rapa
aatagatctctacttagcttctccgcgatacaagcccattaaattcacatccaatcggatcgaggatttagggttcgcgaaaaaaatggcgcaacaacaatccttgatctacagcttcgtcgctcgcggcacggtgatcctcgccgagttcactgatttcaaaggcaacttcacctccgtcgctgcacagtgcctccagaagctcccctcttccaacaacaagttcacctacacctgcgacggccacaccttcaactacctcgtcgaagatggattcacgtactgtgttgttgcggttgattctgcggggaggcagattcctatggcgtttttggagagagtgaaagaggattttagcaagagatatggtggtgggaaggctgctactgctcaggctaacagcttcaataaagagtttggctctaagctgaaagagcacatgcagtattgtatggatcatcctgatgagattagcaagcttgctaaggttaaggctcaagtctctgaagttaagggtgttatgatggagaacatcgagaaggttcttgaccgtggtgagaaaattgagcttctggtggacaaaaccgagaaccttcgctctcaggcacaagacttcagaacaacggggacacagatgagaagaaagatgtggcttcagaacatgaagattaaactcatagttctcgccatcatcgtcgcactgattctcataatcgtgctctcagtttgccatggcttcaagtgttaaagagccccataaaagtttaaaaaactctcttgaaatctttttctcactcggtcttcgtaatctatatataatagcaaaccatttttattaatctgatgargtcttcattttttataaggaaaaaaaaaa

SEQ ID NO: 428 - DNA, 802 bp, Musa acuminata
gggacaagaaacgacaaggaagaggaggcacttttcgcctcttctaccttggtggagatcgcggtctcctccacttcctcctcgtcttgattcgaccgatctggggttagggtttctttaggggtcgtggagatgggacagcagtcgttgatctacagcttcgtcgcgcggggaacggtggttctggcggagttcacggagttctcgggtaacttcaacagcatcgctgcccagtgcctgcagaagctccccgctagcaacaacaagttcacctacaactgcgacggccacaccttcaattacctcgtcgaggacggttacacatattgtgttgttgctgttgagtcagttggcaggcaaattcccattgcctttctagagagggtgaaggaggattttaacaaaagatatggaggaggaaaagctgcaactgctgcagccaacagcctcacccgcgagttcgggtccaagcttaaagagcacatgcagtactgtgttgaccaccctgaagagataagcaagcttgccaaggtgaaagctcaggtttctgaagtcaaaggagttatgatggagaacattgagaaggttcttgatcgcggggagaaaattgagttgcttgtcgacaagacagaaaaccttcgctcacaggcacaagatttcagacaacatggaacacagatgaggaggaagatgtggcttcagaacatgaaggttaagctaatcgtcttgggaatcattattgcactagtacttattatcattttgtctgtgtgcatggcttcaatgctaatattgatggata

SEQ ID NO: 429 - DNA, 1011 bp, Musa acuminata
tttttggattctttcctctctccgtcgtcgccaagatcggcgtcactttgtctccatctcgcttcagtcgatcaaggggtggggtttgatcggggatcgggagatggggcagcagtcgctgatctacagcttcgtcgcgcgggggacggtgatcctggcggagtacaccgagttctcgggcaacttcaacagcatcgccgctcagtgcctgcagaagctccccgctagcaacaacaagttcacctacaactgtgacgggcacaccttcaactacctcgtcgaggacggatatacatattgtgtagttgctgttgagtcagttggcaggcaaattcccattgccttcctggacagggtgaaggaggactttaacaaaagatatggaggaggaaaggctgcaacggcctcagccaatagcctcagccgcgagtttgggtccaagcttaaagagcagatgcagtactgtgtagaccattccgaagagatcagcaagcttgccaaggtgaaggctcaggtttctgaagtcaaaggagttatgatggaaaacattgagaaggttcttgaccgtggggagaaaattgagttgcttgttgacaagacagagaaccttcgctcccaggcacaggattttagacagcaagggacaaagatgaggaggaaaatgtggctacagaatatgaaagttaagctgattgtcttgggcataattattgcgctaattcttatcatagttttgtccatatgccatggcttcaaatgctagcatcaacggatctgcgaccgtcacaactacccgctcccctgtaagactggtgctgtgtcgtagtgtagcctattagtttcataaaccttggtgactcatacttcagcatttacatttgcagaatgagtattttgtttgttttcttgtctgctgggtaccaggacggtattagctcagtgtgtcgtatgccatgcggtgtggcctgagaacagaattgcttttttgtcatcgtggcttatcttgttcag

SEQ ID NO: 430 - DNA, 1161 bp, Hordeum vulgare
ctccaccaaagcgaaaccgacctttcccccctcccctcccctcccccagcagcctcgccgagatccaatccggcagcccaccctcccacctcccccacccccaccggcggcgagcgagggcggagaggcggggaagcgagcgagcgagggaggagcgggcgggaggagccatggggcagcagtcgctcatctacgcgttcgtggcccgcggcacggtggtgctggccgagtacaccgagttcaccggcaacttcaccaccatcgcctcccagtgcctcgtcaagctcccggccagcaacaacaagttcacctacaactgcgacggccacaccttcaactacctcgtcgaggacggcttcacatactgtgtagtcgctgttgaatcagtggggcaacagatgccaattgctttcttggttcgggttaaggatgatttcagcaaaagatatgctggcgggaaagctgctactgctgcaccaagcagcctcaacagagagtttggatcaaaactcaaagagcacatgcagtactgtgtagaccaccctgaagagataaacaagctcgctaaagtgcaagcacaagtttcagaagtcaagaacgtgatgatggaaaacattgagaaggttcttgatcgtggggagaagattgagctgcttgttgacaagacagagaatctccgctcacaggcccaggatttcaggcagcaaggaacacaggtgaggagaaagatgtggctacaaaacatgaagatcaagctgattgtcctgggcatcatcgtcgcgctcatcctcatcataatcctgtcggtgtgccacgggttcaactgcggcaagtccaagtgaggacagactctgaggtcgtgagacacattcaactgtccctatattactctgctgattcgagcaaaaaccatatatggtgcctagtgttctttcttctctagtgtgcgctggcccgggccgtggtgcctgtgggggtccgttaccgttgtcgtcgtcgttgtgttgggccgttcgcttgtcgttggatgggtggtggctgggccagcgggtcgtgtatttttggacgctatgtatgtatagcttggatcttgacacctttgttctattgttacatgatgatgagtagtagatttacttaattggagtcaaaaaaaaaaaa

SEQ ID NO: 431 - DNA, 1007 bp, Ocimum basilicum
ggtagagagagaaacagacataggggattccactcccttaaacctcaattaaagtgatctaactcgagatctggttaaaaaggatcgatattgccgagaagaaccctmmcgyarggstatatcgtcggtgccrattgaattcstrckcysattgcwgtcrraaatggggcaaaacggtcggaagacgctgatctacacgctggtggcgcgyggcacgccgccggtggtgctggcggagtacacggagttcagcggsaacttcaattccatcgcctaccagtgcctccagaagcttcctgcgtccaacaataagttyacctacaactgcgataatcacaccttcaattatctcgttcaggatggatttacttattgtgttgttgctgaagaatcggctggaagacagcttcccatggcttttctggatcgyataaaagatgactttttgagcaaatatggtggtgggaaggctgcaacagttcctgctaatggmctcaacaaagaatttggaccaaagttgaaagaacacatgcgatattgcatcgagcaccctgaggagattagcaaattttccaaggtccaggcycaggtttcagaagtgaagggtgttatgatggaaaatatcgagaaggttcttgatcgtggggagaaaatagagcttctggtggataagactgaaaatcttcatcatcaagcccaggacttcaggacaactggaacacaaatcaggagaaaaatgtggctgcaraacatgaagatcaagttgatcgttctagccattgtcgtcgctctgattctcataatagtcctctctatatgcaagggattcaactgctgaaattgagccacttcctcatcatcacatcatttatagatctggctctgctctgaaatgattctgttatgacatccattttgtacatgtataaagccrgtrtctaacaccttgtttgctaggaramrctctttycaryrrtyaaatgycaagtttaataccaataatctcc

SEQ ID NO: 432 - DNA, 1201 bp, Phaseolus coccineus
ggaaaaatcaaacccacttcttctctctcttttcaacgctctgtgtacagcggaagaacgaagcctcctcgttcttcttctgcgctttctctctctacaaccgtagccgttccttcattctttcgttctcctcagcctgccacgtcaccttcctctcatactctctcggcgttgttccttctgctacggttgtggttccggcgatgggacagcaatcgttgatctacagcttcgttgctcgcggtactgtgatcctggccgagttcaccgagttcaccggaaacttcacgggcgtggcggcgcagtgcctccagaaactcccttcctccaacaacaagttcacttataactgcgatggccacaccttcaactacctcgtcgataacggattcacttattgtgtggttgctgttgaatctgctggacggcagattccaattgctttccttgaacgaatcaaggaggattttaccaaaaagtatgctggaggaaaagcggcaacagctgccgctcagagcctcaacagagagtttggacctaagttgaaggagcagatgcagtactgtgttgatcatccagaggaagttagcaagcttgctaaagtgaaagctcaggtttcagaagtcaaaggggttatgatggagaatatcgaaaaggttcttgaccgtggggagaaaattgagcttttggtggataaaacagagaacctgcgttctcaggctcaggatttcaggcagcagggaaccaagattaggagaaagatgtggttccaaaacatgaagataaagctaatcgttctgggtatcataattgccttgattctcattattgttctttccgtttgtggtggctttaactgtggtaaatgagtcttcccacgtcttggcttcaactgtggtatttgtctcctcactcgataagattttgccactgtgcgtgtcgacatggtgcttttgagtttttgggatttacattcttccaaattcgatgatcaatattacatggcattgcttgtatagtgtgtaatgcatttagtccttttcttattgtctcccatagcgtaatgctagtttgccattttctatagtttaggtgggagtattacatttggttttcaagattatgctgttttatttatgacacatttaagaaaccaacccttacgtagttgagctattattaccatagtttttggttagac

SEQ ID NO: 433 - DNA, 989 bp, Phaseolus coccineus
ctcttccttcctacatcctttgtctaaaaagaaaggaaaagaaaaagaaaggaaaagaaaagaaaaagaagagagtgaaggtgtacgcactgcacacagatctgggagaagaagatggggcacgaccagaaccagagatctctgatctacgcgttcgtctctcgcggcaccgtgattcttgccgagtacactgaattcagcggcaacttcaacaccatcgcttttcagtgcctccagaagctccctgcctccaacaataaattcacctacaactgcgacggccacaccttcaattacctagtcgacaacggattcacgtattgtgttgttgcggatgagtcgattgggagacaggtgcctgtggcttttctggagcgcgtgaaggatgattttcttgccaagtacggcggcgggaaggcggcgacagcagccgccaacagcctgaacaaggaattcgggtccaagttgaaggagcatatgcagtactgtgttgagcaccctgaagagattagcaagcttgctaaggtgaaagctcaggtttctgaagttaaaggtgtcatgatggagaacattgagaaggttctggacagaggggaaaagatagagcttctggtagacaagactgaaaatcttcatcaccaggcacaagacttcaggaattctgggaccaaaatccgtagaaaaatgtggctgcaaaacatgaaggtaaagctgattgtgttggcaattttgatagccctgatcctcataatagtcctctctgtttgccgtgggttcaattgtggaaaaaattaagcaccgagtcattttagcttcttgtcattatatatgaggaaaaaatgtggaatgaatagatgacgtgattttgtatgtagtaaaaatgtgggatctcttcaattgttcattttaaagattttacagtgcgatatgagaatgcttttggaaatattaatttgtttgtctattgtagttccattttcattcactcc

SEQ ID NO: 434 - DNA, 1042 bp, Phaseolus coccineus
ggatctgtgttgtagtaacttccctatgaccactttctccctctatttctcaccgtttttctaaaccctcttttatcttttctcttcctttttctccctacaaattccaaagaaagtgtgtgtgtttgtgagagagaagaatttcgatttgggtgttggattgagcaaaagcgtgacaccatcaccaccaagaaactgttcccagatctctctcttgcaacaatcgaactccaaaaccctacccaacactcaattcagattctcattcatggggcagaggtctctgatctacgcgttcgtgtctcgtggaacggtaattcttgcggagtacactgaattcagcggaaacttcaactccatcgccttccagtgccttcagaagctccctgccagtaacaacaagttcacctacaactgcgacgcccacaccttcaattacctcgtcgacaatggctacacatattgtattgttgcagatgaatcaattggaaggcaagtgcccatggcttttttagagcgtgttaaagatgattttgtgtcaaaatatggtggtggaaaggcagccacagctcctgcgaacagccttaacaaggaatttgggccaaagttgaaggaacatatgcagttctgtgttgatcatcctgaagaggtcagcaagcttgcgaaggtgaaagctcaggtttctgaagttaaaggtgtcatgatggagaatattgaaaaggttctggacaggggtgaaaagatagagcttctggtggataagacagagaaccttcataaccaggcacaagatttcaggacttctgggaccagaatccgtcgaaaaatgtggctacaaaacatgaaaacaaagctgattgtcttgggaattttgatagcactgatccttataatagttctatctgtgtgtcgtgggttcaactgtgggaaataggcgccattctcggaggccctttatcatgttacttcaagcttgagattatctgaggaaagatcctaatgtatggcatgagtttgtatgtaatataaatatagatataga

SEQ ID NO: 435 - DNA, 1078 bp, Brachypodium distachyon
agcgaaaccgacctttccccctcctctcctccccacctcgccgagatctagccctagggttgcttaacccggcggcgaagccccgcggcgagcttggactctcacgtaccacaggcggcgagcgagagggaggacggacggacaagggaagccatggggcagcagtcgctgatctacgcgttcgtggcccgcggcacggtcgtcctggccgagtacacggagttcaccggcaacttcaccaccatcgcctcccagtgcctcgccaagctcccctccagcaacaacaagttcacctacaactgcgacggccacacgttcaactacctcgtcgaggacggcttcacatactgtgtagttgccgttgaatcagtagggcaacaaatgcccattgctttcttggttaggataaaggatgatttcagcaaaagatatggtggtgggaaagcagctactgctgcagcaagcagcctcaacagagagtttggatcaaaacttaaagagcacatgcagtattgtgtggaccacccagaagagataaataagcttgctaaagtgcaagcacaagtttcagaagtcaaaaacgttatgatggaaaacatcgagaaggttcttgatcgtggagaaaagattgaactgcttgttgacaagacagagaatctacgctcacaggctcaagatttcaggcagcaaggaacgcaggtaaggagaaagatgtggctacaaaacatgaagatcaagctgattgttctcggcataattgttgcactcattctcatcataatcctgtccgtgtgccatggattcaagtgcaagtaagggcggcctggtcgagatacattcagcagtccctatattacctgctgcttctgcttggagcaaaaaccatatggtgttctgttctttctctagtgtgctctggcccggttcgtggtgcctggggggtgtttacgtcgtcagtgttgggctgtttgcttaatgtttggatggtggctgggtcagcggggtcgtgtatttttggacgctatgtatgtatagcttggatcttaaccctttctattatatgagtagagatttactt

SEQ ID NO: 436 - DNA, 1330 bp, Theobroma cacao
gcagaattcggcacgagctgaacccctgaatccacagcaacgccttagatatttccacctccaactccccccttacgaccaaatccaaaattcgcactatttcaaggcaatttcccctctttctaaattgtaacataggaataaaaaaaatactcttaaatatatatacgtacaaacaaaattatcgtcgtacatatataaatataaatccattcaccgcaaatccagcatttcttcattttccaatttccttctccgatcccatcgcccctccctcgctctcccgttgctctctctctctctctgtctattttcattattttatcctttcgtttggattcttggttgtgaaactttagggctagggttttgagagatggggcaacagtcgctgatctacagcttcgtggcgcgtggtacgatgatcctcgccgagtataccgagttcaccggtaatttcaccagcatcgcggctcaatgtctccagaagctccctgcttccaacaacaagtttacctataactgcgatggccacaccttcaattacctcgttgaaaatggattcacctactgtgtggtagcagttgaatctgctggcaggcaagttccaattgcatttctggaacgagtcaaggaagacttcaacaagagatatggtggagggaaagctgcaactgctactgcgaatagcctgaatagagaatttgggtccaaattgaaggagcatatgcagtattgtgtggaccatcctgaagagatcagcaaacttgccaaagtgaaggctcaagtttctgaagtcaagggtgttatgatggaaaacattgagaaggtccttgatcgtggtgagaaaattgagttgctggtggataaaacggagaaccttcgctcacaggcacaagactttaggcagcagggaactaagatgagaagaaagatgtggtttcagaatatgaagataaaattgattgttttgggtatccttattgccctgattcttatcattgtgctgtccgtctgccatggcttcaaatgttaatctgtcttggatttcccttgtaccgctcttgctgcctgggttgtcttgatagattggtttgtcttacttgtttttttagggcatatatttctccctttgctagccgtttaggatagggggaggctttgtatcttggttggctgtataggttatagtttgaacttgttacggtagataaaaaatttctatggaggatttcttctttatattgtaatgggggattactcggatgcctgcatatcatatttgtccttttgaaatgttattaatctgtttttttgtttttctcgcgta

SEQ ID NO: 437 - DNA, 1085 bp, Theobroma cacao
cgggggaagagaaacaaagagaaagagaaagagggacagagagaaagcctctcaaatcctagatctctctttgctttctctttggaaacccaaagtaccatatcaaaaatttctaagaaaaatggtgcagaaatcattgatctacgcgtttgtatctcgtggggaagttattctagcggagtacactgaattcagtgggaatttcaattccatagcttttcaatgcctccaaaagcttccttcttccaacaacaagttcacttacaactgtgatggccacaccttcaattaccttgttgacaatggctacacatattgtgttgttgcagatgagtcagctggaaggcaagtaccaattgctttcttggagcgtatcaaggatgattttgtgtcaaaatatggtagtggaaaggctgctacagctcctgccaacggcttgaacaaggaatttgggccaaaactaaaagaacatatgcagtactgtgtggagcatcctgaagaaataagcaagcttgctaaggttaaagctcaggtttcagaagtcaaaggtgttatgatggagaacattgaaaaggtgttagatagaggggaaaagatagagctgctagtggataagactgagaatcttcatcaacaggctcaagactttcgaagtactgggacaaaaatccgaagaaaaatgtggctgcaaaacatgaagatcaagctgattgttctaggaatactgattgccttgatcctcatcattgtcctctctgtttgccatggtttcaactgtggaaaatgaatgctgttcttgaatcggcttattagcttgagcttttgtgataatattgtgaggggaaagataaaaaatatattaaaatgacttcctctgtcataaaaaattagcagtcaccagatgtttggtgcaagttatttttgaatgtgagcagaccctataagtttttattgtattacatgaatgtgcttttgcaacaatcatattggttgtttaccatccagcttcacagttagttggcacatttttggcctggacaagaacttgtttgaacttawactttttagctcaatcttgttaatca

SEQ ID NO: 438 - DNA, 1109 bp, Theobroma cacao
cgggggcctttgcctagcttcttttttaagcgaaaaagaaaaaggaaactctcctctttctcttcccatttctttccttctctctgtcctctttccccctccgtagcaaacacctcctttcctctctctctctccctttctttctttctgctaggtttagggagttaaggggggctttgagtgggactcttgtttgatggggcaacaatcgctgatctacgccttcgtggcgcgaggcaccgtcgtgttagccgactacaccgaattcaccggcaacttcaccagcatagcttctcagtgtctccagaaacttcccgcttccaacaacaagttcacgtacaactgcgatggccacacctttaactatctcgtcgataacggcttctcttattgcgtggttgctatcgaatctgttggccgacaggttccaattgcctttcttgagagaattaaggaggattttaccaagatatatggtggaggtaaagctgcaactgctcctgcaaacagcctgagcagggaatttgggccaaaattgaaggaacatatgcagtactgcattgatcatccagaggagattagcaagattgccaaagtgaaagcccaagtttcagaagtgaaaggagttatgatggaaaacattgagaaggttctggaccgtggtgagaaaattgagcttctggtggataaaacagaaaaccttcgctytcaggcccaagatttcaggcagcagggaacccagatgaggagaaagatgtggttgcagaacatgaagataaagctcatagttcttgggatcctgatcgccttgattttgatcatcgtactgtctgtttgcggtggctttaaatgttgatgaattgcttgtttgctaaattccattgccccccatggattggtgttgctgcggtgacaagtaatatttagttttttttttattattattataacacgtactcttctgccgtagcatatttttgaaggctgtgtgcatgtatagtttgtatttttggattcttttgttagcagtaagtttgttgatgtgtggaaattcgatwtgtgtcgattrgaaattgaattttgatccaaaaaataatgaaggtacttca

SEQ ID NO: 439 - DNA, 952 bp, Brassica napus
tacgcgtttcagagttaagtcttcttctctagatctctgccttcctccgatccatcgctctccgcgtcgtttttcatagaagaaaatggcgcagcaatcgtcgttgatctacagcttcgtcgctaggggcacagtaatcctcgtggagttcaccgatttcaaaggtaactttacgtccgtcgctgcacagtgcctccagaagcttccgtcctcgaacaacaagttcacctacaactgcgatggccacaccttcaattacctcgtcgaaaacggattcacttattgtgttgttgcagttgattctgctgggaggcagattcccatggcttttttggaacgggtgaaggaggatttcaacaagagatatggtggtggaaaggctgctactgctcaggctaacagcttgaataaagagtttgggtcgaaactgaaagagcacatgcagtattgtatggatcatcctgatgagattagcaagcttgctaaggtgaaagctcaggtgtctgaagttaaaggtgtcatgatggaaaacattgaaaaggttcttgaccgtggtgagaaaattgaacttttggtggacaaaactgaaaaccttcgctcacaggcgcaagatttcaggacacaaggaacacagatgagaagaaagatgtggtttcagaacatgaagataaagctcattgttctagcaatcatcattgccttgatcctcatcatcgtcctctcagtctgcggtggcttcaactgtggcaaataagtctgggaacatttcttcctcctagtgattttccgtcaacatcctcagtcacttcgttgtgctgctttcgctcttttttgtggtttctaaattctctcatgctatctttatctgcttagattgtacgtctttgaaattggttttgtataggccatatatatgtatgaatgttcgacattttgccaacatttgctatta

SEQ ID NO: 440 - DNA, 955 bp, Brassica napus
gctcgctctattgttgtttagtcttattagatctctattttctcgcgacagcaccattaaaatcctctgatcggatcgagccgaatcgaggatttagagttcgaaagaaaaaaatggcgcagcaatcgctgatctacagcttcgtcgctcgaggtacggtgatcctcgtggagttcaccgatttcaaaggcaacttcaccaccgtcgctgcacagtgcctccagaagctcccctcttccaacaacaagttcacctacaactgcgacggccacaccttcaactacctcgtcgaagatggattcacttattgcgttgttgcggttgattctgctgggaggcagattccgatggcgttcttggagagagtgaaggaggattttaacaagagatatggtggtgggaaggctgccactgctcaagcaagcagcttgaataaagagtttgggtctaagttgaaggagcacatgcagtattgtatggatcatcctgatgagattagcaagcttgctaaggtgaaggcgcaggtgtctgaggttaagggtgttatgatggagaacatcgagaaggttcttgaccgtggtgagaagattgagcttctggtggacaaaactgagaatctacgctcacaggcacaagatttcagaacaacggggacgcagatgagaagaaagatgtggcttcagaacatgaagataaaactcatagttctcgccatcattgtcgcgttgattctcattatcgtgctctcagtttgccatggcttcaagtgttaaaactctcttgagatccttctcgctcggggtacatggtactactgccttttcttttattgttctatcatcattatcattctaaatgttttccggttgaattggtttttgtatagatagacatatatatgtatccttcacatttgcttatattgcttgcacttggtaacgttaatccctagtga

SEQ ID NO: 441 - DNA, 993 bp, Brassica napus
agatgttacttacgctcgcctcttcgattctgtacgcgtttcagagtttagtcttctctagatctctgccttcctctgcgccgttttaaatctccgattcgatcggtaaaaccatctcgctccgcgtcgtttttcatagaagaaaatgtcgcagcaatcgtcgttgatctacagtttcgtggctcggggcacagtaatcctcgtggagttcaccgatttcaaaggcaacttcacatcaatcgccgcacagtgcctccaaaagcttccttcctcgaacaacaagtttacctacaactgcgatgggcataccttcaattacctcgtcgaaaacggattcacttattgcgttgttgcagttgattctgctgggaggcagattcccatggcttttttggaacgagttaaggaggatttcaacaagagatacggtggtggaaaggctgctactgctcaagctaacagcttgaataaagagtttgggtcgaaactgaaagagcacatgcagtactgcatggatcatcctgatgagattagcaagcttgctaaggtgaaagctcaggtgtctgaagttaaaggtgtcatgatggaaaacattgaaaaggttcttgaccgtggtgagaaaattgaacttttggtggacaaaactgaaaaccttcgctcacaggcgcaagatttcagaacacaaggaacacagatgagaagaaagatgtggtttcagaacatgaagataaaactcattgttcttgcaatcgtcattgccttgatcctcatcatcgttctctcagtctgcggtggattcaactgtggcaaataagtctgggaacatttcttcctcctcgtgactttcggggaacatccctcattcacttcgttgtgctgctttcgctcttttttgtggtttctaaattctcatgctatgtttctctctctgcttagattgtacttctttgaaattggttttgtataggccatatatatgtatgaatgttcgac

SEQ ID NO: 442 - DNA, 1098 bp, Brassica napus
gagtcctcgtttggttgctctctagtcctaaatagatctgtagtttttaacgcgacagcaaccataaaatcctctggtttagtcggtcgatcggatcgagtcgaatcgaggatctagggttcgaaaaaaaaatggcgcaacaacagtcgttgatctacagtttcgtggctcgcgggacggtgatactcgtggagttcacagatttcaaaggcaacttcacrtcaatcgctgcgcagtgcctccagaagctcccgtcttccaacaacaagttcacctacaactgcgacggtcacaccttcaactacctcgtcgaagatggattcacctattgtgttgttgcggttgaatctgcggggaggcagattccgatggcgtttttggaaagagtgaaggaggattttaacaagagatatggtgggggaaaggctgctactgctcaggctaacagcttgaataaagagtttgggtctaagctgaaagagcacatgcagtattgtatggatcatcctgatgagattagcaagcttgctaaggtgaaggctcaggtgtctgaagttaagggtgttatgatggaaaacatcgagaaggttcttgaccgtggtgagaaaattgagctcctggtggacaaaaccgagaaccttcgctcacaggcacaagacttcagaacaacggggacgcagatgagaagaaagatgtggcttcagaacatgaagataaaactcatagttctcgccatcatcatcgctctgattctcataatcgtgctctcagtttgccatggcttcaagtgttaaaagccccaggaaaattcaaacctctcttgagatctttctcactcggtacatcgtactactgcctttttccctttattgtcctatcaccatcatcattctaatgtttctgcttgaattggtttttgtatagatagacatatatatatgtaagctttcacgtttgctatattgcttgcacctgatgactttgatccctaagagatcaaaaactattaaaatgattttgtggactgatgactgcttgtggtgatgatgataataaaacgattacggttatgataataattatattgaccaaaagtct

SEQ ID NO: 443 - DNA, 904 bp, Brassica napus
ttgttgtttagtcttataattagatctctatttcctcgcgacagcaccattaaaatcctctgatcggatcgagccgaatcgaggatttagagttcgaaaaaaatggcgcagcaatcgctgatctacagcttcgtcgctcgaggcacggtgatcctcgtcgagttcacagatttcaaaggcaacttcacctccgtcgctgcacagtgcctccagaagctcccctcttccaacaacaagttcacttacaactgcgacggccacaccttcaactacctcgtcgaagatggattcacgtattgtgttgttgcggttgagtctgctgggaggcagattccgatggcgttcttggagagagtgaaggaggattttaacaagagatatggtggtgggaaggctgccactgcgcaagcaaacagcttgaataaagagtttgggtctaagctgaaagagcacatgcagtattgtatggatcatcctgatgagattagcaagcttgctaaggtgaaggcgcaggtgtctgaggttaagggtgttatgatggagaacatcgagaaggttcttgaccgtggtgagaaaattgagcttctggtggacaaaaccgagaaccttcgctcacaggcacaagatttcagaacaacggggacgcagatgagaagaaagatgtggcttcaaaacatgaagataaaactcatagttctcgccatcattgtcgcgttgattctcattatcgtgctctctgtttgccatggcttcaagtgttaaaactctctgggggggtacatggkactgccttttcttttattgttctatcgtcattatcattctaaatgttttccgcttgaattggtttttgtatagatagacatacatgtatgcttcacatttgctatattgcttgcacctg

SEQ ID NO: 444 - DNA, 1082 bp, Brassica napus
ctctctctctctttctsattttagtctctacgcgtttcagcgttaagtctttttctagatctcttctaccttcaaacaaaactctctgatcagtcaataaaaacccatcgaaacagcgtcgttttcttttacccaacagagagagagagaacacacacaaaaaaaaaatggcgcagcaacaacaatcgttgatctacagtttcgtggctcgagggacggtgatcctcgtggagttcaccgatttcaaaggcaacttcacatccatcgctgcacagtgcctccagaagcttccttcctccaacaacaagttcacctacaactgcgatggccacaccttcaattacttggttgaaaatggattcacttattgtgttgttgcagttgattctgctgggaggcagattcctatggctttcttggagcgagttaaggaggatttcaacaagagatacggtggtggaaaggctgctactgctcaagctaacagcttgaataaggagtttgggtcgaaactgaaagagcacatgcagtattgtatggatcatcctgatgagattagcaagcttgctaaggtgaaagctcaagtgtctgaagttaaaggtgtcatgatggaaaacattgagaaggttcttgaccgtggtgagaaaattgaacttttggtggacaaaactgaaaaccttcgctcacaggcgcaagacttcagaacacaaggaacacaaatgagaagaaagatgtggtttcagaacatgaagataaagctcattgttcttgcaatcatcatcgccttgatcctcatcatcgtcctctcagtctgcggtggcttcaactgtggcaaataagtctgggaacatttctgattcccgagaacatcctcattcagtttgttgtgctttttttttgtggtttaaaaatttctcatgctatgtttcttctctgcttagatttgtacttgttgaaattggttttgtataggtcatatatataatgtatgaaactgattcttgcgaaccattcacttggacctgatttgaacgcttgtgtttgctttcgtctttttattttgtgtgacttctgttaatttt

SEQ ID NO: 445 - DNA, 1146 bp, Brassica napus
ggatctttctctagttcaattccatttcttttcaccgtctctctctctttctcatttagtctctacgcgtttcagcgttaaagtctttttctagatctcctctaccttcacgccgatataacaaaactctctgatcagtcaatagaaacccaccaatagagagagagaacacaaaaaaaaaaaaatggcgcagcaacaacaatcgctgatctacagtttcgtggctcgagggacggtgatcctcgtcgagttcaccgatttcaaaggcaatttcacatccatcgctgcacagtgcctccagaagcttccttcctccaacaacaagttcacctacaactgcgatggtcacaccttcaattacttggttgaaaatggattcacttattgtgttgttgcagttgattcagctgggaggcagattcctatggccttcttggagcgagttaaggatgatttcaacaagagatacggtggtgggaaggcagcaactgctcaagcgaacagcttgaataaggagtttgggtcgaaactgaaagagcacatgcagtattgtatggatcatcctgatgagattagcaagcttgctaaggtgaaagctcaagtttctgaagttaaaggtgtcatgatggaaaacattgagaaggttcttgaccgtggtgagaaaattgaacttttggtggacaaaaccgaaaaccttcgctcacaggcgcaagacttcagaacacaaggaacacaaatgagaagaaagatgtggtttcagaacatgaagataaagctcattgttcttgcaatcatcatcgccttgatcctcatcatcgtcctctcagtctgcggtggcttcaactgtggcaaataagtctgggaacatttctgattcccgagaacatcctcattcagttcgttgtgctggtttttttctttttgtggtttaaaaattctcatggctatgtttcttctctgcttagatttgtacttctttaaattggttttgtataggtcatatatatatgtttgaaattgattcttgcgaaccattcacttggacctgatttgaacgcttgtgtttgctttcgtcttttttttggtgacttctgtgaatttttataatcgtatagcatagtctatttggtctgaaaaaaaaaaata

SEQ ID NO: 446 - DNA, 880 bp, Brassica napus
atcgaggatttagggttcgcgaaaaaaatggcgcaacaacaatcgttgatctacagcttcgtcgctcgcgggacggtgatcctcgccgagttcactgatttcaaaggcaacttcacctccgtcgctgcacagtgcctccagaagctcccctcttccaacaacaagttcacctacacctgcgacggccacaccttcagttacctcgtcgaagatggattcacgtactgtgttgttgcggttgattctgctgggaggcagattccgatggcgtttttggagagagtgaaagaggattttagcaagagatatggtggtgggaaggctgctactgctcaggctaacagcttcaataaagagtttggctctaagctgaaagagcacatgcagtattgtatggatcaccctgatgagattagcaagcttgctaaggtgaaggctcaagtctctgaagttaaaggtgttatgatggaaaacatcgagaaggttcttgaccgtggtgagaaaattgagcttctggtggacaaaaccgagaaccttcgctctcaggcacaagacttcagaacaacggggacacagatgagaagaaagatgtggcttcagaacatgaagattaaactcatagttctcgccatcatcgtcgcactgattctcatcatcgtgctctcagtttgccatggcttcaagtgttaaagagccccatcaaagttaaaaaaactctcttgaaatctttttctcactcggtcttcgtaatctatatataatagcaaaccatttttattaatctgatgatgtcatcattttttataagaaaaaaaaaacaaaatctaacggtgatatatgttcctaaaatataatctaatggtaaattttgtttgagaac

SEQ ID NO: 447 - DNA, 954 bp, Manihot esculenta
ggctctccaaaaccaaaggctcctgacctcagttccctctctctctctctatctctctctaaggttagggttttgttgacgtaacagatggggcagcaatcgttgatctacagcttcgtggcgagagggacggtgattttggcagacttcacggagttcaccggcaactttaccagcatagcagctcagtgcctccagaaacttccggccaccaacaacaagttcacctacaattgcgatggccacaccttcaactacctcgtcgataacggcttcacttactgtgtagttgcagttgagtctgttggccgacaggttccaattgcctttcttgagcgaatcaaggaggaatttaccaagaaatatggtggaggaaaagctgcaacagcagttgccaatagcctgaacaaggaatttgggcccaagttgaaggagcagatgcaatactgtgtggatcaccctgaggaggtcagtaagctagcgaaagtgaaagctcaggtttcagaagtcaaaggggtaatgatggaaaacatagagaaggttcttgaccgtggagagaaaattgagcttttggttgacaaaactgaaaatcttcgctctcaggctcaagatttcagacaacagggaaccaagatgaggaggaagatgtggttgcagaacatgaaaattaagctgatagtgctgggtatcttgattgccttgattctcatcatagtattgtccgtttgtggtggcttcaaatgtcactagtttcatcgataatgatttacctatacttttttttgtgttgttaccactttctgctatagtctacatcatgagacagtgcttgtatagtttgtgctttgaattctcttgctcggtgtgtgtggaagtttgtcattccttcttgtcacacagtattattattttttatttcatgaatgtcagtcaaattaagttggaagtaaataa

SEQ ID NO: 448 - DNA, 1005 bp, Manihot esculenta
ggaggtgggamctytctctctctctcyacaataaagccactcatttctttgattcatctctgctctgcgacagcaagagctcatcagttccctctctctccctctgtagcgttagggttttgttgacggagtagatggggcagcaatcgttgatctacagctttgtggcccgagggacggtgatattggcagagtacacggagtttactggaaacttcaccagcatagcagctcagtgccttcagaaacttccggcgaccaacaacaagttcacctacaactgcgatggtcacaccttcaactacctcgtcgataacggctttacatactgtgtagttgcagttgagtctgttggccgacaggttccaattgccttccttgagcgggtcaaggaggatttcagcaatagatatggtggaggaaaagctgcaacagcagttgctaatagcctgaacaaggaatttgggcccaagttgaaagagcaaatgcaatattgtgtggatcatcctgaggaggtcagtaagcttgctaaagtgaaagctcaggtttcagaagtcaaaggggttatgatggaaaatatagagaaggttcttgaccgaggagagaaaattgagcttctggttgacaaaactgaaaatctacgctcccaggcgcaagattttagacaacagggaaccaaaatgaggaggaaaatgtggttccaaaacatgaaaattaagctgatagtactgggcatcttgattgctttgattctcatcatagtattgtccgtttgtaaaggcttcaaatgcaactagtttcagcggtgatgatttacgtatgatactttctttgtgttgccactttcagctatagtctatatcgtgagaactgcatgtatagttagtgtttttgaattcttttgatgatgtgtggaagtttgtcattccttgtatgattttgttgtcactcttatttcggctgatgaatgccaatcgaattaatttgaaagaagataaaggcatc

SEQ ID NO: 449 - DNA, 1059 bp, Manihot esculenta
gcagccgcattttagaattttcattttctttcattttcctccccttccttaattcttctttttctatctcatccattttccactccagcattttgcatttccagggttagggttttgctgttctcctgtatataagcaaagacagagatggggcaacagtcgctgatctacagttttgtcgctcgaggcactgtgattctggcggagtacactgagttcactgggaatttcaccagcatcgcctctcagtgcctccagaaactccctgcttccaacaacaaattcacatataactgtgatggtcacaccttcaattacctcgttgaaaacggcwtcacctactgtgtggttgcagtcgaatctgctggcagacagattccaattgcctttctggagcgagttaaggaagacttcaacaagagatatagtggaggaaaagctgcaactgctcaggccaatagcctgaacagagagtttggctccaaactaaaggagcacatgcagtattgtgtggatcatcctgaagaagtcagcaagcttgcaaaagtgaaggctcaagtttctgaagttaagggtgtgatgatggaaaacattgagaaggttcttgatcgtggtgaaaagattgagctgctggtggataaaactgagaaccttcgctcacaggcacaagattttagacaacagggaactaagatgagaaggaagatgtggcttcagaatatgaagataaaattgattgttttgggcattatcattgctttgattctgataatagtgttatccatttgtcatggcttcaaatgttaatttctgttgaatttcattggaatgctatccttgctgccaagctgaccagattgtctggcttaaaatgtgtcgtgttgcttctgatgatccatcttgcagatctctctctctgtggagtctttttaggttaaacctttgcacttatgttagccattagggatgtgagaaggtttatattttggattagttgtataggttatatgttgaactttcttctggtagataattttctttgtccttataatgtttgtt

SEQ ID NO: 450 - DNA, 979 bp, Ricinus communis
ctataactctctttctctcctttcaatttctatgtcccctctctctctttcatccattctacacttctgttttttccggggttagggttttatatatatacacgtatatagatatataaagagaaggagatggggcaacaatcgttgatctacagttttgtggcaagaggcacggtgattcttgctgaatatacagagtttactggtaatttcacaagcatcgcatctcaatgtctccagaaattacctgcttctaacaacaaatttacctacaattgcgatggtcataccttcaattacctcgttgagaacggcttcacctactgtgtggttgcagttgaatctgccggaagacaaattccaattgcctttctggagcgggttaaagaagactttaacaagagatatggtggagggaaagctgcaactgctcaagcccatggcctgaacagagagtttgggtccaaactgaaggagcacatgcagtattgcgtggatcatccagaggaaatcagcaagcttgcgaaagtgaaggctcaggtttctgaagtgaagggtgtgatgatggaaaatattgagaaggttcttgatcgtggtgaaaagattgagctgctggtggataaaactgagaatcttcgttcccaggctcaggatttcagacaacaggggaccaagatgagaaggaagatgtggattcagaatatgaagataaagttgattgttttgggtatcatcattgccttgattcttatcatagtgttatccgtttgtcatggcttcaaatgttaattttctcaactttcagtggagctatcctgccctgccaatattactggatttgtcttgctaaattggttagcctttgttctgatgatccatcttgcagatctctctctacggggtcttttaggttacttctttccccttatgttagcctcttttaggatgtgaggagatctgtattttctggattggttgt

SEQ ID NO: 451 - DNA, 922 bp, Ricinus communis
ttctactttcttcaacaacaacaccatcgctgtccctttttatctttttctttttgctgctgctgctgctgctgctgttgttgcggtaagtagtaagtgtttagatggggcagcaatcgttgatctacagctttgtggccagaggcacggtcatattggccgattacacggagttcaccggtaacttcaccggaatagccgctcagtgtctccagaaacttccggctagcaataataagttcacctataactgcgatggccatactttcaactaccttgtagataacggcttcacttattgtgttgttgcagtcgagtctgttggccgacaggttccaattgccttccttgagcgaatcaaggaggagttcaccaagaaatatggtggaggaaaagctgccacagcaactgctaatagcttgaacaaggaatttgggcccaagttaaaggagcagatgcaatattgtgtagatcaccccgaggaggtcagcaagcttgctaaagtgaaagctcaggtttcagaagtcaaaggagtgatgatggaaaacatagagaaggttcttgaccgcggagagaaaattgagcttttggtagacaaaactgaaaatcttcgctctcaggcacaagatttcagacaacagggaacccagatgaggaggaagatgtggttgcagaacatgaaaattaagctgatagtgctgggtatcttgattgccttgattctcatcatagtattgtccgtttgtggaggattcaagtgtcattagtctcaatgatgacgaacttatagttttttggtttgcaactttctgttatagtctatattacaagacagtgtttgtatagtttgtattttgaataatttttgtactagtgattttgtttacgtgtggaagcttgtcattcatcattacgatctctt

SEQ ID NO: 452 - DNA, 837 bp, Ricinus communis
atgggtgagaaatctttgatctacgcattcgtttcacgtggaactgtggttcttgcagagtacacagaattcagtgggaatttcaattccatagcatttcaatgcctccagaaactcccttctaccaacaacaagttcacttacaactgcgatgcccacaccttcaatttcctagttgataatggctttacgtactgcgtagttgcagatgaatcggcaggacgacaagtacctatggcttttcttgaacgtattaaggaagacttcatggcaagatatggcaatggaaaagctgctactgctcctgccaacagccttgacaaggaatttgggccaaaactaaaggaacatatgcaatattgtgttgatcatcctgaagagataagcaagtttgcaaaggtgaaagctcaggtttcagaagttaaaggggtcatgatggaaaatattgaaaaggttttagatcgaggggaaaaaattgaactactggtggataagactgagaatcttcatcaacaggcacaagacttccgaagcagtgggacaaaaatccggaggaaaatgtggctgcagaatatgaagatcaagcttattgttttggcaatactgattgccttgatcctcatcatagtcctttcagtttgcagaggttttaactgcggaaaatgagtgctatctaggaaggctttatattattaatggagcttttttcgagttatatatatattgtgataataccgtgtgtagcaacaaacaacaatttcttgatatctttgtatgtgaatgagaactctatactattgtgacatcattacaatgctattagcagattttagttgg

SEQ ID NO: 453 - DNA, 989 bp, Centaurea maculosa
cccaaaatcagatcctcccccatctctccagccctagggttagggtttctactctcagattgaaagatttgtagttcaattttgttgaaatcabcatgggccaacagtctttgatctacagttttgtgtctagaggcagcgtgattcttgccgagtacacagagttcaccggaaatttcacttctattgcttcccaatgcctacagaagcttcctgcaactaacaacaagttcacttacaattgcgatggacataccttcaattaccttgttgaagatggcttcacatactgtgttgttgctgctgaatctgctggcagacaagttccaatggcttttcttgagcgaaccaaggatgactttaccaagaagtatgctgstggtgggaaagcagctacagctactgccaatagtctgaacaaggaatttgggcccaagytgaaggagcagatgcagtattgtgtggatcaycctgaagaaatcagcaagctttcgaaggtaaaggcacaggtttcggaagtcaaaggtgtgatgatggagaacattgaaaaggttttggatcgtggtgagaaratagagcttcttgtggataaaacagagaatcttcgctctcaggctcaagattttaggacacaaggtacacaaatgaggaggaagatgtggctgcagaatatgaagataaaactcatagttctcggaatcatcattgccttgattctcattatagtcctctccgtctgtggcggcttcaactgcggcaagtgaagtacgtatatataactattcatggtaaaacgtctctcgtttatttgtgttttcccgtgcctttattcgtacccttatgttgttaaaaagccctatattgcaagactatatgtatattttgtaccttgagaattgtgatgagggaaacaccatgattgctctttagtagaataatttgtgttcgttttgaagtatatatataatattttatatatgggaaaactg

SEQ ID NO: 454 - DNA, 1192 bp, Centaurea maculosa
tcctaagaaatgaaacaaaccagcagggtttttgtgagataaatttctttgtaaaataaaaaagcggttttaaaaccctttttgattccttagtatctacgaaaacccacaaatctcaccttcttttgttctcctttcctcttctgcaaaatcaaaatcaaaatcaaatctcacatccattcctccatcttcaagtttcctttattccttcaatacatcatactctctattatccaatttctcttctttttcttttcttaataatcacttgctagggttttgtattaatggggcaacagtctttgatctatagttttgtgtctagaggagccgtgattctctccgagtacaccgaattcaccggcaatttcacttcgatcgcatctcagtgcctccagaagcttcctgcaaccaacaataagttcacctacaactgcgatggacacaccttcaattaccttgttgaagatggctttacatactgtgttgttgctgctgaatctgctggcagacaggtcccaatggcttttctcgagcgaattaaggaagactttaccaagaaatatggtgcagggaaagctgctaccgctgctgccaatagcctgaacaaagaatttgggcctaagctgaaggagcagatgcagtattgtgttgatcatcctgaagaaatcagcaagctttcaaaggtgarggcccaggttacagaagtcaaaggtgtgatgatggaaaacattgagaaggttctagaccgtggagagaagatcgagcttctagtggataaacagagaacctccgatctcaggcacaagattttaggacacaaggtacccaaatgaggaggaagatgtggttgcaaaacatgaagataaagctgatagttcttggtatcattatcgccttgattctcattatagtcctatcggtttgcggtggtttcaactgtggcaaatgaagcttgtagacttgataccgggytttcgttattatcattttgttggtgtttcatttgccatttttggatgagagatatacttgcattatgcaaaaatacaaaaagcctatgttttgggttcctagtgtatatttgtacccttgaagatatttgtgatgtatacttgggtaatagtttgattgtggctccactttgctcctttaaacgtttttatttttgaaattaaaattgagcattttg

SEQ ID NO: 455 - DNA, 964 bp, Centaurea maculosa
aaacccttttcttattccccattttccactttctctctctagaaactcctccactttctctctctaaaaactcctctttctctctcacacacaaacacacaaaaacacgcacttcattcttcgatcggagagakagagatggggcaacagtcgttgatctacagcttcgtggccagaggaacggtgattctgtcggaatacacggagttcaccggaaacttcaccagcatcgctgcacagtgtctccagaagcttccggctaccaacaacaagttcacctacaactgcgatggccataccttcaactatctcgttgaggatggattcacatactgtgttgtcgcggttgaatctgttggtagacaggtcccgatagcttttcttgagcgagttaaagaggatttcactaagaaatatggaggggggaaagctgcaacagctgttgccaacagtctgagcaaagagtttggtcccaagctgaaggagcagatgcagtactgtgtggatcacccagaagagatcagcaagcttgcaaaggtgaaagcccaagtctcagaagtcaagggtgtgatgatggaaaatatcgagaaggttcttgaccgtggagagaagattgagcttctggtggacaaaacagagaaccttcgctcccaggcccaggatttcaggactcaaggcacccaaatcaggaggaagatgtggttgcagaatatgaaggtaaaactgatagttctcggtatcatcatcgccttgattctcattatcgttctatccgcttgtggtggcttcaattgtggcaagtgaaaaaaaaaattacatctwtgcattggggggcattttaggacggtmwaaatctcrattcatggtaaaaaarattcakggcttagttgtttgtcccatgtttatttgtttgctgcttgatttswtttgttagtatcttttgggtgacacgaggggccttatc

SEQ ID NO: 456 - DNA, 797 bp, Centaurea maculosa
gcgggggatcgccggcgattggagagagaaggtgtgtgttttgtgtgtagtgtgtgtttttgatagatatcatggggcaacagtcgttgatctacggttttgttgcgagagggacggtgatcctggccgaattcacggaattcaccggtaattttacgaatatcgctgctcagtgtctccagaagcttcctgctaccaataacaagttcacctactcttgcgatggccacacgtttaactatctcgttgaagatggattcacatactgtgtggttgctgtcgaagccgttggtcggcagattccgattgcttgcctcgagagaatcaaggatgaatttaccaagaagtacggtggagggaaagctgcaaccgctgttgccaatagtctcaataaggaatttggttctaagctgaaggagcagatgcagtattgtgtggaccatccagaagagatcagcaagctttcaaaggtgaaggcccaagtttcagaagtcaaaggtgttatgatggagaacattgagaaggttcttgaccgtggagagaagatcgagcttttggttgataaatctgagaaccttcactctcaggcacaaggttttcggacggcgggaactcagttgagaaggaagatgtggtttcagaatatgaaggttaaactgatagttttaggaatcttgattgcactcatcctcatcatagttctatctgcttgtcatggctttaaatgtggcaagtgaagtctatcttttattttctttttgtttttttcttcaccataaaaaccacttatattcagc

SEQ ID NO: 457 - DNA, 1167 bp, Castanea mollissima
ctaaatataagtaatttcacaacagaaacagcttattattattacaccaaaccttatattttttctttctcgcagcgtttgctttcaaattctgcaattggtttgttttggattagggttagggtttgggtttgaattctagataaatagagagaggaaaaaaagatggggcagcaatctctgatctacagcttcgtggctcgaggcacggtgattctggcggagtacacggagttcaccggaaatttcacgagcatcgcttcccaatgcctccagaagcttccggcttccaacaacaagttcacctacaactgtgacggccacaccttcaattacctcgtcgaaaatggcttcacctattgtgtggttgctgttgaatctgctggtagacagattcccattgcctttttggagcgagttaaggaagatttcaacaagagatatggtggagggaaagctgcaactgctgttgccaacagcctcaataaagagtttgggtccaaactgaaggagcacatgcagtattgtgtggatcatcctgaagagataagcaagcttgcgaaagtgaaggctcaggtttctgaagtcaagggtgttatgatggaaaatattgagaaggttcttgaccgtggtgagaagattgagctgctggtggataaaactgagaaccttcgctcacaggcacaagattttaggcaacagggaaccaaaatgagaaggaagatgtggcttcagaatatgaagataaaattgattgttttgggtatcatcattgccttgattcttatcattgttttgtctgtttgccatggcttcaaatgttaaattggcttggaacttcccagaggcttcactgctgtcatcttactgatttggactgtcttggtagattccattccaccttgcagatcctttctcttgggtctttgatcttttaggttatacctaccttcttctgctagccttttaggattggggagcatttgtattttggattggttgtataggtaatatgcttcgactcctgcaagtagataaattttctatatgttctgtgttgtggattttttgtttaaggtgtattgaaggaatattttgatgcctgcaatggtatgtactctcggaatgttttcaatatatatatgtctcattgtttttgttcgtaat

SEQ ID NO: 458 - DNA, 1005 bp, Castanea mollissima
tctctctctttctttctctctctctctctcgctgtgaatttatcagaaaaccctaaaactctctgatcaaaatttccagctgctgctgagagaaaaaaaaaggaagagagatgagccagaagcctttgatctacgcattcgtggctcgcggaactgtgatcctctccgagtacaccgaattcagcggcaatttcaactccatcgctttccaatgcctccagaagcttccttccaccaacaacaagttcacctacaactgcgatgctcacaccttcaattacctcgtcgataacggcttcacatattgtgttgttgcagatgaatcggttgggcgacaggtgcccatggcttttctggagcgcatcaaagatgatttcgtgtcaagatacagtgctggaaaggctgatacagctcaagccaacagccttaacaaggaatttggaccaaaattgaaggaacacatgcagtactgtgttgatcaccctgaagagattagcaagcttgcaaaggtcaaagctcaagtatcggaagttaaaggtgttatgatggaaaatattgaaaaggttttagatagaggtgaaaagatagagcttctggtggataagactgagaatcttcatcaacaggcacaggactttcggacctctggcacaaaaatccggaggaaaatgtggctgcagaatatgaagatcaagctgattgttttgggaattctgatagcgttgatccttatcattgtcctctctatttgccatgggttcaactgtgcaaaaaaataagctgcttgccagaggcttttgtcttgtttattaaatcttgcaattatatatcaagagaaatattatatatgtatatgtcatgacttggtatgtagttcaatctagcaacttccagatactcagcacgaagtgaatttatttttgtgtgaacgaaccctacaagttctttttatgtcacagaatgcttttccataaatatagtttgcttgattgccttgaagcttaa

SEQ ID NO: 459 - DNA, 893 bp, Cichorium intybus
tctgttatttactggcggcggtgctcattgaccgtttttgtaatcgtcggagacacagaaagaggttattatgggacaacagtcgytgatctcagtttcgtggctagaggaacggtgattctgtcggagtacacggaattcaccggcaatttcactascatcgctgctcagtgcctccagaagcttcctgccaccaacaacaagttcacctacaactgcgacggccacaccttcaactaccttgtcgaagatggatacacatactgtgttgttgcggttgaatccatyggcagacaggttccaatagcttttcttgagcgcatcaaggaggacttcaccaagaaatatggtggtggraaagctgcaacagctattgccaacagtctcaacaaagaattcggtcccaaacttaaggaacaaatgcagtattgtgtggaccatccagaagagatcagtaagctytcaaaggtcaaagctcaggtttcagaagtcaaaggtgtgatgatggaaaacatcgagaaggttcttgaccgtggagagaagattgagattctggttgataaaacagagaaccttcgttctcaggcccaagattttaggacwgggggtactcagttgagaaggaaaatgtggttgcagaatatgaagataaaactgattgttcttggaatcattatcgccttgattctgataattgttctatcggtttgtggaggcttcaattgtggcaagtgaagcaaaaattatattttgatgattcamaaaccttgttctttcattttgattcttgttctttttggttactgattcttacatatgaggaggtttatactttatattgtgagaccatatttgtataggttgttgtacctttatgtactttttaatacgcg

SEQ ID NO: 460 - DNA, 1027 bp, Cichorium intybus
gcgggggagtgtcccttcaggcttcactttctttctctagaaactcccccctccctctctctctctctttctacacacgcgcatcattcaccggagggatggggcaacagtcgttgatctacagtttcgtcgccagaggaacggtgatcctctccgagtatacggagttcaccggaaatttcactagtatcgctgcacagtgtctccagaagcttcctgctacgaacaacaagtttacctacaactgcgatggtcacaccttcaactaccttgttgcagatggattcacatactgtgttgtcgccgttgaatctgttggtagacaggttccaatggcttttctggagcgagtgaaggaggatttcactaagaaatatggaggtgggaaagctgctacagctgctgcaaatagtctgaacaaagaatttggtcccaagctgaaggaacagatgcagtattgtgtagacaatccagaagaaatcagcaagcttgcaaaggtcaaagcccaggtttcagaagtcaagggtgtgatgatggaaaatattgaaaaggttcttgaccgtggagaaaagatcgagcttctggtggataaaacagagaacctccgctctcaggcacaagattttaggacgcaaggcacacagataaggaggaaaatgtggttgcagaacatgaagataaagctgatagttcttggaatcatcattgctttgattctgattatagttctatcagcttgtggcggcttcaactgtggcaagtgaagtacgtgtttgcttcagggatttaggatggtaaaaatctctcattcatgraaaaaaaaaaasgactcttggctttgtcgtcccatgtttatttgtttgccgatgctttttcttyttgtktgwtagttwtttttwtgagggwgacatagagcctatctyttgarytctatattgtgatatagtggttgtatagtttgtactttttaagtaccattgtcatccatatcttattagggaaacaatttgattggtgttttgcaaaa

SEQ ID NO: 461 - DNA, 1256 bp, Cichorium intybus
  misc_feature (1034)..(1034): n is a, c, g, or t
atttctccagcggttctcttccggccggtacgattttatacttcaaaagagggttttgtagatcagtcttcttataatcatcatcatcatggggcaacaatcgttgatctatagttttgtgtccagagggaccgtgattcttgctgagtacacagagttcaccggaaatttcacgtctattgcttcccagtgcctccagaagcttcccgcaactaacaataagttcacacacaactgcgacggacacacctttaattaccttgttgaagatggcttcacatactgtgttgtggctgctgaatctactggccgacaagttcccatggcttttcttgagcgaaccaaggatgaatttaacaagaaatatagtggtgggaaagctgctacagctgctgccaatagtctcaacaaagaattcgggcctaagctgaaggagcagatgcagtattgtgtggaccatcccgaagaaatcagcaagctttcaaaggtgaaagcccaggtttcagaagtcaaaggtgtgatgatggagaacattgaaaaggttttggatcgtggtgagaagatagagctccttgtggataaaacagagaatcttcgctctcaggcgcaagattttrggacacaaggtacacaaataaggaggaagatgtggctgcaaaatatgaagataaaattaatagttcttggaatcatcattgctttgattctaatatagttctctcggtgtgtggcggcttcaattgtggcagtgaagtacgataagtatatatatcgtaaaacttgtttatttgtccttttctttttatgtttttgtttgtgttacggaatgctattaaaaagcgtattatgttgcgagactgtctgtatattttgtacttccatgactaggggaaacaacttgattgctctttcgtcttttaagttttaagttttagtagaataaattttaaatgtttgtaagaggctaagaagttgttgctgttacaaactaaaatggaggtcaggaatgcgatttgaaatagtggttttcgctnaaaatagtgagatacagttacaagtagccgachtctagcttggttttttgtttttttgaatgaactttccagtgattggagaaaatttggggcatctattgaggtaawawyswtaratswwttgggacgacttttgtgttacacatgttggtttagatgtcttatatgaggcgggtgtggtcctctatgttgtagtaatcagaaaatggtatttatagagtc

SEQ ID NO: 462 - DNA, 1158 bp, Citrus sinensis
ccaactttactcttccttctctctctctctctctctctctctctcgcgtaaaaaagcaaagcatagcaacaaacaaaattggagaggagagagagacctcttggagctttaaaacaaaataaaaaataaaaacaagcccagatctcatctcatctcaactcgactcaattagtctcatcaaaatgagccagaaatcgctgatctacgccttcgtggcgcgcggaaatgttgtgcttgctgagtacactgagttcagtggcaatttcaactccatagcctatcagtgcctccagaaactccctgcttccaacaacaagttcacttacaactgtgatgctcacaccttcaattatctcgtcgataatggttacacatattgtgtggtcgcagatgaatcgtccggaagacaaataccgatggcttttctggagcgcgtcaaggatgaatttgtttccaaatatgggggtggaaaggctgccacggctcctgccaatggcctgaacaaggaatttggaccaaaattgaaagaacttatgcagtactgtgttgatcatcctgaggagatcagcaagcttgcgaaggttaaggctcaggtttcagaagtcaaaggtgttatgatggagaatattgaaaaggttttagataggggggaaaagattgagctactggtcgataagactgagaaccttcatcagcaggcacaagactttcggagtacggggaccaaaatgcggaggaaaatgtggctgcaaaatatgaagatcaagctgattgttttgggaatactgattgccttgatcctcatcatagtcctctctgtttgccatggtttcaactgcggaaaatgagtgctattctccaggaggcttatattacgctcttctaagagcttctgtgatgatattgtgaaagagatatataaatatatatgatcttgactttgtatttagtctaaaaaagttagcagtttccctatatttgttacaaagaaaaccgaaaacttatttttgcttgtgaatgagtcccgtcattatattgtgagaatgcttgtgcaaagatgctgctgctgattataccggccagaactaaaataggccttcttagctagcttcgaatttgctgaatttgtgtggaagtagcttaactttcccagtattc

SEQ ID NO: 463 - DNA, 1114 bp, Citrus sinensis
ccacgcgtccggaggtcgcgtggcatttccgttaattcacctgaacgcggagggtggctattagctaaacaacaactcacaaaaaacgccagaattttgcttcccctctaagcaaaaacgaaaattcgctcctgtttctcacataaaatcactcaattgattcattttcaataacaacaacaacaaccattttctctctctctctctcttcgttcttctctctctctcaggattagggtttgttcttgttgttgtggtcgtattagtagtagttgttttttatcagaaaaatgggacagcaatcgttgatctacagcttcgtggctcgaggaacggtgatactagctgagtacacggagttcaccggaaacttcaccggcatagctgctcagtgtctccagaaacttccttctagtaacaacaagttcacttacaattgcgacggccacacttttaactacctcgttgatgacggcttcacttactgtgtggttgcagttgaatctgttggtcgacaggttccaattgccttccttgagcgtgtgaaagaggattttacaaagagatatggtggaggaaaagctgcaacagcrgtcgctaacggcttgaacaaggagtttgggcccaaattgaaggagcatatgcagtactgcatcgatcatccagaggagatcagcaagcttgctaaagtgaaggctcaggtgtcagaagtcaaaggtgttatgatggataacatagagaaggttcttgatcgtggagagaaaattgagcttctggtggatagaacagagaatcttcgctcacaggcgcaggatttcagacagcagggaacccagatgaggagaaagatgtggtttcagaacatgaagatmaaactgattgttctgggaatcataattgccttgattctcatcatagtattatctgtatgcggtggcttcaattgttgatgatacttcgtactctattagtattgttgctgcttgtcaactgtttcttgatgtgtttactcgtaattttgtccgttctcacaagaccaatgcttgtatagtctgtattttttgaattgttctgataacaaatttcttgatgtgtggaagtttgtctttccatt

SEQ ID NO: 464 - DNA, 1069 bp, Citrus sinensis
cgcaaatctagcatttctttagtttccctctctccgatcccacgggttagggttttgaggatgggccaacagtcgttgatctatagcttcgtggctcgaggcacggtgatcctcgccgagtacactgagttcaccggtaatttcacgagcatcgcatcgcaatgtctccagaaacttcccgctaccaataacaagttcacctacaactgcgatggccacaccttcaattacctcgttgagaacggcttcacctattgtgtggttgctgttgaatctgctggcaggcaaattccaattgcctttctggagcgagttaaggaggatttcaacaagagatatggtggaggaaaagctgcaacggctgttgcaaatagcctgaacaaagagtttgggtctaaactaaaggagcacatgcagtattgtgtggatcatcctgaagagatcagcaagcttgccaaagtcaaagctcaggtttctgaagtcaagggggttatgatggaaaatattgagaaggttcttgatcgtggtgagaagattgagctgctggttgacaaaactgagaaccttcggtcacaggcacaagatttccgacaacaggggacgaagatgagaaggaagatgtggatccagaatatgaagattaaattgatcgttttgggtatcatcatcgcattgatccttatcatcgttctgtcagtttgccatggcttcaaatgttgatttggtcttggaaagtccctggaaactgtgctttgctgtcccgctgacatggtcgacttggtacattggccacatcttttgatccttgcatctctctcgcttgtttttgtttaagtttttttttttttcccctcttttaggtcatcatgcccttacttgccccttggcaagggaatgaatttgtatcttttcgattgcttgtataggttatatgcttgaactcctcgaaatagataaatatcttatgctgcctgctgttgtctatgctgcctgctgctttatgtggattttagtttaagatgtaatggaaacatagttggatacctgcagaattgatcattcctttggc

SEQ ID NO: 465 - DNA, 1154 bp, Coffea canephora
tacaaaaatcaaactcgatccaatcctctccccgcatcgtcacgcttcctctatttctttttctctcgcgatttatcctcttttcatttgtttgcccctctctctttcttcgctcactttctctctctagattccgaagaggcctgctagggtttttgtgagggagttacccgagagagagaagagtgaaaatggggcagcagtcgttgatctacagcttcgtcgcccgaggaacggtgatcttagccgagtacactgagttcactggaaatttcaccagcatagcatcgcagtgccttcagaaacttccggccacgaacaacaagttcacctataactgcgatggtcacacttttaactacctcgtcgaagacggcttcacatattgtgttgttgctgtggaatctgttgggagacagcttccaatagcttttctggagcggataaaggaggattttaccaagaaatatggcggtgggaaagctgctactgctgttgctaatagtcttaacagagaatttgggcccaaactgaaggaacagatgcaatactgtgtggatcatccagaggagatcagcaagctttcaaaagtaaaggctcaggtttcaraagtcaaaggggtgatgatggaaaacattgagaaggttcttgatcgtggagagaagattgagcttctggttgataaaactgagaatcttcgatctcaggcacaagatttcaggacacagggaaccaagatgaggaggaaaatgtggttacagaatatgaagataaagcttattgtcctgggcattatcattgctttgattcttattattgtgttgtccgtgtgtggtggcgtcaaatgtcattgatttggttgtgctatggtttttgttaggctggtgattgacggagaacttgtgctgctttcttgatatcataacatagcgttatgtttacgtataaatttttggtggcccttgcctacccatttgatagggatggtactctgagacatgcttgtatagtctgtatttctgaattcgttgaatatattagaagagtccggaatgttttcaggaaaaatatgatgatggttcatgcgcctgtatttttgaatttattgcgtgctcatggtatcaactaaataattacaatgcttgcgttaaatt

SEQ ID NO: 466 - DNA, 1091 bp, Coffea canephora
gtctctctctctctctacaaaagaactagagagagaagcaacgacgactgtactgtccacatctagtcagcacccaatttcatacgctcttcgtctggtctctttctctctccctttctactttgattaatcgctaagcaaaatcacaaatattcaccgaacaaacacaagatacgccgatttttcacactttcagctacaaaatcgattggatcgagtagtattttggagcagaaatggcagcgaagcagaagtcgtcgttgatctacgcgttcgtggctcgaggaccggtggttttggcggagcacacagatttcagcggcaacttcaattctattgcgtatcagtgtctccagaagctgccggctaacagcaacaataataagttcacctttaattgcgatgcgcatacttttaattatctcgtcgacaatggctttacatattgtgtggttgctgaagaatcagctggaagacagatccccatagcttttctggagcgtgtcaaggatgactttgtatccaagtatggcggtgggaaggctacaacagctccagccaatgggcttaataaggaatttggtccaaagttgaaggaccatatgaagtattgcatggatcatccagaggagataagcaaacttgctaaagtcaaagctcaggtttctgaagttaaaggtgttatgatggaaaacattgagaaggttcttgatcgtggggaaaagatagaacttctggtggataagactgagaaccttcatcagcaggctcaggatttcaggaccacaggaaccaaaatgcgaaggaaaatgtggtygcagawcatkaakgtcaagttgaytgygttasctattgtgattgccttsattctcattataatcctttctgcctgyaaggggttcaattgyggaamgtgagcatatgttagygatgatggtgaatttatggaaagcacagctctgtactgtttttactatcgaatgattgsaatgatgtttttcctaagcctgttattatgtatatgcatcaagggacaagcaatttccagatattggcgaattgataaatctgttttttgggcagtagagcta

SEQ ID NO: 467 - DNA, 1214 bp, Gossypium hirsutum
ccggatcggatctacactgaataaagatcmcykrwkaccttagcttctcatctaagcgaaaaagacaaaggaaagtctccttcctttccatttctttttccttttccaaaaacctccgatacttcctctctccctttcctccgattccatatctctctctctttctgctagggtttgggagttagtgaagaaggggttgttatttcatggggcaacaatcgttgatctacgccttcgtggcacgaggcaccgtggtcttagccgactatacggagttcaccggaaacttcaccggcatagcttctcagtgtctccagaaacttccttcttcaaacaacaagttcacttacaactgcgatggccatacctttaactatctcgtcgataacggcttcacttattgtgtggttgctattgaatccgttggcagacaggttcctatggcatttcttgagagaattaaagaggatttcaccaagagatatggtggaggaaaagctgcagctgcccctgcaaacagcctgagcaaggagtttgggccaaaattaaaggagcatatgcagtattgcattgatcatcctgaggagatcagtaagattgccaaagtgaaagctcaagtttcagaagttaaaggagttatgatggaaaacattgagaaggttctggaccgtggtgagagaattgagcttctggtggatagaacagaaaatcttcgctctcaggcacaagatttccggcagcagggaacccagatgaggagaaagatgtggttacagaacatgaaggtaaagcttatagttctcggaatcttggtcgctttgatcctcatcattgtactgtctgtttgtcacggcttcaaatgttcatgaattgyatgtscgctctacattccatcggcaactcccagatcagaattattgcaatcacaagtaatgtctaatgcttcttctagttagatttcttttctttttttgtgaaattacatgtgggtyatgtataaccatatcagaagactgcatttagaatataagtttgtgtttctggatccttttgatagtagtaagtttgttgamgtgtggaaatatgattaagcatctttggaaaattaatcttgattaagttcctataatcaagcctttggattttctataacgtttctgataatatatttcatattatgtatacatattttattgtctgtcttcttccggcca

SEQ ID NO: 468 - DNA, 989 bp, Gossypium hirsutum
  misc_feature (2)..(2): n is a, c, g, or t
gnttcggcacgagagactagtcagttttctatatcttctcggatcccatcgaccctcctaagtcatctctcactgatttcaacctttgcggatttgaatcctttgcttgagggttagggttttgagagatggggcaacagtctttgatctacagcttcgtggcgcgtggaactgtgatactcgccgagtacaccgagttcaccggtaatttcaccggtatcgccgctcaatgtctccagaaactccctgcttctaacaacaagttcacctatacctgcgatggccataccttcaattacctcgttgaagatggattcacctactgtgtagttgctgttgaatctgctggcaggcaagttccaattgcatttctggaaagagttaaggaagacttcaacaagagatatggtggaggaaaggctgcaactgctacggccaaaagtctgaatagagaatttgggtccaaattgaaggagcatatgcagtactgtgtggaccatcctgaagaaatcagcaaacttgctaaagtgaaggctcaggtttctgaagtcaagggtgttatgatggaaaacatcgagaaggtccttgaccgtggtgagaagattgagttgctggtggataaaactgagaaccttcgctcacaggcccaagattttaggcagcagggaacaaagatgagaagaaagatgtggcttcagaatatgaagataaaattgatcgttctgggtatcctgattgccttgattcttatcattgtgctgtctgtctgccatggcttcawttgtwaaaatctgtcttggatttcccttkktctgctttttgctgccttgctgactggagtctcgatagattggtttgktttactttgtgttttaggtcgcatatttctcccttcgcttgccatatagtaggatagagggagactttgtatcttggttgattgtataggttataagttcattgaaggatttcttctctcatgttgtaat

SEQ ID NO: 469 - DNA, 1345 bp, Gossypium hirsutum
agaaaagcaacaaatgagtcattcttgagagaagaatacgagaaacagagagcctctgaaatcccagatctctctttggaacccatatttctaaggaaaatggtgcacaaatcgttgatctatgcatttgtatctcgtggggaagttatcttagcagaatatactgaattcagtggtaatttcaattccatagcttttcaatgcctccaaaagcttccttcttccaacaacaagttcacttacaactgtgatggccacaccttcaattaccttgttgacaatggctacacatattgtgttgttgcagatgaatcagctggaaggcaagtaccgattgcttttttggagcgtgtcaaggaggactttgtgtcaaaatatggtagtggaaaggctgctactgctcctgccaacagcctgaacaaggaatttgggccaaaactaaaagaacatatgcagtattgtgttgagcatcctgaagaaataagcaagcttgctaagatcaaatctcaggtttctgaagtcaaaggtgttatgatggagaacatagagaaggtgttggatagaggggaaaagatagagctgctagtggataaaacagagaatcttcatcagcaggctcaagacttccggaatactgggacgaaaatccgaagaaaaatgtggctacaaaacatgaagatcaagctgattgttctaggaatattgattgcattgatcctcatcattgtcctctctgtttgccatggtttcaactgtggtggaaaatgagtgccatctttattaggcttattattagagttttcaccagagctattatgataatattgtgatgaaaagatcaaaaaatatataatatgatttcatatgctatatataagattagcaatcaccagatgtttggtgcaagatatttttggatgtgagcaaaccctgtaagtgattattgcaattcatgaaattgttttctgcaacaaaaaaaaaaaaaaaaaaaaaaaacctcgagaatacttctaaaaaggcccggcggccccttcatttttccaccccgggtgggggtaacccggtaaggggtacccaaatttcccccctataaggggaattcggatattacaatttcccggggccccgccccttttttaaaaaccgcccttgaactggggaaaaaaccccgggggggttatccccaaatttatattcccccctttggaaacccaataccccccctttttccccccaactctgggggaaataataaacccaaaaaaaaggccccccccccccccaatatcccccccctttctccccaacaaaagttgttcgcccccacaccccctcgggaagaggg

SEQ ID NO: 470 - DNA, 1001 bp, Gossypium hirsutum
ggcacgagaaaagggraaaggaaacaactctccttccttccgacgataaaaacccttccccttcctcttgctcttcatttcaattcattcttccttagtcaaaggactgtgatggggcaacaatcgctgatctacgccttcgtggcacgaggcaccgtcgttttagccgactacaccgagttctccggcaacttcacctccattgcttctcagtgcctccagaaacttcctgcttccaacaacaagttcacttacaactgcgacggccatacctttaactatctcgttgataacggctttacttactgtgtggttgctgttgaatccgctgggcgacaggtgccaattgcctttcttgagagaattaaggaggattttaccaagagatatggtggaggaaaagctgcagctgctcctgcaaacagcttgagcaaggagtttgggccaaagttgaaggagcatatgcagtattgcattgatcatccagaggaggttagtaagattgccaaagtgaaagctcaagtttcagaagtcaaaggagttatgatggaaaacattgagaaggttctggaccgtggtgaaaaaattgagcttttggtggataaatcagaaaatcttcgctcccaggcacaagatttcaggcagcagggaacccagatgaggagaaagatgtggttacagaacatgaaaataaagctgatcgtgctcgggattctgatcgcgttgattctcatcatcgtactgtctgtctgtcatggcttcaactgttgatgaatcgctcagttgctatattctattcatttgcccactcattgatcggtgttgtagctgtcaccagtaatattgatgctcctcatagttagcagttacagttttctttaattccacgtccttttatgctgtagcctaatatcagaagactctctgcatatatactgagattcgaactatggaaattgaattttgaaatatataaaaatatcaaataaggtactttcaaa

SEQ ID NO: 471 - DNA, 1341 bp, Gossypium hirsutum
cgcgctgcaggtgacctagtggatcaaagaattcggcacgagggaaaaagcaatagaaaagagcaagcaagcttcaaatcccagatctctctttgttttctctttgaaacccaaattttcccatataagaaaagmttctgagaaaatggtgcccaaatcattgatctatgcatttgtatctcgtggaggagttatattagctgagtatactgaatacagtgggaatttcaattccatagctcttcaatgcctccaaaagcttccttcttcaaacaacaagttcacttacaactgtgatggccataccttcaattatcttgttgacaatggatacacttattgcgttgttgcagatgagtcagctggaaggcaagtgccgattgcttttttggagcgtatcaaggatgatttcgtgtcgaaatatgataacgggaaggctgctacagctcctgccaacagcctgaacaaggaatttgggccaaaactgaaagaacatatgcaatactgtatggagcatcctgaagaaataagcaagctggctaaggtcaaagctcaggtttctgaagttaaaggtgttatgatggagaacatcgaaaaggtgttagatagaggggaaaagatagagctgctagtggataagactgagaatcttcataatcaggctcaagactttcgaagtacagggacaaaaatccgaagaaaaatgtggctacaaaacatgaagatcaagctgattgttctaggaatacttattgccttgatccttatcattgtcctctctgtttgccatggtttcaactgtggcaaaaaataaatgctattcttagaaggctttattagctttcaccacagcttttgtgatataatattgtgagggaaagtttaaaatacatgcatatatattatatatactttatatgtcataaaagacttaacatttagcaatcaccaggtgactggtgcaagttatttttttttgtgaacaaaacccctataattttttatttggttaaatgaatattgctgcttgcaacccaaaaaaaaaaaaaaaaaaaaaactccgaaggagaacctttctaaaagcggcgccccggggccccatcccaattttcccaccccggggggggggggtaccccaggtaaagtggtaccccaatttcccccctataaagggaactccgtaattaaaaatttccactgggcccggccctttttttaaaacgcctcctggaagtgggggaaaaaacccctggggcggtttaaccccaaattttaaatcccccccctttgctaaaccacccaactccccccccccttttttctccccccgcccgggggggg

SEQ ID NO: 472 - DNA, 1192 bp, Vigna unguiculata
aaaccaaacacacttcttctccctcttttcaacgttctgtacagcggaagaacgaaccctttactcgttcttcttccgcgctttctctccccacaaccgctgctgccggttgtttcgttctttctctcttctcaacctgccacgtcaccttcttctcggagtcgcgcggcgttgatcgttctgctaccgttgtggttccggcgatgggacaacaatcgttgatctacagtttcgtcgctcgcggcaccgtgatcctcgccgagtataccgagttcacgggaaactttacgggcgtggcggcgcaatgcctccagaaactcccttcctctaacaacaagttcacctacaactgcgatggccacaccttcaactacctcgtcgataacggattcacgtattgtgtggttgctgttgaatctgctggacggcagattccaattgctttcctggaacaaatcaaggaggatttcaccaaaaaatatgctggaggaaaagcagcaacagccgccgcccagagcctcaacagagagtttggacctaagttgaaggagcagatgcagtactgtgttgatcatccagaggaaattagcaagcttgctaaagtgaaagctcaggtgtcagaagtcaaaggagttatgatggaaaatattgagaaggttcttgatcgtggggagaaaattgagcttttggtggataaaacagagaatcttcgttctcaggctcaggatttcaggcaacagggaaccaagattaggagaaagatgtggttccaaaacatgaagataaagctaatagttctgggtatcttaattgccttgattctcattattgttctgtccgtttgtggtggcttccactgtggtaaatgagtcttcccactttctggctcctcactccatatcattgttactagcagattgccattgtgcgcgtagtgtcgacatggtgcttttcacttactttttgggatttacattcttcgaaatttgattatcaatattacatggcattgcttgtatagtgtgtaatgctagttttccattttctatagtttaggtgggagtttaatcatttggttttgaagattatgctgttttatttatgataagaaaccaacctttacgtagttgagcttcttattaccatattttaatgtgctaattttaaaaccaaatgattaaactcccaccta

SEQ ID NO: 473 - DNA, 1159 bp, Vigna unguiculata
ggaccgctttggtaaactctctttctctgttctcctttgcctcttcctttctctctctggacaaatcccaaacaaagcgtgtgtgtttgtgtgagagaagaatttcgatttggatgttagactgagcaaaagcgtgacaaaatcaccaccgcggaactgttctcagatctctcacttgcggcaacgaactccaaaaccctaccgaacactcaatttagattctcatccatggggcagaagtctctgatctacgcgttcgtgtctcgtggaacggtgattctcgcggagtacactgaattcagcggaaacttcaactccatcgccttccagtgtcttcagaagcttcctgccactaacaacaagttcacctacaactgcgacgctcacaccttcaattacctcgtcgacaatggctacacatattgtattgttgctgatgaatcaattggaaggcaagtgcccatggcttttttagagcgtgtcaaagatgattttgtgtcaaaatatggtggaggaagggccgccacagctcctgcgaacagccttaacaaggaatttgggccaaagttgaaggaacatatgcagtactgtgttgatcatcccgaagaggtcaacaaacttgcgaaggtgaaagctcaggtttctgaagttaaaggtgtcatgatggagaatattgaaaaggttctggacaggggtgaaaaaatagagcttcttgtggataagacagagaaccttcataaccaggcacaggatttcaggacttctggaaccagaatccgtcgaaaaatgtggctacaaaacatgaagataaagctaattgtcctgggaattttgatagcactgatccttataatagtcctatctgtgtgtcatgggttcaattgtgggaaataggcaccattctccgatgccctttatcatgttatttcaagcttgagattatatgaggaaagatcctaatgatggcatgagtttgtatgtaatatagttatagatatagataaaggtcatatgttggtcgctttgttctacttataaatgctttgatctacttataaattgggttgtcgatttgaagttcagtttccattttattcggtcatcaatcatgtaaatgtgttattcgatcttattctttctaatgattccatttacacca

SEQ ID NO: 474 - DNA, 1130 bp, Vigna unguiculata
ggactcatcatttctcttccttcctacattctctctctaaaaagaaaggaaaagaaaagaaaagaaagggaaagaaaaagaagagagtgtaggtggagagagtgcgcactgcagacagatctgggagaagacgatgggacacaaccagaaccagagatctctgatctacgcgttcgtctctcgcggcaccgtgattcttgcggagtacaccgaattcagcggcaacttcaacaccatcgcttttcagtgcctccagaagctccctgcctccaacaataaattcacctacaactgcgacggccacaccttcaattacctcgtcgacaacggattcacgtattgtgttgttgcggatgagtcgattgggagacaggtgcctgtggcttttctggagcgcgtgaaggatgattttattgctaagtacggcggtgggaaggcggcgacggcagccgccaacagcctcaacaaggaattcgggtccaagttgaaggagcatatgcagtactgtgtcgagcaccctgaagagataagcaagcttgctaaggtgaaagctcaggtttctgaagttaaaggtgtcatgatggagaacattgaaaaggttctggacagaggggaaaagatagagcttctggtagacaagactgaaaatcttcatcaccaggcacaagacttcaggaattctgggaccaaaatccgtagaaaaatgtggctgcaaaacatgaagataaagctgattgtgttggcaattttgatagccctgatcctcataatagtgctctctgtttgccgtgggttcaattgtggaaaataagcacggagtcatttgacgttgttgtgattatatgtgaggaaaagatgtggaatgaatggatgacatgattttgtatgtagtaaaaatatgggatctcttatatttttcattttaaggattttacagtaccatataagaatgcttttggaaatattaatttgtttgtcaattgtagttccattttcattcactccacccatcttctcatcatcattcttgtaattttacttatttagagttcacaccagttcagtgcaagttcaactattttccaatcgcacttcgaattcaataaaatgctatatattttctttctgca

SEQ ID NO: 475 - DNA, 1221 bp, Cycas rumphii
tggatccaaagaattggacgaggcttgaatttcggagcgaaggtggggtggacggggccagggggatgggtttgacatctgccagggcatttcctatgcatttgtagggcatttcctatgcatttgtagggcatttggggcaatttccctttccagagtcccgattgaacaaggaatgcgtcaagacttccacggctccccacaagagattttcttcccttctagaaggactgttcagttccatcttcaattattactcgcccaccctctgcatttctcgtttcatttgttgaagaacccacagatctgaggattcagtgcacggattttggtagggttgtttcagaatggggcagcaatctctcatatacagttttgttgcaaggggcaccgtggtcctggcagagtacacggaattcacgggcaattttacaagcattgccgctcagtgcctgcaaaagcttccggccagcaataataaattcacatacaactgtgataaccacacttttaactaccttgttgaagatggtttcacatattgtgttgttgcagctgaatcggttgggagacaagtaccaatagccttcctagagcgtgtcaaggaggattttaagaggagatatggaggtggaaaagctgacactgctgctgcccatggccttaataaggattttggatcaaaattgaaggagcatatgcaatattgtgttgaccacccagaagagatcagcaaacttgcgaaagtgaaggctcaggtttcagaagttaaaggtgttatgatggagaatatagaaaaggtccttgatcgtggtgagaagattgaacttctggttgataaaacagagaaccttcgttttcaggcccaggatttccaaaagcagggtacacagttacgcaggaaaatgtggttccagaatatgaaagttaagctgattgtcctcgggatattggttgccttgattcttataatagttctttctgtatgccacggattcaagtgttgacagtgttacaaaacattctagtccatttggactgattagcttttgtttggctgtgggtatcatttattgtgttataatccttatatatgtgggtttcaggtgacataattttgtgctgtttttatagaggatgtttgacttggcacagttataacttcatggtacatactaattagtatggcggtggtaacatggattttcacacttttggtgc

SEQ ID NO: 476 - DNA, 940 bp, Cynara scolymus
ttttgattgaattcgaaggatttcgtcaaagagttcccttcagcctactatttcgaaaacccaaaatctctttttccccaaaatcagatcttccatttctccaagcgcrgggttttctactccgaaagggttttgtagatcaatattgttagaatcaycatgggccaacagtctttgatctacagtttcgtgtctagaggcaccgtgattcttgccgagtatacagagtttacaggaaatttcacttctattgcttcccagtgcctacagaagcttccggcaactaataacaagtttacttacaactgcgatggacacacctttaattaccttgttgaagatggattcacatactgtgttgttgctgctgaatctgctggcagacaagttccaatggcttttcttgagcgtaccrrggrtgactttaccaagaaatatggtggtgggaaagccgctacagctgttgccaatagtctgaacaaggaatttgggcccaagctgaaggagcagatgcagtattgtgtggatcatcctgaagaaatcagcaagctatcgaaggtaaaggcacaggtttcagaagtcaaaggtgtgatgayggagaacattgaaaaggtgttggatcgtggtgagaagattgagctccttgtggataaaacagagaaccttcgctctcaggcacaagattttaggacacaaggyacacaaatgaggargaagatgtggctgcagaatatgaagataaaactgatagttcttggaatcatcattgccttgatctcatcatagttctatcggyctgtggtggsytcaactgcggcaaatgaagcgcgtatatagctcattcatggtaaaacttccgttatctcgtttatttctgttttcccatgttttattcgtgtcggtctgctgttaaaaagcctatgttgcaagactgcctgta

SEQ ID NO: 477 - DNA, 1078 bp, Cynara scolymus
  misc_feature (983)..(983): n is a, c, g, or t
caatcttttccctttctttctttcccacaataacccctcccttggaaaatagatcagattcatacatttctccatcgtcacgtctccttcaataccctctatcagcatcgcactatccgtttctgttcaaggcgctgcttttcttactgctagggttcttacgggagtaaggttttgttgatcgtcattttcataatcttaatggggcaacagtctttgatctatagttttgtgtctagaggaaccgtgatcctctccgagtacactgaatttaccggaaatttcacttctatcgcctctcagtgcctccagaagcttcctgcaactaacaataagttcacctacaactrcgaggaacactttcattaccttgttgagatggttytacatactgtgttgttgctgccgaatctgctggcagacaggttccaatggcttttctcgagcgaattaaggaagactttaccaagaaatatggtgcagggaaagcttctacagctgttgccaatagcctgaacaaagaatttgggcctaagctgaaggagcagatgcagtattgtgttgatcatcctgaagaaatcagcaagctttcaaaggtgaaggcccaggttacagaagtcaaaggtgtgatgatggaaaacattgagaaggttctagaccgcggagagaagattgagcttcttgtggataaacggagaacctccgatctcaggcacaagattttaggacacaaggtacccagatgaggaggaagatgtggttgcmaaacatgaagataaagctgatagtyctcggtatcattatcgccttgattctcattatagtcctatcggtttgcggtggtttcaactgtggcaagtgaagcatatagacttgggcataggatcttcatctgggttttctttcggtattcttattatcattttgttgctgttttatttgccatttttggatgacacacacatacttgcattatgcagaanatacaaaaccccatgttttgggtgcctactgtatatttgtacccttaaagacatctatgatatatacttgggaaatagcttgattttgtccttcg

SEQ ID NO: 478 - DNA, 1020 bp, Taraxacum officinale
tcattttctctctcttcagactcctccccctctccctctctctctcaaacacacgcacatcattcatcggagggatggggcagcagtcgttgatctacagtttcgtcgccagaggaacggtgattctctctgagtacacggagttcaccgggaatttcactagcatcgctgcacagtgtctccagaagcttcctgctacgaacaacaagtttacctacaactgcgatggtcacaccttcaactaccttgttgcagatggattcacatactgtgttgtcgccgttgaatccgttggtagacaggttccaatggctttccttgagcgagccaaagaggatttcattaagaaatatggaggtgggaaagctgctacagctgtcgctaatagtcttaacaaagaattcggtcccagttgaaggaacagatgcagtattgtgtagaccatccagaagagatcaacaagcttgcaaaggtcaaagcccaggtgtcagaagtcaagggtgtgatgatggaaaatattgagaaggttcttgaccgtggagagaagatcgagcttttggtggataaaacagagaaccttcgctctcaggcacaagattttaggacacaaggcacacagataaggaggaagatgtggttgcagaacatgaaaattaaactgatagtycttggaatcatcattgccttgattctgatcatagttctatcagcttgtggcggcttcaactgtggcaagtaatctgcatctttgctttcgggatttaggatatggtaaaaatctctcattcatgcttatggctttgttgagtcccatgtttayttgtttgccgatgattttcttttttctttkattttcttttgattgttagtttctttttgggggtttcacagagcctatcttttcagcttttatattgtgatatagtggttgtatagtttgtacgttaatgaccccgtcttactagggaaaacaatttgattggtgtttttgtgttttttatgttttattttcttcctaaa

SEQ ID NO: 479 - DNA, 861 bp, Taraxacum officinale
tcaaatcagatcagattcttcatttcttcagcggttctcttcttcccgatactctgatctatagttttgtagatcaatcttcctataatcatcatcatcatggggcaacaatcgttgatctatagttttgtatccaggggcaccgtgattctcgcagagtacacagagttcaccggaaatttcacctctattgcttcccagtgcctccagaagcttcccgcaaccaacaataagttcacatacaactgcgatggacacacctttaattacctcgtcgaagatggattcacatactgtgttgtggctgctgaatctgctggccgacaagttcccatggctttccttgagcgaaccaaggacgacttcaacaaaaaatatagtggtggaaaagctgctacagctgttgctaatagtctgaacaaggaattcggacccaagctgaaggagcagatgcagtactgtgtagaccatcctgaagaaatcagcaagctttcaaaggtcaaagctcaggtttctgaagtcaaaggtgtgatgatggagaacattgaaaaggttttggaccggggtgaaaagatagagctccttgtggataaaacagagaatcttcgatctcaggcacaagattttaggacacaaggcacacaaataaggaggaaaatgtggctacaaaatatgaagataaaactaattgttcttggaatcatcatcgccttaattctcattatagttctctctgtttgtggtggcttcaattgtggcaagtgaagtatcattttataaatatgtcgttaaaactttgtttattttgtttttatcgggtttttttgttttaaagcagtacatatactataataaatagct

SEQ ID NO: 480 - DNA, 1374 bp, Festuca arundinacea
ggcacgaggctttttctctcttccccgtcctctctttctctccctctccacacagcctagccacgcatcgctccgccctaaccttccgagcctcyccaacaccggcgtgctccagcatccacagtcggccgcggcggcggyggagagagaaacggataggyagaagaagaggyagtaggcgagggccatggggcagcagtcgctaatctacgcgttcgtggcgcgcggcgcggtggtgctggcagagtacacggagttcaccggcaacttcaccaccatcgccgcgcaatgcctccagaagctcccctccagcaacaacaagttcacctacaactgcgacggccacaccttcaactacctcgtcgaggacggcttcacatactgtgtggttgctgttgaatctgttgggcggcaaacccccattgctttcctggacagagttaaggatgattttaccaaaaaatatggtggtgggaaggcagcaactgctggagcaagcagcctcaaccgagagtttggatcaaaacttaaggagcacatgcagtactgtgctgacaaccccgaggagatcaacaagcttgctaaggttaaagcccaagtttcggaggtcaaaggagttatgatggaaaacattgagaaggttcttgaccgtggcgagaagattgaactgctcgttgacaaaactgaaaacctacgttctcaggcacaagatttcagacagcagggcacacaggtgcggaggaagatgtggctacagaatatgaagatcaagctcatcgttctgggcatcatcatcgcgctcattctcatcatcatcctgtcagtgtgccatggcttcaaatgcaacaagtgaggatctgacttgagatcgccttttgctttgccctattaatacgtcctacttctggcgaaaaagaagagcgtgtggtctttgttctgcgtgagtcgtcgtcctcctgtcctgattcttggtggtcatagtgtgtccctgatgttgttgctgattgctgtgttggatagtgactgggtttatgaggtcgagagtatcctgtatttttgggtgctattgatgtatagattgtctgctacgtttacgccagaaaaagttgtcatagcgaaataatatattcactccatctgattaaaaaaaaaaaaaaaaaaaaaaaaaaaaggacccgccggccttccatggagtttgtgtagcaggtgcctcgatcccgccaccgtctcggagcccctgttgttcatctacttcggctgttgttcgactacttcctctacagccgagggtgagctaaacttccatctcctcctccgttgtttacttatgtcactaacttgcaggcgatgaccgagtattgtatgtgtggcact

SEQ ID NO: 481 - DNA, 967 bp, Zingiber officinale
cgagatcggcagtatcttccacatccatctcgcttcgatcgatctrgratttkggagaasmgagatggggcagcagtcgctgatctatagtttcgtcgcccgggggacggtgatcctggcggagtacacagagttcacgggaaacttcaacagcatcgccgcccagtgcctgcagaagctccccgccagcaacaacaagttcacctataactgcgacggccataccttcaattacctcgtcgaggatggatacacatactgtgtcgttgctactgagtcagttggcaggcaagtccctattgcctttcttgagcgggtgaaggaggattttagcaaaagatatggtggaggaaaagctgcaacagctacagctaatagcctcagccgtgagttcgggtccaagcttaaggaacacatgcaatactgcatggaccatccagaagagattagcaagcttgccaaggtgaaggctcaggtttctgaagtcaagggagttatgatggagaacattgagaaggttcttgaccgtggggagaaaattgagttgcttgttgacaagactgaaaatcttcgctcccaggcacaagatttcagacaacagggaacacaaatgcgaaggaagatgtggctgaataacatgaagattaagctcattgtcttgggcatcattattgccctgatccttatcataattttgtctgtatgccatggtttcaaatgttaatattggtggttaagaactkagagtctgttgcaactgctgcttcccttaggacatcttacttatatggtgtgatagcaatacttggataatcattgtcggtttgtggtttaacttcayctgctgcaratgagtattttgtttccagaytatggaggaccagaataggcttggattagtgaawtgtatgttatgtgtgtatagtrcraasarattctttgttgttggtcaawamraagttctctc

SEQ ID NO: 482 - DNA, 1012 bp, Zingiber officinale
ttataagtatcgctttccttccactcgcgctgtccctttcctctctcgccaccgatttgccgtttagatcggtcttcgttcctccgatctcgcttcgaccaaggtccagcgctaaggagtcttcgcgcgatcggaatatgggtcaacaatcgctcatctacagtttcgtctcgcgggggacggtgatcctggcggagtacacggagttcaccggcaacttcaacagcatcgctgcccagtgcctgcagaagctccccgccaccaacaataagttcacstacaactgcgacgaccacacattcaactacctcgttgaggatggatacacatattgtgtagttgctgttgaatctctaggtaggcaagttccgattgcttttctggagagggtgaaggaggactttagcaaaagatatgggggaggaaaagctgcaactgctccagcaatagcctcagccgcgagtttgggtccaagcttaaagagcacatgcaataytgtgtcgaccacccagaagagatcagcaagctctccaaggtgaaagctcaggtttctgaagtcaaaggagttatgatggaaaatatcgagaaggttcttgaccgcggtgagaaaattgagttgcttgtcgataagaccgaaagccttcgatcccaggcccaagattttcgacagcaaggtacaacaatgaggaggaagatgtggctgcagaacatgaagattaagctgatcgtcctgggcatcatcatcgccctgattctcatcatagttttgtccgtttgtcatggcttcaaatgctaatgagcatcgatatgcaactgtctcagcaatttcctcctttgtgcgagtcgtcaaacatggtgttactacttacatcattgtatagcttctgcataaacatttgcggaatgtggtttgggattccttttgcaaacaattccattttctatctcctcgaaacctagcatcttatgaagaaaaaagatactatcaatatgaatggtcatatttgtactt

SEQ ID NO: 483 - DNA, 1106 bp, Vitis vinifera
gggatttctctgtttatgtataaaacttgtgtctcacactcctccattcaaaccccacacttttttgcctctttcctccaccaaagcaaaagcagcgagtgaggaggaagaagcggtggataaaggagaaggagaagaggaacagagctgagatctgcgaggcaaaattcctccctgagatgggtcagaagtctctcatctacgccttcgtggctcgtgggactgtgattctggcggagtacactgaattcagcggcaatttcaattctattgcctttcagtgccttcagaaactccccgccaccagcaacaagttcacctacaattgcgacgcccacaccttcacttaccttctcgataatggctacacatattgtgtggttgcagatgaatcagtaggaagacaggttcccatggctttcctggaacgcatcagagatgactttgttgcacgatatgggggtgagaaggctgccacagctcctgcaaacagccttaacaaggattttagttcaaaattgaaggaacacatgcagtactgtgttgatcatcccgaggagataagcaagcttgcgaaggtgaaagatcaggtttcagaagttaaaggtgttatgatggagaatattgagaaggttctagacagaggggaaaagatagagcttctggtggataagactcataaccttcatgaacaggcacaagattttcggagtgctggaaccaaaatccggcggaaaatgtggctgcagaacatgaagatcaaactcattgtgttggggattctggtagccttgatcctcatcatagtcctctctgtctgccatggcttcaactgcgggaagtgagcggcgctccatctgctgatcttggtgtccggagaaatgccctagcgtttgtagtagaagaacaaaagtaagcgactcccagttaaaatctgaaccaaagacaagttattttagagagtaatacaaacaacatatatatcgtgtcatgtcattataactgcattcagaaatatgaaattgcttgtttgcaaacaaatttagaaaatggaacttgtttttgcttctcttcataaacctgccgcccatcatgcaggcagctca

SEQ ID NO: 484 - DNA, 1028 bp, Vitis vinifera
ctcaccaccataacaacattgaaaaatagaggagcgcaaatctagcccttttcttctctttttctttctctgcaacttctagggttagggtttgggaaatggtgggtcagcagtctttgatctacagctttgtggcccgtggcacggtgatcctcgccgagtacactgagttcaccggcaatttcaccagcatcgccgctcaatgccttcagaagctcccggccagcaacaacaagttcacctacaattgcgatggccatacctttaattacctcgttgagaatggcttcacctactgtgtagttgcagttgagtctgctggcagacaaattcccattgcttttttggagcgagttaaagatgatttcaacaagagatatggtggtgggaaggctgcaactgctgttgccaatggcctgaacaaagagtttgggcccaaactgaaggagcatatgcagtactgtgtggatcatcctgaagagatcagcaaacttgcaaaagtaaaggctcaggtttctgaagtcaagggagtgatgatggaaaatattgagaaggttcttgaccgtggtgagaagattgagctgctggttgataaaactgagaaccttcgctcacaggcgcaagattttaggcaacagggtactaagatgaggaggaaaatgtggatgcagaatatgaagataaaactgattgttcttggtatcattattgccttgatcctgatcattgttttgtcaatttgccatggcttcaagtgttaatttggccagaatccttgcatatgcaaatgccggactaggattgtcttggtagactggttcgatctcgtgttttgatgttccattttggcactcactttgggtctgttcttcatttattttattttatttttatttttaggtttaatatttctcggttgtgctagccttctagggcaagatttctgtaatttggattggtgtatagaatgtatttgaatttcctttaagtagataaaaatatatttgagcactaggggtgctactgaa

SEQ ID NO: 485 - DNA, 985 bp, Vitis vinifera
atcccctctctttctccgaagccaaacaagaaatccatcagactttctctcctcctgtacactttctctctcctagggttaggtttgtgacgatgggccaacagtctttgatctacagcttcgttgctcgtggaacggtgatccttgctgaattcacggagttctccggtaatttcaccagcatcgctgcgcagtgcctccaaaaactccctgccaccaacaacaagttcacctataactgcgatggccacaccttcaactacctcgtcgaagatggctatacttactgtgttgttgctgttgaggctgttggtaggcagattccaattgcattccttgagcgagtcaaagaggattttaccaagagatatggtgggggaaaagctgctactgccgttgctaatagcctgaacaaagagtttgggcccaaactgaaggagcagatgcagtattgtgtggatcatcctgaggagataagcaagcttgccaaggtgaaggctcaggtttctgaagtcaaaggagtaatgatggaaaatattgagaaggttctggatcgtggagagaaaattgagcttctggtggataaaacagagaaccttcgctctcaggcacaagatttccggcaacagggaaccaagatgaggagaaagatgtggttgcagaacatgaagataaagctgatagttttgggcatcctgattgccttaattctcatcatagtgttatccatttgtggtggcttcaactgttgatgtgaacttgtgtttggttagagttgatgattaaaatgaattggtgctgctgtgttgtttccgaacttcccctaaatgtttacctataattttgtttttgttacacgtcttccatttctgcccatagtctgtattgtaagatggtgcttgtatagtctggactgatgtgaattttttttccctatattagtaaaagggtcccttgatgcgtggaagtttgtcataccatgata

SEQ ID NO: 486 - DNA, 989 bp, Ipomoea nil
gcgtctttctctctctagaaagggtaaaggtggtagattgtagagagagaaaggggtctctttggacactgttccctcgtcttcgattcaactttctgaagcgaagaaagccgatagtaaatcgctaccgagaggaatcgatcggaaatggggcagcagaaggcgctgatctatgctttcgtggcgcgcgggaacgcggtattggctgagcataccgacttcaatgggaacttcaactccatagccttccagtgcttgcagaagcttccgtcctctaacaacaagttcacctacaactgcgatggccacaccttcaactacctcgtcgacaacggattcacttattgtgttgttgctgaggaatcaactggaaggcaggttcctatggcttttttggagcgcattaaggatgactttgtatctaaatatggaggtggaaaggctgcaactgcccctgctaatagcctttccaaagagtttgggccaaagttgagggatcacatgcaatattgtgctgaccatcctgaggagataagcaaacttgctaaggtgaaagcccaggtttcagaagtcaaaggtgtcatgatggaaaatattgagaaggttcttgaccgtggtgaaaagattgagcttcttgtggataagacagagaatcttcaccaacaggcacaggacttcaggagcactggcacgaagatccgtcggaaaatgtggctgcagaacatgaagatcaagctgatagtgttgggaattataatagccctgatcctcatcatagtcctatctgtttgccatgggttcaactgtggaaagtgagcttgttctgctatgataatattttgtagaggacactccattattatgtcttgcattttttttttctttttccatgcctcttgaaatcaaatatgtagtaaaggacacacacctgccttattaacaaattgccaccatcttctaagaagtgttacccttttcatttcactctt

SEQ ID NO: 487 - DNA, 938 bp, Ipomoea nil
accgtcacattcccactctctagaaaaaagcaaaggccttcatctacaaccttctctcccctcaattcgatttgcttgattgctgttttgccaaggcaatcgcgtaaaccctaaacgccgcagcttggaggaaaccggtcctgaaatggggcagcagaaggcgttaatctatgcgttcgtggcccgtgggaacgttatactggcggaacacaccgacttcagcggcaacttcaactccatagcctttcagtgcctccagaagcttccagcctccaacaacaagttcacctacaactgcgatggccacaccttcaactacctcgtcgataacggcttcacttattgcgttgttgctgaagaatccgctggaagacaggtccctatggcatttctggagcgtattaaggatgattttgtagcaaaatatggtggtggaaaggctgcaactgctcctgctaatagctttaacaaggaatttggggctaaattgagggagcatatgcaatattgtgttgaccatcctgaggagataagcaaaattgcaaaagttaaagcacaagtttctgaagtcaaaggtgtcatgatggacaatattgagaaggttctagatcgtggagaaaagatagagcttcttgtcgacaagactgaaaatcttcatcagcaggcacaagacttcaggagcactggcactaaaatccggagaaagatgtggctgcaaaacatgaaggtgaagttgatagtgttgggtatcatcatagccttgatcctcatcatagtactctctgtttgtcatggcttcaactgcggaaagtgatggttttctattctatatatctgtagaaggcacacaatattctgtcttagtgtttttgtctctggaaacacgatcttaaaaagaaagatacttgcactgtgtatgtattaagggtgcggaattc

SEQ ID NO: 488 - DNA, 1082 bp, Ipomoea nil
acatatagagagagagagagagagagataggggagaagggtcttcttctataccgttcggcgttcgctacctcatttcccacaactatttgtttttgcttaatcacgaagcataatcggagaacgctaaaagcatcggccgtcagaaaccgatcggagaaatggttcaacagaaggcgctgatctatgcgttcgtggcgcgtggctccgtgatactggcggagcacactgatttcagcgggaacttcaactccatagcctaccaatgcttgcagaagcttcctgcctccaacagcaagttcacctacaactgcgatggccacacctttaactacctcgtcgataacggcttcacttactgtgtggttgcggaagaatcagcaggaaggcagatccccataggttacctggagcgcatcaaggatgactttgtatctaaatatggcggtggaaaggcagcagctgctgctgctaatagccttaacagggaatttgggcctaaattaagggaccatatgcaatattgtgttgaccatcctgaggaggtgagcaaactttcaaaggtgaaagctcaggtgtcagaagtcaaaggtgtcatgatggagaatattgagaaggttctagaccgtggggaaaagatagagcttctcgtggataagacagagaatcttcataatcaggcacaggacttcagaaacactggcacacaaatccggagaaaaatgtggctgcaaaacatgaagattaagctgattgtattgggaattataattgcgctaatcctcatcatagtgctctctgtttgccacgggttcaactgcggaaagtgagccttttttgccatgatatactcggaggcactcaactttgtgttggcatatgcaccactgaaatctttcgttttgaagccataggaaccgtttgatcgatttgcaaccattcttctatagtatatctgtaaatgcctttctttctttctttggtcttttatttgatttgattttattttcttttattttggaacctttggtcttttagttgatatatattggtattttcatttcagtttacagaatacagata

SEQ ID NO: 489 - DNA, 963 bp, Ipomoea nil
gcttgctattcacactttctctctctagaactccggcagctaggaactgaattgagagagaaagcgagccggacgatggggcagcagtcgttgatctacagcttcgtggcgagaggcacggtggtcctcgccgagtacactggtttcaccggcaacttcacgaccatagcttcgcaatgcctgcagaaacttccggctagcaataacaagttcacctacaactgcgacggccacacattcaactacctcgttgaggatggcttcacatactgtgttgttgctgttgaaactgttggcagacaaattccaattgcatttcttgagcgcattaaggacgattttaccaataaatatggtggagggaaagctgctacagctgttgctaacagcttaaacaaagaatttgggcccaagctgaaggaacaaatgcaatattgtgtggatcatccagaagaggtcagtaagcttgcaaaggtgaaggctcaagtctctgaagtcaaaggggtgatgatggaaaacattgagaaggttcttgaccgtggagagaagattgagcttctggtggataaaaccgagaaccttcgttcacaggcacaggattttaggacgcagggaaccaagatgaggaggaagatgtggctgcagaatatgaaagtaaagctcattgtcctggcaattatcattgccttgattctcatcattgttttgtcaatttgtggcagttccaaatgtcattaggttggtcatcaactgaagtttggatgcatcatatcatctctattatagtgtcatgtttgttttacctataatcccctctccatttttgcgcatgtttgtgttcttagtagtatttagtgtgcattgcttagcagtgcctgtatagcttgttctaccgaattctttgaatatatgttcgagtagtgaaaggttttattgaggttgccagttgtaaggcagagctct

SEQ ID NO: 490 - DNA, 913 bp, Actinidia deliciosa
ctaaattctatccctctctctctaggacatttccttcctctctctcattagagttagggtttttgaggaagaaatggggcaacaatcgctgatctacagcttcgtggcacgggggacggtgatcctcgcggaatacacggaattcacgggcaatttcaccaacatcgcgtcccaatgcctccagaagctccccgcgagcaacaacaagttcacctacaattgcgatggccacaccttcaattacctcgtcgaaaacggattcacctactgtgttgttgctgttgaggctgctggcagacaaattccyattgcctttctggarcgtgttaaggatgatttcaacaagagatatggtggagggaaagccgcaactgctgttgcaaagagtttgaacagagagtttgggtctaaattaaaggaacacatgcagtactgtgtggatcatccagatgagataagcaaacttgcaaaggtgaaggctcaggtttctgaagtcaagggagtgatgatggaaaacattgagaaggttcttgatcgtggagagaagattgaggtgctggtagacaaaactgagaaccttcgctctcaggcgcaagatttcaggcaacaggggactaagataaggagaaagatgtggttccagaacatgaagatcaaattgatcgttttcggtatcctcatcttgttgatactcatcatcattctgtccgtatgcaatggcttcaaatgtacttgattcagattgtcctacttgattggttgttccttcactatattatgacattacatttacattctttttcggtttaggtcacaccttccatttctgttatgttagctttttcggggggactgtaatttgaattcgttgtataggtcatgaattacgaaaatatttatgcatgtggcttta

SEQ ID NO: 491 - DNA, 1006 bp, Lactuca sativa
tttctttttatctgagtagtccccttcaaccttctctctctaaaactccttccccatctctctcgctcaaacccacgcacttcattcatcggagggatgggacagcagtcgttgatctacagtttcgtcgccagagggacggtgattctctccgagtacacggagttcaccggaaatttcactagcatcgctgcacagtgtctccagaagcttcctgctacgaacaacaagttcacctacaactgcgatggtcacaccttcaactaccttgttgcagatggattcacatactgtgttgtggcggttgaatcggttggtagacaggttcccatggcttttcttgagcgagcaaaggaggatttcactaagaaatatggaggtgggaaagctgctacagctgttgctaatagcctcaacaaagaattcggtccaaagctgaaggaacagatgcagtattgtgtagaccatccagaagagatcagcaagcttgcaaaagtcaaagcccaggtttcagaagtcaagggtgtgatgatggaaaacattgagaaggttcttgaccgtggagaaaagattgagcttctggtggataaaacagagaaccttcgctctcaggcacaagactttaggacgcaagggacacagataaggaggaagatgtggttgcagaacatgaagataaaactgatagttcttggaatcatcattgcattgattctcattatagttctatctgcttgtgggggattcaactgtggmaagtaaaacwtcatcttatcatctttggtttggggatttaggaatggtaaaaggtaaaaagtctctcattctctttcatcagctttgtcatcccatgtttattttgtttgtttgccattgattttcttttctttttctttttgtttgttagtttttttttggacacaaagcctatcttttgagctttatattgtgatatatagtggttgtatagtttgtaccttttaagtaccattttaagtaccatttg

SEQ ID NO: 492 - DNA, 787 bp, Lactuca sativa
ctttctctctcttgcatcctctctctaagaattaatcagcgtcttcttcgtcacgcttgctccatttcggtgcatctgttatcttccggcggtggtgctcggtgaacggttttatagtcgtgggagacagagaaggaggttattatgggacaacagtcgttgatctacagtttcgtggctagaggaacggtgattctgtcggagtacacggaattcaccggtaatttcactagcatcgctgctcagtgtctccagaagcttcctgccaccaacaataagttcacctacaactgcgacggccacaccttcaactaccttgtcgaagatggatacacatactgtgtggttgcggttgaagccattggcagacaggttccaattgctttcctggagcgcatcaaggaggacttcaccaagaaatatggtggtgggaaagctgcaacagctattgccaccagtctcaacaaagaatttggcccaaagctgaaggaacagatgcaatattgtgtggaccatccagaagagatcagcaagctttctaaagtcaaggcccaggtttcagaagtcaaaggggtgatgatggaaaatattgagaaggttcttgatcgtggtgagaagattgagattctggtagataaaacagagaaccttcgttctcaggcacaggattttaggacgggaggtactcagttgagaagaaagatgtggttgcagaatatgaagataaaactgattgttcttggaatcattattgctttgattctgattatagttctttccgtttgtg

SEQ ID NO: 493 - DNA, 956 bp, Lactuca sativa
cggcgggctcgtaaccacctttcacctacgatttcgaaaacccaaaatcagatcagattcttccattttccaagcggttcttttccggccgctacggtttcatactttgcgagagggtttcgtagatcaatcttcctataatcatcatcaatatggggcaacaatctttgatctatagttttgtgtccagagggaccgtgattcttgcagagtacacagagttcaccggaaatttcacctctattgcttctcaatgcctccagaagcttcccgcaactaacaataagttcacatacaactgcgatgggcacaccttcaattaccttgttgaagatggcttcacatactgtgttgtggctgctgaatctgctggccgacaagtgcccatggcttttcttgagcgaaccaaggacgactttaacaagaaatatggtggtgggaaagctgctacagctgttgccaatagtcttaacaaagaattcggacccaaactgaaggagcagatgcagtattgtgtagatcatcctgatgaaatcagcaagctctcaaaggtcaaagcccaggtttcagaagtcaaaggtgtgatgatggagaacattgaaaaggttttggatcgaggtgagaagatagagctccttgtggataaaacagagaatcttcgatctcaggcacaagattttaggacacaaggtacacagataaggaggaaaatgtggctgcaaaatatgaagataaaactaatagttcttggaatcatcgttgccttgattctgattatagttctctcagtttgtggtggcttcaattgtggcaagtgaaagtgaagtgaagctcatatataatatggtaaaactttgtttaatttgtctttgtttttattaaaaagcctattatgttgcaagattgcgtgtatatttttgtacttttaagacattgaaaacactttatgctctttg

SEQ ID NO: 494 - DNA, 1068 bp, Lactuca sativa
tttttctatacgaaaacccatagtgtatcctttatcccatttcacctcccactttctctctcttgcatcctctctctaagaattaatcagcgtcttcttcgtcacgcttcctccatttcggtgcatctgttatcttccggcggtggtgctcggtgaccggttttatagtcgtgggagacagagaaggaggttattatgggacaacagtcgctgatctacagtttcgtggctagaggaacggtgattctgtcggagtacacggaattcaccggtaatttcactagcatcgctgctcagtgtctccagaagcttcctgccaccaacaataagttcacctacaactgcgacggccacaccttcaactatcttgtcgaagatggatacacatactgtgtggttgcggttgaagccattggcagacaggttccaattgctttcctggagcgcatcaaggaggacttcaccaagaaatatggtggtgggaaagctgcaacagctattgccaacagtctgaacaaagaatttggcccgaagctgaaggaacagatgcaatattgtgtggaccatccagaagagatcagtaagctttctaaagtcaaggcccaggtttcagaagtcaaaggggtgatgatggaaaatattgagaaggttcttgaccgtggagagaagattgagattctggttgataaaacagagaaccttcgttcacaggcacaggattttaggacgggaggtactcagttgagaagaaagatgtggttgcagaacatgaagataaaactgattgttcttggaatcattattgcattgattctgattatagttctttccgtttgtggtggcttcaactgtggcaagtgaaacattattttgatatcattcaaaaaccatgcttctttcttcttctttttggtaaactgattctacataaaaggaggtttattataccttttatattgtgagaccatatttcatttcatatctgtataggtttgtttctttgttgtattttttgatacacgtctatctatctagatttatctaaaccacatattatcttctcaaatg

SEQ ID NO: 495 - DNA, 956 bp, Lactuca sativa
gtaaccmcctttcacctacgatttcgaaacccaaaatcagatcagattcttccatttctccaagcggttcttttccggccgctacggtttcatactttgcgagagggttttgtagatcaatcttcctataatcatcatcaatatggggcaacaatctttgatctatagttttgtgtccagagggaccgtgattcttgcagagtacacagagttcaccggaaatttcacctctattgcttcccaatgcctccagaagcttcccgcaactaacaataagttcacatacaattgcgatgggcacaccttcaattaccttgttgaagatggctttacatactgtgttgtggctgctgaatctgctggccgacaagtgcccatggcttttcttgagcgaaccaaggacgactttaacaagaaatatggtggtggcaaagctgctacagctgttgccaatagtcttaacaaagaattcggacccaaactgaaggagcagatgcagtattgtgtagatcatcctgatgaaatcagcaagctctcaaaggtcaaagcccaggtttcagaagtcaaaggtgtgatgatggagaacattgaaaaggttttggatcgaggcgagaagatagagctccttgtggataaaacagagaatcttcgatctcaggcacaagattttaggacacagggtacacagataaggaggaaaatgtggctgcaaaatatgaagataaaactaatagttcttggaatcatcattgccttgattctgattatagttctctcagtttgtggtggcttcagttgtggcaagtgaaagtgaagtgaagctcatatataatatggtaaaactttgtttaatttgtttttgtatttattaaaagcctattatgttgcaagattgcgtgtatatttttgtacttttaagaccattgaaacaactttattgctctttggtctttaac

SEQ ID NO: 496 - DNA, 1100 bp, Liriodendron tulipifera
craaaccakcacaaagagaaaggaaagaagaagaagaagaaatcctctttccttcctctcttcatttcttcttcattctctttatctctgcaactcctgtaaacaggtctaggtttagggtttctctgttttcatctgcgaagcgagaagagatgggccagcagtcgttgatctacactttcgttgcccgagggacggtgatcctggccgagtacaccgaattcacgggaaatttcacgagcatcgctgctcaatgtcttcagaagctccccgccaccaacaacaagttcacctacaactgcgacgcccacaccttcaattacctcgtcgaagacggtttcacctactgtgtagttgcagttgagtcagctggcagacaaattcccattgccttcctggagcgggttaaggatgatttcaacaagaagtacggaggaggaagagctgccactgctgttgctaacagcctcaacaaagagtttgggtccaaactaaaagagcacatgcagtactgtgtggaccatccagaggagatcagcaagcttgcaaaggtgaaggctcaggtttcagaagttaaaggagtaatgatggaaaatattgaaaaggttctggaccgcggtgagaagattgagcttctggtagacaaaacagagaccctccgcaatgaggcagacggtttccggaaacaaggtacacagatgagaaggaagatgtggctagcgaacatgaagataaagctgatcgttttgggtatcatcgtygcattgattctcattattatcttatctgtttgccatggtttcaaatgttgatgaacaaaaaacctactctacccatctcccagtctctctacatgactgctgctgcttcattatatcttctttactagattggtgctgattatatcttgttttgctgtttytyttttgtgaawgagaggtctttgtttcctccgtttttyttgtctttttytctttgtagacggggatgattgctgagaggcctttgcttcctcmtcccattttcttgtcttttactttctttagacggggatgattttgttytktatggcattgcgtgtatagattgtgcgcttgaat

SEQ ID NO: 497 - DNA, 888 bp, Eragrostis curvula
cgaaagaaaccgaacctttccccctccccctcgcctacccagcatcccaactcgccgagatctagcctagggtttcgccggaggcgaggcctacatcaccggcggcgagctaaactccacgactggggtaagaggagagagggggagggagaaggcggccatggggcagcagtcgctgatctacgcgttcgtggcccgcggcacggtcatattggccgagttcacggagttcaccggcaacttcaccaccatcgcctcccagtgtctcatgaagcttcccgccagcaacaacaagttcacctataactgcgacgggcacacgttcaactacctcgtggaagacggattcacatactgtgtggttgctgttgaatcagtgggacgacaagttcccattgctttcttggacagagttaaggaggatttcgcaaaaagatatggtggtgggaaagctgccacagctgcagctaacagcctcaatcgagagtttggatcaaaacttaaagagcacatgcagtattgtgttgatcactctgaagaggtcagcaagctgtcaaaagtgaaagctcaagtttcagaagtgaagggggttatgatggaaaacatcgaaaaggtacttgatcgtggagagaagattgagctgcttgttgacaagactgagaatctgcgctcacaggcacaagatttcaggcagcaaggaacgcaggtcaggagaaagatgtggctacagaatatgaagattaagctcatagtcctgggcataataattgctctgattcttataattatcttgtctgtttgtcacggttttaagtgcaacaagtaagcttggactaagggtcgagagtaatacattgaactgcccctataatactgctactttgagcc

SEQ ID NO: 498 - DNA, 1385 bp, Zea mays
accgaattccatttatttcatcctctcttttttttccccattccacgcccctcccaacactcccagacccatttccctttccttcccctccggctccgcctcctcgaccactccgacaacccccagcgcctcctctccggcgagctccacctctccaccggcggcggcgagaagcgggggggctaactaagtctgtaggctgcggcggaggtgatcccggagccggagccgagtctagggcgatggggcagcagtcgctgatctacgcgttcgtggcgcgtggcaccgtggtgctggccgagtacaccgagttcaccggcaacttcaccaccatcgccgcccagtgcctgcagaagctccccgccagcaacaacaagttcacctacaactgcgacggccacaccttcaactacctcgtcgaggacggattcacgtattgtgtagttgctgttgaatcagttgggcgacaaatccccatagctttcctggacagagttaaggaagacttcaccaaaaagtatggaggcgggaaagcagctactgctgcagcgaacagcttgaacagggagtttggatcaaagcttaaagagcacatgcagtactgtgtggaccaccctgaggaggttagcaagcttgccaaggtgaaggcccaagtctccgaagtcaaaggagttatgatggaaaacattgagaaggttcttgaccgtggcgagaagattgaactgcttgtcgacaaaactgaaaatctgcgttctcaggcacaagatttcaggcagcagggcaccaaggtgcggcggaagatgtggctccaaaacatgaagatcaagctgatcgtgctgggcatcatcatcgcgctcatcctcatcatcatcctgtcggtgtgccatggcttcaagtgcggcagcaagtgaggagggggacttacggatggccgtgccctgccctgccctgccctggcacctgcgagaaggaggagactacatgtggagttttttttttgcttctttagtcgtcgtgttaagtcgtcctgcgccgataattcttggtggtcaccagataaagagtcattcctggtgtcggtgttgattgctgttggttggtcgggaaatgactgggtgaaccgaggggcgaagtgggaggggggttgtgtcgtgtaattttggatgccactattgtgcatgtatagccccgtgtgctgtgctaccctgatccgtgttgctactcctatgtcagtagatgttacgtactacgtttgctccccaggttgcaggcgactctgttcgaaaatgctcgttttctagctcttatttcggactgctgcagctgtcagctgtaatccacatagatacaaaacattatagaaacagtaaaagctaataaagcta

SEQ ID NO: 499 - DNA, 1122 bp, Zea mays
catcaacaaaatttgattttcctttcctttccttttccacccccgactattacccctcctcccactccacggagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaacacatgcagtattgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaatcttcgctcacaggcacaagatttcagacagcagggaacaaatgtcaggagaaagatgtggttacagaacatgaaaatcaagctcatcgtcctgggaataatcatcgcactcattctgatcattatcctctctgtctgtcatggtttcaaatgccattaagcacagaccagaatactgatacattcaactgcacctattatactgctgcttggagcaaaaaaaagtatgatcttttgttgtttcgctagtgtgctgtggcccggtcattatgcataggtgttttacattgtcgtagtgtttgataaatgatggatggtgactgggtttgttgtgtcaactgtcataactattgtgcatttttggacgctatatgtgtagccttgatatgaatagatttactgtacttata

SEQ ID NO: 500 - DNA, 1048 bp, Medicago truncatula
aaacccttctctctcatccatttctctgtaacttcttcttcttttcctctctctctctctgtacaaaatctttagagagagaaacaaccatcaacaaccaaaatcaaaaccattctcagatctcttcttcaatggcgaacaaccagaatcagaagcaactgatctacgctttcgtatcaagaggaacagttatcctcgctgaattcaccgaattcagtggtaacttcaactccatcgcttttcagtgtcttcagaaacttccttctaccaataacaagttcacatataactgtgataatcacaccttcaactaccttatcgataatggttacacttattgtgttgttgcagatgaaacaactggaagacaggttcccatggcctttctagagcgtgtcaaggatgattttgtgtcaaaatatggtggtgaaaaggcttctacagctcctcccaatagccttaacaaggagtttgggccaaagttgaaggaacatatgcagtactgtgttgatcatcctgacgagataagcaagcttgcaaaggtgaaagctcaggtttctgaagttaaaggtgtcatgatggagaatattgaaaaggttctagacagaggagaaaagatagagcttctggtggacaagactgataaccttcatcaccaggcacaagacttcaggagttctggaacctcaatccgtcgaaaaatgtggctgcaaaacatgaaggtaaagctgattgtgttgggaattttgatagcactgatcctcataatagtcctttctgtgactcggggataataagcaccattctctgtggcctttattgttattccaaccttgtgattatccaaggcgatgtcaatgtatggcatgtgtttgtatgtaatatagatttcaagtccgttgaagttgtcactttgttctagttttaggtgcttttgaatataaattgggttgtctgtttgaagtttggtttccattcagattattcatattgacattgtcatcaattttgtaaattgtttgctttgcgatcatatttttttgtttcc

SEQ ID NO: 501 - DNA, 1131 bp, Medicago truncatula
cggccggggactctttctctctctatatttactctctagaaaagaagagaaaagagaaagaaaaagttgatcgagaatatagcaaacagcatcaccacaagaaacctcttcgttcgatagatctgtggagaagaagatgggacagaaccaaaaatctctgatctacgctttcgtttctcgcggaagcgtgattctctctgaatacactgaattcagcggaaacttcaactccatcgcttttcaatgccttcagaagcttccagcttctaacaacaaattcacttacaattgtgatggccacaccttcaactacctcgtcgataatggctacacgtattgtgttgttgcggatgaaactgttggaagacaagtgccggtggcttttctggagcgtgtgaaggatgattttgttgcgaaatatggtggtgggaaggcgtctacagctgcacctaacagcttgaataaggaatttgggccaaaattgaaggaacatatgcagtattgtgttgatcacccggaggaggtgagtaagcttgctaaggtgaaagctcaggtgtctgaagtgaaaggtgtcatgatggagaacattgaaaaggtcctggacaggggggaaaagatagagcttttggttgacaagactgagaaccttcatcaccaggcacaagacttcaggaactcagggaccaaaatccgcagaaaaatgtggctgcaaaatatgaagataaagctgattgtattggcaattttgatagctctgatcctcataattgtcctcccaattgtccttaagaataaataaacgccactctcggagacatttatctggttattttgactttcttgtgattattatatgatgatgatgatgaggaaagctatcaggtgtatgacatgattttgtatttagtcaagatatcagaacctgtataccgttcacttttaagcttttacagtatgatggtgatgatgatatactaatgcttctatatgttttttttgcctgtctattgtagtttgatttcaatttcaatttttcccgacccatcctgttatcattattcatgcaatttgaacaccttgtttgttgtgtatgaatgatttctcgcaagaaaaaattgaattaaaaaaaaa

SEQ ID NO: 502 - DNA, 1072 bp, Medicago truncatula
ggcacgaggaacacctctctctctatatctctctccttttcatttcttcatcattttccatttcttttccaaaaaaaatataaaaatctttctctcttgtattgaatctgttgcagagagttgtgaattgtgatcattcatgggacaacaatcattgatctatagctttgtggctcgtggtacggtgattcttgcggagtacagtgacttcacaggaaacttcaccaccatagctttacagtgtcttcaaaaactccctgcttctaacaacaggtttacttacaactgtgatggacataccttcagcttcctcgtcgataatggattcacttactgtgttgttgcagtggagtctgttggtagacaaattccaatagcttttcttgaacgtattaaggatgattttaataaaagatatggtggaggaagagctacaacagcaactgctaaaagtcttaacaaagaatttggaccaaagttgaaggagcaaatgcaatattgtgtggaacatccggaggaggttagcaaacttgctaaagtgaaagctcaagtttctgaagtcaaaggagttatgatggaaaatatcgacaaggttattgataggggagagaagattgaggttttggtggataaaactgagaaccttcgctctcaggcacaagatttcaggcagcagggaacccagttgagaagaaagatgtggtatcaaaacatgaagataaagctcatagttcttgctatcataattgcattgattctcattattgttctttctgtgtgccatggcttcagttgttaactattcttattttttctagaattgtcactacatattggattgttttgtaatataatatagtctcatacaatgaagtttatgatttgtttattagatattcaatggcttcatgtaaaaaaaagttaggaagggaagtgaataaggtgtggtaggatgcataatgtttatcatttttattgttcctactctataaactgtattgtttcatttatggaattgtgtatagaaagcatgctgaatattattttattgtagaattaatcggcactgtat

SEQ ID NO: 503 - DNA, 784 bp, Cucumis melo
ctctttctcctccaatatttcgaaccccaaattttccgtctcgctctatatacccgcgcactcaaacaaaattttggaaacaccaatttccgggttcttttggaaatggggcaacaaacgttgatctacagctttgtggctcgaggaacggtgatcctcgctgagtatacggagttcaccgggaatttcgctagcatcgcctctcaatgcctccagaagcttcccgcttcgaacaacaagttcacctacaattgcgatggccacaccttcaattatctcgtcgagaatggattcacttattgtgtagttgctgttgaagctgctggtagacaaattcccattgcctttcttgagcgagtcaaggaagatttcaacaagagatatggtggggggaaagctgcaactgctgttgcccacagtctgaacaaagaatttggatcaaagttaaaggagcacatgcaatattgtttggatcatcctgaagagatcagcaagcttgctaaagttaaggcacaggtttctgaagtcaagggtgttatgatggaaaacatcgagaaggttcttgatcgaggtgagaaaatcgagttgttagtggataaaactgagaatctccgctcacaggctcaggatttcaggacacagggaactaaaatgaggaggaagatgtggtttcagaatatgaaaataaaattgatcgttctcggtattatcattgccttgattctcatcattatcttgtccgtctgtcccggctttaaatgttaagttccatctcgattaccct

SEQ ID NO: 504 - DNA, 1175 bp, Cucumis melo
aaagccttcattttctctcccattttttccctctctctctttctctctatttctccccctgttccaattagggcaatattcatcttcttccatggggcagcaatccttgatctacagtttcgttgcgcgtggaactgtaattctcgctgagtatacagaattcaccggcaatttcaccactatagcctcccagtgccttcacaaacttcccgccaccaacaataagttcacttacaattgcgatggccacaccttcaactatcttgtcgacaatgkattcacttactgtgtggttgcagttgaggctgctggccgacagatccctattgcattccttgaacgagttaatgaagactttgtgaagagatatggaggtggaaaggccatgacagcaactgctaatagcttgaacaaagaatttgggtctaaactgaaggagcatatgaagtattgtgtggagcacccagaggagatcagtaagcttgccaaagtgaaagcacaggtttctgaagtgaaaggagtgatgatggaaaacattgagaaggttcttgatcgtggagagaagattgagcttctagtcgataagacagaaaaccttcgatctcaggcacaagattttaggcagcaaggaacgaaaatgaggagaaagatgtggtatcagaacatgaagataaagctgatagttcttgcaatcgtactggcgttgattctgattatcattttgtctgtgtgcggcggcttcaattgttgatggattcttgtggcagcaacattaggattggtgatgggatcaatattactcggacagtttcttcatacatgcttgtttattgtacaaatctttcagttccaagtccacttamccatacgttttactaccaccctggttttgtataggttgtgcggttatattcttttgacttttgtatggaaatatatcattcgtttgctaaaaaaaaaaaaaaaaaaaaaaaaaaaaaaaaaaaaaaaaaaaaaaaaaaaaaaaaaaaaataattaaaaaaaataaaaaaaaaaaaaaaaaaaaggccgccccgccccccccaaacataatctaacccatcccccccacgggggggcccggcccccaaccccccccatccagaatcgaataacacgccccccctgcccggctttttacatggcggggacggga

SEQ ID NO: 505 - DNA, 959 bp, Nuphar advena
ttaaagcattctctcgtcttaccgctttggcgatttccctccctccctcccttccccccccctcttccgtttcgccctctcagartctatctcagaagagagagagagaggatgggccagcaatctctgatctacagcttcgtcgctcgagggacggtgatcctcgccgagtacactgaattcaccggaaatttcacgttgatcgcctcccagtgcctccagaagctccccgccaccagcaacaagttcacctacaactgcgacggccacaccttcaactacctcgtcgacaayggcttcackttttgtgtagttgcagtygagtcagttggaagacaactgccaatagctttcttggagcgggtgaaggaagactttaatmagagatatggtggtggaaaggctgcaactgctgtygccaacagcctcaacaaagaatttggatcaaaattaaaggagcatatgcaatattgtgttgaccaccctgaagaggtaagcaascttgcgaaggtgaaggctcaggtttcagaagtyaaaggtgtgatgatggagaacattgaaaaggttttagatcgaggagaraagattgagcttctggttgacaaaaccgaaaacttgcggtmccaggcccaggacttccgwactcaaggcacaackatgcgaaggaaaatgtggyttcagaacatgaagatcaagctcattgtgttgggtattatcgtcacgctgatccttatcattattttgacagtttgccatggcttcaactgtggtaagaagtgaagaagatgaatgaggatggagttagaattttggattgcttctgctgtgtagtctgggtgaaggcatcatctgcacatatatagaagatgattgtagggcaggttccacatttctaggaatattagtatatatttacatcagaaaacagcttcttatctgcaatatatgtgaaagggtca

SEQ ID NO: 506 - DNA, 1028 bp, Quercus rubra
aaaagtcccctaattgaatttcaaatctctttctctttctctttctctctctatctgactgtgaatttttcagaaaaccctaaatctctgatcgaaatttccagctgctgctgagagtctcagagaaaaggaagagagatgagccagaagcctttgatctacgcattcgtggctcgcggaactgtgatcctctccgagtacaccgaattcagcggcaatttcaactccatcgccttccaatgcctccagaagcttccttccaccaacaacaagttcacctacaactgcgatgcacacaccttcaattacctcgtcgataacggctacacatattgtgttgttgcagatgaatcagttgggcgacaagtgcccatggcttttctggagcgcatcaaagatgatttcgtgtcaagatacagtgctggaaaggctgatacagctcaagccaacagccttaacaaagagtttggaccaaaattgaaggaacacatgcagtactgtgtcgatcaccctgaagagattagcaagcttgcaaaggtcaaagctcaagtatcggaagttaaaggtgttatgatggaaaatattgaaaaggttttagatagaggtgaaaagatagagcttctggtggataagactgagaaccttcatcaacaggcacaggactttcggacctctggtacaaaaatccggaggaaaatgtggctgcagaatatgaagatcaagctgattgttttgggaattctgatagcgttgatcctcatcatagtcctctctatttgccacgggttcaactgtggaaaaaaataagctgctttctgccagcggcttctgtcttgtttatcaaaacttgcaattatatatcaagagaaatattatatatgtatatgtcatgacttggtatgtagttcaatctagcaacttccagatactcggcacgaagtaaatttatttttgtgtgtgaacgaaccctacaagttctttttatgtcacagaatgctttttcataaatatagtttgcttgattgcct

SEQ ID NO: 507 - DNA, 1198 bp, Quercus rubra
tagtttcacaacagaaacagcttattattattacaccaaaccattttttctttcttactcgcagcgtttcctttcaaattctgcaattgatttgtttagggttagggtttgggtttgaattcttgataaatagagagagaaaaaaagatggggcagcaatctctgatctacagcttcgtggctcgaggcacggtgattctggcggagtacacggagttcaccggaaatttcacgagcatcgcttcccaatgcctccagaagcttccggcttccaacaacaagttcacctacaactgtgacggccacaccttcaattacctcgtcgaaaatggcttcacctattgtgtggttgctgtcgaatctgctggtagacagattcccattgcctttttggagcgagttaaggaagattttaacaagagatatggcggagggaaagctgcaactgctgttgccaacagcctcaataaagagtttgggtccaaactgaaggagcacatgcagtattgcgtggatcatcccgaagagataagcaagcttgcgaaagtgaaggctcaggtttctgaagtcaagggtgttatgatggaaaatattgagaaggttcttgaccgcggtgagaagattgagctgctggtggataaaactgagaaccttcgctcacaggcacaagattttaggcaacagggaactaaaatgagaaggaagatgtggcttcagaatatgaagataaaattgattgttttgggtatcatcattgccttgattcttatcattgttttgtctgtttgccatggcttcaaatgttaaattggcttggaacttcccagaggcttcaccgctgtcatcttactgatttggactgtcttggtagattccattccaccttgcagatcctttctcttgggtctttgatcttttaggttatacctaccttcttctgctagccttttaggattggggagcatttgtatcttggattggttgtataggtaatatgcttcaacttctgcaagtagataaattttctatatgttctgtgttgtggattttttgtttaaggtgtattgaaggaatatttggattcctgcaattgtatgtcctctcggaatgttttcaatatatatatgtcattgtttttgttcgtgtaatttcctttcctttgctgttttgggtgataggtggtggtagcctggttagg

SEQ ID NO: 508 - DNA, 1024 bp, Elaeis guineensis
ctctctctctcgccccgaccgtccctcgtcccattgcgtatcccaacccctctccctccttcctctctctcgcgccgtgattccaagaattctagggtttgggtttgggagatggggcagcagacgctgatctacagcttcgtggcccgggggacggtgatcctggcggagtacacggaattcaccggcaacttcaccagcatcgcctcccaatgcctccagaagctcccctccagcaacaacaagttcacctacaactgcgacagccacaccttcaactacctcgtcgaggacggattcacatactgtgtggttgcggttgagtcagctggcaggcaaattcccattgcctttttggagagggttaaggaagactttaagaaaagatatggtgggggaaaagctgcaactgcttcagctaacagcctcaaccgtgaatttgggcctaaattaaaagagcacatgcagtattgtgtggatcatcctgaggagatcagcaagctgtccaaagtgaaagctcaggtttcagaagttaaaggagttatgatggaaaacattgagaaggttctagaacgtggggaaaaaattgaactccttgttgacaagacagagaatcttcgctcacaggctcaagatttcaggcaacaagggacaaagatgaggaggaagatgtggttgcagaatatgaagataaaacttattgtcttgggcattatcattgcactaatcctcatcataatattgtcagtttgtcatggcttcaaatgcacatgagaccatacacacctccattccccttctgacggagagtatagtatcttatactaccattcctgtgtgcgttggtgcttttgtgatagactagcgttgtgttctcgcatatgaaccctatcctatgtcatagtttgtctggaattgagatgggaatgcttatgtatttcagatgttgtgcatgtatagaccatatgacagagtatttcttatgatagaagtacaggagggtcttgttctatttggtttggtc

SEQ ID NO: 509 - DNA, 888 bp, Allium cepa
aaatctctgtataaatctgattcaccctttcctcatccttcttgtcgaaatctcgaattctggaaaattagaatttcgggatgggacagcagactctgatttacagcttcgtggcacgcggcaccgtcatcctcgccgrgtatacagagttcactggcaacttcaccagcatcgcttctcagtgtctgcagaagcttcccgccacaaataacaagttcacgtacaactgcgatggccatactttcaactatttggttgaagatggattcacatactgtgttgttgctgttgagtcagcagggagacaaattccaatcgcttttattgagaggattaaggatgactttgtcaaaagatatggtggaggtaaagctgcaactgctgccgctaatagcctgaatcgagaatttggaccaaaaatgaaagagcacatgcagtactgtgtcgaccaccctgaagagatcagtaagcttgccaaagtgaaagctcaggtttcagaagtcaagggagtcatgatggaaaatattgagaaggttcttgaccgtggggagaaaattgagcttcttgtagacaaaactgagaatcttcgctctcaggcgcaggatttcaggcagcagggaacgaaaatgaggagaaagatgtggttccaaaatatgaagattaaactcatagtcttgggcataatcattgccttaatcctcatcattatgcttgtctgtgtgccatggattcaaatgctagacccaaaccaccaggggagcttcattgtttgatacattgattttccaggtagcgatatatcttttgttgtaaatggcctgggttgttgtacccttctatgattgggtgaatttgtgacattttgattagcctctctctctccctgtt

SEQ ID NO: 510 - DNA, 981 bp, Carica papaya
atacgacaaccattttcttccttcgtttcctctctgcaacagcaaaaacctaccaaacctctgtctcctttctctgttatagcgttagggttagggtttctgtagtttgttagccggcgatggggcagcaatccctgatctacagctttgtggctcgaggcaccgtcgtgttagcagagtacacagagtttacaggcaacttcaccagcatagcggctcagtgccttcagaaactccctgcctccaataacaagttcacctacaactgcgatggtcacaccttcaactatctcgtcgacaacggcttcacttattgtgtagtcgctgttgagtctgttggccggcaggttccaattgccttcttggaacgaatcaaggaagattttaccaagagatatggtggaggaaaagctgccacagcagctgcaaatagcctgaataaagaatttggctccaaactgaaggagcatatgcagtattgtgtggatcatcctgaagagatcagcaggctagctaaagttaaagcacaggtgtcagaagtcaaaggagttatgatggagaacatagaaaaggttcttgaccgcggagagaaaattgagcttctggtggacaaaacagagaatcttagatctcaggcgcaagacttcaggcagcagggtacgaagatgagaaggaagatgtggtttcagaatatgaagataaagctgattgttcttgctatcctgattgccttaattcttatcatagttttatctgtctgtggtggcttcaaatgttgatgggtcctatgcactccatgagtggatccttctgctctcaaattgtattgattgtctggatcatgcatttttttttttgttacaaggtgcttcctattatagcctttatcataagacactgcttgtatagtctgtattttggaaaatattttgacactagcaaggttcttaatgtgtgaaagtgtgtcacttctttatgttc

SEQ ID NO: 511 - DNA, 1126 bp, Carica papaya
accaatttaaaaatggttgttggcgtttgataagaaatctcaacaaaattcaaaccgaccgcgttcgaacgcctcgcttttaattttctcgtttcctccatttcaagggttagggtttctctttcgctgggggaatgggacagcaatcgttgatctacagctttgtggctcggggaacggtggttctggcagagtacacggaattcaccgggaattttaccagcatcgcttctcaatgcctccagaagctccccgcttccaataacaagttcacctataattgtgatggtcataccttcaattacctcgtcgaaaatggcttcacctactgcgttgttgcagttgagtctgctgggaggcaaattccaattgcctttttggaaagagttaaggaggactttaacaagagatatggtggagggaaagccgcaactgccgttgctaacgggttgaacaaagagtttggacccaagttgaaggagcatatgcaatattgtgtggatcatcctgaagagatcagcaagcttgccaaagtgaaagctcaggtttctgaagttaagggtgttatgatggaaaatatcgagaaggttcttgatcgtggtgaaaagatcgagctactggtggataaaactgagaaccttcgctcccaggcacaagattttaggacacagggaacaaagatgagaaggaagatgtggattcagaatatgaagataaaattgattgttttgggtatcatcattgcgttgattcttataattgtgttgtcagtttgccatggctttaagtgttgattatgttggatatttctccatggagactgcactcaccactatatggagtggatttcatggtaagatcggtttgccttttatgaagatccacattgctatctctttttctctggagtcatttatgtttcagccaatgcctttctcctctgctagcatctgaaggtgggagaggtttttgtattttggatttgctgtataggttatatggttgaacttccttagtagatatatatattttcctgtttcgtatcatggatcttgtttaagaattaagatgtattgcgtacttgaatgcttacgaattaggttgtgaagtgggattattacaccta

SEQ ID NO: 512 - DNA, 1132 bp, Prunus persica
ctcattaaaccccccaactttcccttttatctctctctctctcccaaaaagagccaaaacaaaaccagtgtggaagaaggcgcttgacagatcagagagagagaaagagcgcttcacacaaacaaaacccaaaaatccaaaacaaaatcaaaaggagaaaaaaaaagaaggaaaatacaaaacctctgttcctctctctgaaaccaaaagctaagcaaagcaggtggtctcaggggaaggctcaaatcaaatggggcagaagtcgctgatctacgcgttcgtagcacgaggcactgtgattctggcagagtacacggaattcagcggcaatttcaactccatagcgtttcagtgcctccagaagcttcccgctaccaacaacaagttcacttacaactgcgatggccacaccttcaattacctcgtcgacaatggctacacgtattgtgtggttgcagatgaatcatctggaagacaagtacctatcgcttttctggagcgtatcaaagatgattttgtttcaaaatatggtggtggaaaggctgctacagcccctgccaatagccttaacaaggaatttgggtcaaaattgaaggaacatatgcagtactgtgttgatcatcctgaagaaataagcaagcttgcaaaggtgaaggcccaggtttcggaagttaaaggtgttatgatggagaatattgaaaaggttttagatagaggggaaaagatagagcttttggtcgataagactgagaaccttcatcaacaggcacaggacttcagaaatgttgggacgaaaatgcggaggaagatgtggctgcagaacatgaaggtgaagctgattgttttgggaatcctgatcgcactaatccttgtcataatcctctccgtttgccatggtttcaactgtggaaaatgagcttcaagaaaagcttttggtcttgccagtccaaacttttgcaattatatgtagtattattataagagaaagatcaagtgtctgttgcaagtctggttacaaatatgtgtcaaaaggcgaagacgtattttttgtgtgaatgaatggaactccctatatgatgctagtcataagaatgttttgctaaaaaaagaattcaaattgcttattgcttta

SEQ ID NO: 513 - DNA, 1079 bp, Prunus persica
ttggcgtgactttgaatctctttctgcaacaaaaaaaaccctcaaaccctcckccctctctttctctctaatckaaatcgaaagcttcgctcctagggttagggtttggggatcgaatcgatggggcagcamtcgttgatctacagcttcgtggcgcgtggcacggtgattctcgcagagtacacggaatkcactggaaacttcaccakcatascttckywktgcctccagaaactacctgctwctwcaacaagttcacgtacaactgcgacggccacaccttcaactacctcgtcgayaatggctkcacatactgwgtakttgcrrwygaggctrtyggtagacaaattcctattgctttccttgagcgaatcaaggaggattttaccggtagatatggtggaggaaaagctgcaacagcagtagcaaatagtctgaacaaggaattcgggtccaaactgaaggagcatatgcaatattgtgttgatcaccctgaggagatcagcaagcttgctaaagtgaaagctcaggtctcagaagtcaaaggagttatgatggaaaatattgaaaaggttcttgatcgtggggagaaratagagcttctggtggataaaacagaaaaccttcgctcacaggcacaagatttcaggcagcaaggaacccagatgagaaggaagatgtggctgcagaacatgaagatcaagctgatcgttttgggaatcttaattgctttgattctcatcattgttctatctgtttgcaatgggttcaaatgctgatgcgagaatcttaatcaggaaccggatggagctcatcgtgctgatttctacaagccggtctacgtacaattattttttgttacacatcctattttctactataatttgtattgtaagacagtttgtatagcttgtattcgtgaattctttctatattagtctcttggatgtgcgaatcggtttttggttccttttgttccatggaacttctgttgtatcactgttgtgagtgatttggcaaaccactgtgagtgattttagatttgttgttcaacaaatggaaagggcatcttcatacta

SEQ ID NO: 514 - DNA, 1207 bp, Arachis hypogaea
  misc_feature (1194)..(1194): n is a, c, g, or t
ttctctctcttaaaaaagatcctagagagagaaagtgagaaataaagggtttccgtttcgatttcttcatcatcaccaccaccgaagcaaacactgttcctagatctctttctccctttctcttcttttttttcattcggaatccctagaattttttcgaatttcaaattttcggaatttcgattcatcgatggggcagaaccagaggtcgctgatctacgctttcgtttctcgcgggaccgtgattctcgccgagtacactgaattctcagggaacttcaactccatcgctttccagtgccttcagaagctacccgctaccaacaacaagttcacctacaactgcgataatcacaccttcaattaccttgttgacaatggatacacatattgcgttgttgcggatgaatcggtcggaagacaggtacccattgctttcctagagaggatcaaggatgattttgtgtctagatttggtggtggaaaggctgctacagctcctgcaaatggtcttagcaaggaatttggcccaaagttgaaggaacatatgcagtactgtgtggatcatcctgaagagataagtaagctggcaaaggtgaaagctcaggtttctgaagttaaaggtgtcatgatggagaatattgaaaaggttctggacaggggtgaaaagatagagctgctggttgacaagactgagaaccttcatcaccaggcacaagatttcaggaactcaggaaccaaaatccgtcgaaaaatgtggctgcagaacatgaagataaagctgattgtattgggaatcttgatagcactgatcctgatcattgttctgtctgtgtgtcgtgggttcagtcactgtggaaaatgagcaccatattctctgaggacgcattttgtgtttattttagcttcttgtgattatgagaggaaagatatcactatatgtcatgactttgtatgtagtaaagataacaattcggtatgctgttcacgttgttctacttatataggattgcttttgaaaatataagtttggttttctgttcaagtaatcaagttcttttctaattcccatttttcacgcaaaattacttctgatatttttttccattacaacttttctaattgtattgcttaaatcattattagcattattagtttcaattcgtgctatcttacttttgaagtttgaaaganaaaaaggagggga

SEQ ID NO: 515 - DNA, 903 bp, Arachis hypogaea
ggccggggaagcaaacactggtttctttgtattactactcagatctgatcttgaatcagaagaaatcagaaggaaaatgggacagaaatctctgatctacgccttcgtctctcgcggaaccgtggttcttgcagagtacactgaattcagcggcaacttcaacaccatcgccttccagtgcctccagaagcttccttcctccaacaacaagttcacctacaactgcgacagccacaccttcaacttcctcgtcgacaatggcttcacttactgtgttgttgcggatgattctgctggaaggcaggttcctattgcgtttctggagcgagtgaaggatgattttgtttccaaatatggtgcctccgataaggccggtgctagtgctgccaacagccttaacaaggagtttgggccgaaattgaaggagcatatgcagtactgcatcgatcaccctgaggagataagcaagcttgccaaggttcagaatcaggtctctgaagttaagggtgtcatgatggagaatattgaaaaggttctggacaggggagaaaagatagagcttctagttgacaagactgagaaccttcataatcaggcacaagactttaggacttcagggaccaaaattcgtagaaaaatgtggctgcagaacatgaagatgaagctgattgtattggcaattttgatagtcctgatcctcgtaattgtcctttccgtctgccatggattcaagtgtggaaaataagcactccatcttccacatattttatatttttttcattttgaccactcttgtgattatatattgttgaggaaagatatcacattcgtgacatgattttgtacgtagtaaagacatcatcatattccttattcactttggtctaactatgatatttttac

SEQ ID NO: 516 - DNA, 801 bp, Capsicum annuum
cctcgtgccgcgaaaaacagcctagggtttttctgctcttctcctatcaactgtgagaagaaatggggcaacaatcgttgatctacagcttcgttgctcgaggaacggtgattctcgctgagtatactgaattcactggaaatttcactagtattgcatcgcagtgtctccagaaacttccggcttcgaataataagtttacttataactgtgatggacatacttttaactacctcgttgatgacggcttcacatactgtgttgttgctgtggaatctgttggcagacaggtcccaattgcatttctggagagagttaaggatgattttaccaagaaatatggtggaggcaaagctgctacagctgttgctaacagcttgaacaaggagttcgggcccaaaatgaaggagcagatgcagtactgtgttgatcatccagaggaaatcaacaagcttgcaaaggtgaaggctcaggtttcagaagttaaaggtgtgatgatggaaaacattgagaaggtcctggatcgcggggagaaaattgaacttttggtggacaaaactgagaatcttcgctcacaggcacaagattttaagacacaaggaacaaaagtgaggaggaagatgtggttgaagaacatgaagatcaagcttatagtcctgcgcatcattattgccttgattctggtcatagttctttcaatatgtcatggcttcaaatgtcattaattggtggtccttttctttgttttaataaacctggctattgaactataattcttaatatttctagcagtaaaatgcc

SEQ ID NO: 517 - DNA, 948 bp, Petunia hybrida
tcatcttccttcaattctctttctttctcccctctctctctctctcaagaatcccttttttccttgaagggattctccattaacaaagattttcaagaaaatagagagagctagctagggagatggggcaacaaacgttgatctacagctttgtcgcccgaggaacggtgattttggctgagtataccgaattcactggtaatttcaacaccattgcttcacaatgcctccaaaaattgcctgcatcaaataataggttcacttacaactgcgatggccacactttcaattttcttgccgagaatggattcacctactgtgtggttgctacagaatcagcaggcagacaaattcctatagcattcttggagcgtatcaaggatgattttaccaagagatatggtggaggaaaagctgctactgctactgctaaaagcctgaacaaggaatttgggccaaaattaaaagagcacatgaagtactgtgttgaacatcctgaagaaattagcaaacttgctaaggtgaaagctcaagtttcagaagttaaaggagttatgatgcaaaacatcgaaaaggttcttgaccgtggtgagaagattgagcttctagttgataaaactgagaatcttcgrtcacaggctcaggacttcaggcaacaaggtacaaagataaggaggaagttgtggtatgaaaatatgaagataaaattgattgtgttagggattatcatagctttgattctcattatcattttgtccgtttgccctggcttcaactgtttttaattaaacacttgcatcagactcaaccttttccctgattatgatgtagatgtatattaatcaggattagtttgtcttacttttctccttttgggaattgtatttgttattgtaacatttgtctttgttctttctccaaatgaaattcctcaagtcaggtgcaaat

SEQ ID NO: 518 - DNA, 1129 bp, Ananas comosus
tcctctccgatcgctttcccttctccctcgcggcgagatctagggttagggctagggtttcggcgaggaaaggaggaggaggaggtgggagatggggcaacagtcgctgatctacagcttcgtggcgcgggggacggtggtcctcgcggagtacacggagttctccgggaacttcaacaccatcgccgcgcaatgcctccagaagcttcccgcgagcaacaacaagttcacctacaactgcgatggccacaccttcaactacctcgtcgaggacggattcacgtattgtgtggtagcagttgagtcagttgggaggcaaattcccattgctttcttagagagggttaaggaggattttacgaaaagatatggaggaggcaaagctgcaactgctgcggccagcagccttaaccgagattttgggtcaaaactgaaggagcacatgcagtactgtgtggaccacccggaggagatcagtaagttggctaaagtgaaagctcaggtttcagaagttaaaggagttatgatggaaaatatcgagaaggttcttgatcgcggagagaaaattgagctgcttgtcgacaagacagagaaccttcgctcccaggcacaagattttcggcagcaagggacgaagatacgaaggaagatgtggctgcagaacatgaagataaagctgattgtgctggggatcatcatcgccctaatcctcatcatcatcttatccgtctgccacggcttcaaatgctaatatgggtgaaccctagattgcttcagaatgtcccacttcccctgaaattggactctggttttcgagcttgatgaagatgtttcgtgctatttccatagatatcggtgcgttcttgatggttcttaagagtaaaatactattcctcttgtaattagcatactttcggtaagtgtttgggaacttggtcgatggcttgaaatgactcttttagatattttgtgcgtatactttggtcggaatattttcttgctattgtagtaggatgtttcttattacatgctttgtgtcgcaaatataaagggttataggtgcatctaatactcgaaattcattcgtcctatttaaatttgatccttatgatttcatcacattcgtcgt

SEQ ID NO: 519 - DNA, 1006 bp, Populus trichocarpa
ttttaaaaaaccacatctttgaaagccctctcctctttcgcttttactctctctctctctctccttcccaaaagcaacaaggaaacaaacgacaaggagagagagataccaaaaaatccctctcagatctctctctcttttgaaaaccccaaattttgaattttcaaaaatgagccagaaatcactgatctacgcatttgtttctcgaggaactgtgattcttgctgactatactgagttcagtgggaatttcaattccatagcttttcaatgtctccagaaacttcctgctactaacaacaagtttacttacaactgtgatggccacactttcaattacctcgttgacaatggctttacttattgtgtggttgcagctgaatcggctggaagacaagtacctatagcttttctggagcgtgttaaggatgattttgtgacaaaatatggcggtggaaaggctgccacagcccaggccaacggtcttaacaaggaatttgggccaaaattgaaggaacatatgcaatattgtgctgatcatcctgaagagataagcaagcttgccaaagtgaaagctcaggtctctgaagttaagggtgtcatgatggagaacattgagaaggttttggataggggggagaaaatagaacttcttgtggacaagactgagaaccttcatcaacaggcacaagacttccgcagtcaagggacacaaatccggagaaaaatgtggctgcagaacatgaaggttaagctgattgtattgggtatactgattgtcttgatcctcatcatagtcctctctatttgcaaaggcttcaactgctgagagtgagagatgtttttgaaggcttgataatactgtttctagagcttttgcgagttacaaaagcaaataccgaatatattgttatgactgtgtgtagcagcaactagtgatttctttgatatatcgtccaagaactttatttttgaacgtgaatgaaaccctatatgttatttgtca

SEQ ID NO: 520 - DNA, 1083 bp, Populus trichocarpa
aataaactcctctttctctccgatcctctcatctctctagtttcgtatctattgctgaatatttgatttgatcatctgatcctctagggttttttttcttcgggaaataaaggagaggaggtggagatggggcaacaatcattgatctatagctttgtggcaagaggaactgtgattcttgcggagtacacggagtttaaaggcaatttcactggcatcgctgcacaatgtcttcaaaaacttcccgcttccaataacaagtttacttataattgcgatggccataccttcaattacctcgttgaagatggattcacctactgcgtggttgcagttgaatccgctggcagacaaatcccaattgcctttttggagcgagttaaggaagattttaacaaaagatatggtggaggaaaagcagcaacggctgttgccaatagcctgaacagagagtttgggtccaagttgaaggagcacatgcagtattgtgtggatcatcctgaagagatcagcaagcttgcaaaagttaaggctcaggtttctgaagttaagggtgttatgatggaaaacattgagaaggttcttgatcgtggagagaagattgagctgctggtggataaaactgagaaccttcgctcacaggcacaagatttccgacaacagggaactaagatgagaagaaagatgtggattcagaatatgaagatgaaattgattgttttgggtattatcattgccttgattctcatcatagtgttatccgtgtgccatggcttcaattgttaatttctcctggattccactggatgcttctcttgctgccaagattactggattgtctttgctaaattgattctgacgatttgtccacgagatctctctctacatggtcatttatgtcttactccattcgctttctgttagctttgtttaggatgcgagaggttttgtgttttgaatttgtttgtataggttatatgaactcccgagtagataattttcttctcctacatggtattaaaatttgtttaatttgtgatgaatattgaatcccagcaatttagatcgtcctttgcaatgtta

SEQ ID NO: 521 - DNA, 1130 bp, Populus trichocarpa
tttatatttctccctctcccaaattcaactccctatctctctctctctctcgctctcgctctcatccgttccacatttccactatttctagggtttgagtgtttccgtgtttttctcggggaaaggaaggagaggaggtagagatggggcaacaaacgttgatctatagctttgtggcaagaggaacggtgattcttgcggagtacacggagtttaaagggaatttcacaggcatcgctgcacaatgtcttgaaaaacttcccgcgtctaataataagtttacttataattgcgatggccataccttcaattacctcgttgaaaacggattcacttactgcgtggttgcagttgaatctgctggcagacaaattccaattgcctttttggagcgagttaaggaagattttaacaaaagatacagtggaggaaaagcagcaactgctgttgccaagagcctgaacggagagtttgggtccaaattgaaggggcatatgcagtattgtgtggatcatcctgaagagatcagcaagcttgcaaaagtcaaggctcaggtctctgaagttaaaggtgttatgatggaaaacattgagaaggttcttgatcgtggtgacaagattgagctgctggtggataaaactgagaaccttcgctcacaggcacaagatttccgacaacagggaactaagatgagaagaaagatgtggattcagaatatgaagataaaactgattgttttgggtattataattgccttgattctcatcatagtcttatctatttgtcatggattcaattgctaatttatcttggctttcactggaagctgcttttgctgcggattgtctttgcggaattgattcttatttgtttttgatgatatgtccttgagatctctttttctacagtgtcttttatgtcttagattactcctttctccttgttagctttgtttaggattgtgaaaggttttgtattttgaatttcgttgtataggttatatgaactcttgagtagataattttcttccttcctcctacgttagtattaataatttagtatttgtttaatgtgtaatgaacatcgaatccatgcagtttagattgtcctttgcaatgttattattatac

SEQ ID NO: 522 - DNA, 1135 bp, Populus trichocarpa
atcacacaaaaacccatcattaaattaaaccatacttttccttttctttactctttcctctctctcctcaccctttccccttcccaaaacacatctcattaaaccctcttctctttctcctctactctctcccccccttgaaccaacaaagaaacagactagaacaaggagagagataccaacaatctctctcagatctctttatttggaaaaccccaaattttgaatttttaaaaatgaaccagaaatcactgatttacgcgtttgtttcacgaggaactgtgattcttgctgagttcactgaattcagcgggaatttcaattccatagcgtttcaatgtctccagaaacttcctgctactaacaacaagtttacttacaactgcgatggtcatactttcaattacctcgccgacaatgggtttacatattgtgttgttgcggatgaatcggctggaagacaagtgcctatggcttttctggagcgtgtcaaggatgatttcgtgtcaaagtatggcggtggaaaggctgccacagcccaggccaatggtcttaacaaggaatttgggccaaaattgaaggaacatatgaagtattgtgctgatcatcctgaagagataagcaagcttgcgaaagtgaaagctcaggtttcagaagttaaaggtgtcatgatggagaacattgagaaggttctggataggggagagaaaatagaacttcttgtggacaagaccgagaaccttcattcacaggcacaagactttcgcagtcaagggacacaaatccggagaaaaatgtggctgcagaacatgaaggttaagctgattgtattgggaatactgattgccttgatcctcatcatagtcctctctgtttgcaaaggctttaattgtggaaaatgagagctggctattctttgaaggcttgataatactgtttctagagcttttgcgagttgcaaaagcagatactgaatatattgttatgaccatgtgtgtagcagcaactagagatttctttgatatatcgtccaagaacttatttttgaatgtgaatgaaaccctatatgttattgtcatatcatttcaacctttcgtgatagataaaaagttggattacctccaagcggggtccc

SEQ ID NO: 523 - DNA, 1054 bp, Populus trichocarpa
cgctgcctgcctaccttgaagctttcttcacctccaagcgataacgaaatcctccctatttcctctctcgtcttcgaaaattcatctccgcttctactgctacgaaacctagcttctctcccagggttagagcttatttttgcagtagatggggcaacaatcgttgatctatagcttcgtggctcgaggcacggtgattttggctgattacaccgatttctctggtaacttcgcgggcatagccgctcagtgtctccagaaacttcctgcaactaacaacaagttcacttacagctgcgatggccacaccttcaactacctcgtcgataacggcttcacttactgtgtagttgcagtggagtctgtggggcgacagattccgattgcctatctcgagagaatcaaggaggattttaccaacagatatggtggggggaaagctgcaatagcggttgctaatggtctgaagaaggaatttgggccgaagttgaaggagcagatgcagtattgtatggaccatccagaggaagtcagcaagcttgccaaagtgaaagctcaggtttctgaagtgaaaggagttatgatggaaaacatagagaaggttcttgatcggggagagaaaattgaacttctggtagacaaaacagaaaaccttcgctctcaggcacaagttttcaggcagcaagggggccagataaagaggaaaatgtggtggcagaacatgaaaataaagctgatagtgctggcgatcttgattgtcctgattctcatcatagtattgtctatttgtggtggcttcaaatgctgaagatgatctaccttcacttttttgggggttacacgtaccaggttctgctatatagtttttggcttcaaatgactgtatcatacgacagtgcctgtatagttttttctttttgaattatttacaatttcttgacgtgtgcggccattccttgttattcatttactactcgatatgtttttggttaaatacaatgaatttgattacctcaagaagtggaaagtggcaaattggagatggcatcttacc

SEQ ID NO: 524 - DNA, 1060 bp, Solanum tuberosum
ctctaaaaatcaagagagagaaaaaggggcacaaggatatagaggaggtccattagtctacacttttttctcacctttgaattcttctttgtttgcttgctaagcaaaatcgaagaaaacccacaaaaccagatcggcgatccaccggaaaagcaagaaatcggttgtaaatgggtcaacagaaagctttgatctatgcgtttgtcggtcgtgggaatgttatattggctgaatacacagatttcagtggtaacttcaactccatagcttatcagtgtcttcagaagctgcctgcttccaataacaagttcacttataactgtgatggtcataccttcaactaccttgttgataatggattcacatactgtgtggttgctgaggagtctgttggaagacaaattccaatagcgtttttggagcgcattaaggatgatttcatgtcaaaatatgggagtgggaaggctgcgacagctcctcctaatagcctgaacaaggaatttggccctaagttgaaggagcatatgcagtattgtgctgaacatcctgaggaaattagcaaacttgccaaggtgaaagcacaggtttcagaagttaagggtgttatgatggaaaacattgagaaggttcttgatcgtggagagaagatagagcttcttgttgataagacagagaaccttcatcaccaggcacaagacttcagggaacacggggaacccaaatacggaggaagatgtggctgcaaaacatgaaaatcaagctgatagtgttaggtatcctgatagctttgatcctcatcattgttctctcagtttgcaagggattcaattgtggaaagtgaggatgtttctattgtgatgctatagttgtatgaaaagctttgtcttatatcagcatttacaattctatgagaatagagatggtgtatgtttctgtatgtattagcctactcactttttttctgtttgttggagcagaaaggatctgagttttctcttctttatattctgatctaaatgtcgtagtatatgatgccgccattgagaggtcattttgtgct

SEQ ID NO: 525 - DNA, 971 bp, Solanum tuberosum
cattttgttctctgcaattcgaaatagctagggtttttgtctcttctcgagtgtgagaagagagagcaaaaatggggcaacaatcgttgatctacagcttcgttgcgcgaggaacggtgattctcgctgagtatactgagttcactggaaatttcaccagtattgcatcgcagtgccttcagaaactccctgcttccaacaacaagttcacctataactgtgatggacatacttttaactacctcgtcgatgacggcttcacatactgtgttgtagctgtggagtctgttggcaggcaggtcccaattgcatttctggagagagttaaggatgattttaccaagaaatatggtggaggcaaagctgctacagctgttgctaacagcttgaacaaggagtttgggcccaaaataaaggatcagatgcagtactgtgttgatcatccagaggaaatcaacaagcttgcaaaggtgaaggctcaggtttcagaagttaaaggtgtgatgatggaaaacatygagaaggtcctggatcgtggggagaarattgaacttttggtggataaaactgagaatcttcgttcacaggcacaagatttcaagacacaaggaacaaaagtgaggaggaagatgtggttgcagaacatgaagataaagcttatagtcctgggcatcattttggccttgattctggtcatagttctttcgatatgtcatggcttcaattgtcattaattgatggtcatttatwtattawwacggtggttattgaactataattcttaatacttctagcagtaaaatgcctgatccttgtaattcattttttattttttgaatgatacattttgctctatgctgtggatggtatgattaagttcctatatagcttgtcatgctgtgaagtgacttactgctgaaagcttctccttgggagctgacgtgtagtatacttttgaaagatccaaaatt

SEQ ID NO: 526 - DNA, 1147 bp, Solanum tuberosum
ctcgctttctctctctaaaaatcaagagagagaaaaagggcacaaggatatagacgagtccattagtctacactttttctcacctttgaattcttctttgtttgcttgctaagcaaaatcgaagaaccacaaaaccagatcggcgatccaccagaaaagcaagaaatcggttgtaaatgggtcaacagaaggctttgatctatgcgtttgtcggtcgtgggaatgttatattggctgaatacacagatttcagtggtaacttcaactccatagcttatcagtgtcttcagaagctacctgcttccaataacaagttcacctataactgtgatggtcataccttcaactaccttgttgataatggattcacatactgtgtggttgctgaggagtctgttggaagacaaattccaatagcgtttttggagcgcattaaggatgatttcatgtcaaaatatggcagtgggaaggctgcgacagctcctcctaatagcctgaacaaggaatttggcccaaagttgaaggagcatatgcagtattgtgctgaacatcctgaggaaattagcaaacttgccaaggtgaaagcacaggtttcagaagttaagggtgttatgatggaaaacattgagaaggttcttgatcgtggagagaagatagagcttcttgttgataagacagagaatcttcatcatcaggcacaggacttcaggaacacgggaacccaaatacggaggaagatgtggctgcaaaacatgaaaatcaagctgatagtgttaggtatcctgatagctttgatcctcatcattgttctctcagtttgcaagggattcaattgtggaaagtgaggatgtttctattgtgatgctatagttgtatgaaaagcttttgtcttatatcagcatttacagttctgtgagaatagagacggtgtatgttctgtatgtattagcctactcactttttttctgtttgttggagcagaaaggatcagagttttctctgctttatattctggtctaaatgtcgtagtatatgatgccgccattgagaggtcattttgtgctgttaatgatatgttcctttttataagaaaaagacctgcaatgctagaaactcttgtcaatgatattcaatttttcatccagtt

SEQ ID NO: 527 - DNA, 1106 bp, Prunus persica
ctcattaaaccccccaactttcccttttatctctctctctctcccaaaaagagccaaaacaaaaccagtgtggaagaaggcgcttgacagatcagagagagagaaagagcgcttcacacaaacaaaacccaaaaatccaaaacaaaatcaaaaggagaaaaaaaaagaaggaaaatacaaaacctctgttcctctctctgaaaccaaaagctaagcaaagcaggtggtctcaggggaaggctcaaatcaaatggggcagaagtcgctgatctacgcgttcgtagcacgaggcactgtgattctggcagagtacacggaattcagcggcaatttcaactccatagcgtttcagtgcctccagaagcttcccgctaccaacaacaagttcacttacaactgcgatggccacaccttcaattacctcgtcgacaatggctacacgtattgtgtggttgcagatgaatcatctggaagacaagtacctatcgcttttctggagcgtatcaaagatgattttgtttcaaaatatggtggtggaaaggctgctacagcccctgccaatagccttaacaaggaatttgggtcaaaattgaaggaacatatgcagtactgtgttgatcatcctgaagaaataagcaagcttgcaaaggtgaaggcccaggtttcggaagttaaaggtgttatgatggagaatattgaaaaggttttagatagaggggaaaagatagagcttttggtcgataagactgagaaccttcatcaacaggcacaggacttcagaaatgttgggacgaaaatgcggaggaagatgtggctgcagaacatgaaggtgaagctgattgttttgggaatcctgatcgcactaatccttgtcataatcctctccgtttgccatggtttcaactgtggaaaatgagcttcaagaaaagcttttggtcttgccagtccaaacttttgcaattatatgtagtattattataagagaaagatcaagtgtctgttgcaagtctggttacaaatatgtgtcaaaaggcgaagacgtattttttgtgtgaatgaatggaactccctatatgatgttactacctagtcataagaatgttttg

SEQ ID NO: 528 - DNA, 1089 bp, Prunus persica
gacgataaaccaccgtgactttgaatctctttctgcaacaaaaaaaaccctcaaaccctccgccctctctttctctctaatcgaaatcgaaagcttcgctcctagggttagggtttggggatcgaatcgatggggcagcaatcgttgatctacagcttcgtggcgcgtggcacggtgattctcgcagagtacacggaattcactggaaacttcaccagcatagcttcgcagtgcctccagaaactacctgctactaacaacaagttcacgtacaactgcgacggccacaccttcaactacctcgtcgataatggcttcacatactgtgtagttgcagttgaggctattggtagacaaattcctattgctttccttgagcgaatcaaggaggattttaccggtagatatggtggaggaaaagctgcaacagcagtagcaaatagtctgaacaaggaattcgggtccaaactgaaggagcatatgcaatattgtgttgatcaccctgaggagatcagcaagcttgctaaagtgaaagctcaggtctcagaagtcaaaggagttatgatggaaaatattgaaaaggttcttgatcgtggggagaaaatagagcttctggtggataaaacagaaaaccttcgctcacaggcacaagatttcaggcagcaaggaacccagatgagaaggaagatgtggctgcagaacatgaagatcaagctgatcgttttgggaatcttaattgctttgattctcatcattgttctatctgtttgcaatgggttcaaatgctgatgcgagaatcttaatcaggaaccggatggagctcatcgtgctgatttctacaagccggtctacgtacaattattttttgttacacatcctattttctactataatttgtattgtaagacagtttgtatagcttgtattcgtgaattctttctatattagtctcttggatgtgcgaatcggtttttggttccttttgttccatggaacttctgttgtatcactgttgtgagtgatttggcaaaccactgtgagtgattttagatttgttgttcaacaaatggaaagggcatcttcatacta

SEQ ID NO: 529 - DNA, 1152 bp, Pseudoroegneria spicata
  misc_feature (8)..(10): n is a, c, g, or t
ccccgctnnnctccaccaaagcgaaaccgacctttcccccttcccacctcccctcccccccagcagcctcgccgagatccaatccggcagcccccctcccccaccggcggcgagcgcgagcggagagagcgagggcggagaggcggggaagcaggcgagcgggaggagccatggggcagcagtcgctgatctacgcgttcgtcgcccgcggcaccgtggtgctggccgagtacaccgagttcacggggaacttcaccaccatcgcctcccagtgcctcgtcaagctcccggccagcaacaacaagttcacctacaactgcgacggccacaccttcaactacctcgtcgaggacggattcacatactgtgtggttgctgttgaatcagtggggcaacagatgccaattgctttcttggttcgggttaaggacgatttcagcaaaagatatgctggcgggaaggctgctactgctgcaccaagcagcctcaacagagagtttggatcaaaactcaaagagcacatgcagtactgtgtagaccatcctgaagagataaacaagctcgctaaagtgcaagcacaagtttcagaagtcaagaacgtgatgatggaaaacattgagaaggttcttgatcgtggagagaagattgagctgcttgttgacaagacagagaatctccgctcacaggcccaggatttcaggcagcaaggaacacaggtgaggagaaagatgtggctacaaaacatgaagatcaagctgatcgtcctgggcatcatcgtcgcgctcatcctcatcataatcctgtcggtgtgccacggattcaactgcggcaagaagtgaggaggacttgaggtgatgagacacattcaacttgcccctatattactgctgattcgagcaaaacccatatatggtgcttagtgttctttcttgtctagtgtgcgctggcccgggccgtggtgcctgtgggtgggtctgtgttttcgttgtggtcgtgttgggatatttgcttaccgcctgatgggtggtggctgggtcagcgggtcgtgtatttttggacgctatgtatgtatagcttggatcgtgacccctttgttctatttttatatgatgatgatgagtagtagatttacttaaaaaaaaaaaattttta

SEQ ID NO: 530 - DNA, 1107 bp, Raphanus sativus
cgtctctctctctctttagtctctacgcgtttcagcgttaagtcttttctagatcttctctaccttccttcacgccgttataataacaaaactctctgatcagtcaataaaatccatcggaacagcgttgttgtttttttgttcccagtagagagagagagagagagagaacacaggaaaaaaagggatggcgcaacagcaacaatcgttgatctacagtttcgtggctcgagggacggtgatcctggtggagttcacggatttcaagggaaatttcacatcgatcgctgcacagtgcctccaaaagcttccttcttccaacaacaagttcacctacaactgcgatggtcataccttcaattacttggttgaaaatggattcacttattgtgttgttgcagttgattctgctgggaggcagattcctatggctttcttggagcgagttaaggaggatttcaacaagagatatggtggtggcaaggctgctactgctcaacccaactccttgaataaggaatttgggtcgaaactgaaagagcacatgcagtattgtatggatcatcctgatgagattagcaagcttgctaaggttaaagctcaagtttctgaagttaaaggtgtcatgatggaaaacattgagaaggtccttgaccgtggtgagaaaatcgaacttttggtggacaaaaccgaaaaccttcgctcacaggcgcaagatttcagaacacaaggaactcaaatgagaagaaagatgtggtttcagaacatgaagataaaactcattgttcttgcaatcatcatcgccttgatcctcatcatcgtcctctcagtctgcggtggcttcaactgcggcaaataagtccggaacatctctgatttccgagaacatcatcctcattcagtttgttgtgctttttttttttctttttggtttaaaatttctcatggctatgtttctcttgcttagatttgcacttgttgaaattggttttgtataggtcatatatatatatatgtatgaaactgattcttgcaaaccatttacttgggacctaatttgaacgcttgtgtttgctttggtctttttattattttttacttctgaga

SEQ ID NO: 531 - DNA, 985 bp, Raphanus sativus
tatagatctgtagtagttctaacgcgacatcccataaaatcctctgttcagacggttcgatcggatcgagtcggatctaggggattcgaaaaagatgtcgcaacagtcgttgatctacagtttcgtggccagaggaacggtgatcctcgtggagttcacagatttcaaaggcaacttcacaaccatcgccgcacagtgcctccagaagctcccctcttccaacaacaagttcacctacaactgcgacggtcacaccttcaactacctcgtcgaagatggcttcacctactgtgttgttgctgttgaatctgctgggaggcagatcccgatggcctttttggaaagagtaaaggaggattttaacaagagatatggtggtggaaaggctgcaactgctcaagctaacagcttgaataaagagttcggctctaagctgaaagagcacatgcagtattgtatggatcatcctgatgagattagcaagcttgctaaggttaaggcgcaagtgtctgaggttaagggtgttatgatggagaacatcgagaaggttcttgaccgtggtgagaaaattgagcttcttgtggacaaaactgagaaccttcgctcacaggcacaagacttcagaacaacaggaactcagatgagaaggaagatgtggcttcagaacatgaagattaaactcatagttctcgccatcatcatcgcactgattctcataatcgtgctctcagtctgccatggcttcaagtgctaaaagcccaggaaaaaaattcaaaactctcttgagatctttctcactcggtacatcgtgtacttgccctttttccctttattgtcctatcatcagcattctaatgtttctgcttgaattggtttttgtatagatagacatatatgtaagcttcacgtttgctatattacttgttgcacctgatgacgttgatccctaagagatctaaaactattaaatgattttgtcgactga

SEQ ID NO: 532 - DNA, 984 bp, Raphanus sativus
agtcttatagatctgcaagttctaacgcgacatcccataaaatcctccgttcgatcggatcgagtcgaatcgaggatctagaaggggttcgaaaagatgtcgcaacagtcgttgatctacagtttcgtggcacgcgggacggtgatcctcgtggagttcacagatttcaaaggcaacttcacaaccatcgccgcacagtgcctccagaagctcccctcttccaacaacaagttcacctacaactgcgacggtcacaccttcaactacctcgtcgaagatggcttcacctattgtgttgttgcggttgaatctgctgggaggcagattccgatggcctttttggaaagagttaaggaggattttaacaagagatatggcgggggaaaggctgcaactgctcaagctaacagcttgaataaagagttcggctctaagctgaaagagcacatgcagtattgtatggatcatcctgatgagattagcaagcttgctaaggttaaggcgcaagtgtctgaggttaagggtgttatgatggagaacatcgagaaggttcttgaccgtggtgagaagattgaacttctggtggacaaaaccgagaaccttcgctcacaggcacaagactttagaacaacggggacgcagatgagaagaaagatgtggcttcagaacatgaagataaaactcatagttctcgccatcatcatcgcactgattctcataatcgtgctctcagtttgccatggcttcaagtgctaaaagcccaggaaaaattcaagactctcttgagatctttctcactcggtacatcgtgtacttgccttttttccctttattgcccctatcatcatcattctaatgtttctgcttgaattggtttttgtatagatagacatatatgtaagcttcacgtttgcttatattacttgttgcacctgatgacgttgatccctaagagatctaaactattaaatgattttgtcgact

SEQ ID NO: 533 - DNA, 1096 bp, Raphanus sativus
ggatttcaattaaacgttagatgtcactcctcttttctctctctttcactttagtcctcgattctctctctctctacgcgtttcagcgttagtcttcttctatctctagatctctgccttccttccttcctccacgccgttataataaatctccgatccatctcctcctccgcgttaggaaaaaaaagaaaaaaaaagaagaaatggcgcaacaacaatcgtcgttgatctacagcttcgtggctcgaggcacagtaatcctcgtggagttcaccgatttcaaaggaaacttcacatcaatcgccgcacagtgcctccaaaagctcccttcctcgaacaacaagttcacctacaactgcgatggtcataccttcaattacctcgtcgagaatggattcacttattgtgttgttgcagtcgattctgctgggaggcagattcctatggccttcttggaacgggtgaaggaggatttcaacaagagatacggtggtggaaaggctgctactgctcaagctaacagcttgaataaagagtttgggtcgaaactgaaagagcacatgcagtattgtatggatcatcctgatgagattagcaagcttgctaaggtgaaagctcaggtgtctgaagttaaaggtgtcatgatggaaaacattgaaaaggttcttgaccgtggtgagaaaattgaacttttggtggacaaaactgaaaaccttcgctcacaggcgcaagatttcagaacacaaggaacacagatgagaagaaagatgtggtttcagaacatgaagataaaactcattgttcttgcaattatcatcgccttgatcctcatcatcgtcctctcagtctgcggtggtttcaactgtggcaaatgagtctgggaacatttcactgattttccgtcaacatcctcctcattcacttcgtcgtgctgcttcttcttttttgtggtttctaaattctcatgctctatgtttctctgcttagattgtatttcttgaagttggttttgtataggccataatatatatgtatgaatgttcgacattttgccaacatttgctattggtggtttcgacactgattcttgcgaacc

SEQ ID NO: 534 - DNA, 841 bp, Raphanus sativus
gaaaaaaatggcgcagcaacaatcgttgatctacagtttcgtggctcgagggacggtgatcctggtggagttcactgatttcaaaggcaacttcacatccatcgctgcacagtgcctccagaagctcccctcttccaacaacaagttcacttacaactgcgacggccacaccttcaactacctcgtcgaagatggattcacgtattgtgtggttgcggttgaatctgctgggaggcagattccgatggcgtttttggagagagtgaaggaggattttaacaagagatatggtggtgggaaggctgccactgctcaagcaaacagcttgaataaagagtttgggtctaagctgaargagcacatgcagtattgtatggatcatcctgatgagattagcaagctcgctaaggtgaaggckcaagtgtctgaagttaagggtgttatgatggagaacatcgagaaggttcttgaccgwggtgagaagattgagcttctggtggacaaaaccgagaaccttcgttcacaggcacaagatttcagaacaacggggacgcagatgagaagaaagatgtggcttcaaaacatgaagataaaactcatagttctcgccatcattgtcgccttgattctcattatcgtcctctcagtttgccacggcttcaaatgctaaactcakaaaaaatttyaaaaactctcttgagaatgcatctttctcactaggtacattggtactgccttttgcttttattgtcctatcatcattatcattctaatgtttgccccttgaattggtttttgtatagatagacatatatatgtatgcttcatattttgctatatt

SEQ ID NO: 535 - DNA, 899 bp, Raphanus sativus
ggacctttagtcctcgttttgttgctgtgtagtcttatagatctgtagtagttctaacgcgacatcccgtaaaatcctccgttcgatcggatcgagtcgaatcgaggatctagaaggggttcgaaaagatgtcgcaacagtcgctgatctacagcttcgtggcacgcgggacggtgatcctcgtggagttcacagatttcaaaggcaacttcacaaccatcgccgcacagtgcctccagaaactcccctcttccaacaacaagttcacctacaactgcgacggtcacaccttcaactacctcgtcgaagatggcttcacctactgtgttgttgctgttgaatctgctgggaggcagatcccgatggcctttttggaaagagtaaaggaggattttaacaagagatatggtggtggaaaggctgcaactgctcaagctaacagcttgaataaagagttcggctctaagctgaaagagcacatgcagtattgtatggatcatcctgatgagattagcaagcttgctaaggttaaggcgcaagtgtctgaggttaagggtgttatgatggagaacatcgagaaggttcttgaccgtggtgagaaaattgagcttcttgtggacaaaactgagaaccttcgctcacaggcacaagacttcagaacaacaggaactcagatgagaaagaagatgtggcttcagaacatgaagattaaactcatagttctcgccatcatcatcgcactgattctcataatcgtgctctcagtctgcatggcttcaagtgctaaaagcccaggaaaaaaaattcaaaactctcttgagatctttctcactcggtacatcgtgtacttgccccttttccctttatttcccctatcatcatcattctaatgtttctgc

SEQ ID NO: 536 - DNA, 955 bp, Raphanus sativus
ggattgttgtttagtctatagatctctagcttctctcgcgacagcacaattaaatcctctgattagattagagtcggtgtggataggatcggagccgaatcgaatcgaggatttagggtttgagaaagagaaaaatggcgcaacaatcgctgatctacagtttcgtggctcgaggaacggtgatcctggtggagttcactgatttcaaaggcaacttcacctccatcgctgctcagtgcctccagaagctcccttcctccaacaacaagttcacctacaactgcgacggtcacaccttcaactacctcgtcgaagatggattcacgtattgtgttgttgcggttgaatctgctgggaggcagattccgatggcgttcttggagagagtgaaggaggattttaacaagagatatggtggtggtaaggctgccactgctcaagcgaacagcttgaataaagagtttgggtctaagctgaaggagcacatgcagtattgtatggatcatcctgatgagattagcaagcttgctaaggtgaaggcgcaggtgtctgaagttaagggtgttatgatggagaacatcgagaaggttcttgaccgtggtgagaaaattgagcttctggtggacaaaactgagaaccttcgctcacaggcacaagattttaggacaacagggacgcagatgagaagaaagatgtggcttcaaaacatgaagataaaactcatagtcctcgccatcattgtagcgttgattctcataattgtgctctcagtttgccacggcttcaagtgttaagctccgaaaaattcaaaaactcggatctctctcactcggtacattgtactacctttttcttttattgttctgtcatcataatcattctaaatgtttccgcttgaattggttttgtatagatagaccatatatgtatgcttcatattttgctatatcgcttg

SEQ ID NO: 537 - DNA, 1027 bp, Raphanus sativus
atagatctgtagtagttctaacgcgacatcccgtaaaatcctccgttcgatcggatcgagtcgaatcgaggatctagaaggggttcgaaaagatgtcgcaacagtcgctgatctacagcttcgtggcacgcgggacggtgatcctcgtggagttcacagatttcaaaggcaacttcacaaccatcgccgcacagtgcctccagaagcttccctcttccaacaacaagttcacctacaactgcgacggtcacaccttcaactacctcgtcgaagatggcttcacttactgtgttgttgcggttgaatctgctgggaggcagatcccgatggcctttttggagagagttaaggaggattttaacaagagatatggtgggggaaaggctgcaactgctcaagctaacagcttgaataaagagttcggctctaagctgaaggagcacatgcagtactgtatggatcatcctgatgagattagcaagcttgctaaggtgaaggctcaagtgtctgaggttaagggtgttatgatggagaacatcgagaaggttcttgaccgtggtgagaaaattgagcttctggtggacaaaaccgagaaccttcgctcacaggcacaagacttcagaacaacagggacgcagatgagaagaaagatgtggcttcagaacatgaagataaaactcatagttctcgccatcatcatcgcactgattctcataatcgtgctctcagtttgccatggcttcaagtgctaaaagcccaggaaaaaaaattcaaaactctcttgagatctttctcactcggtacatcgtgtacttgccccttttccctttatttcccctatcatcatcattctaatgtttctgctcgaattggtttttgtatagatatatatgtaagcttcacgtttgcttatattacttgttgcacctgatgacgttgatccccaagagatctaaaactattaaatgattttgtcgactgataaactgcttatggtgatgatgataataaattgattacgatagca

SEQ ID NO: 538 - DNA, 977 bp, Raphanus sativus
gggtttagtccttaataggtttgatcaaaaaaaaaaagtccttaatagatctctagttacttcttggcgagacaaagcccattcattaatttaaaaatcgaccggatcgagaggatttagggtttgtgaaagaaatggcgcagcagcagcaatcgttgatctacagcttcgtcgctcgcggcacggtgatcctcgtggagttcactgatttcaaaggaaacttcacctccgtcgccgcacagtgcctccagaagctcccttcttccaacaacaagttcacctacaactgcgacggtcacaccttcaactacctcgtcgaagatggcttcacgtactgtgttgttgcggttgattctgctgggaggcagattccgatggcgtttttggagagagtgaaggaggattttaacaagagatatggtggtggaaaggctgctactgctcagcctaacagtttgaataaagagtttgggtctaagctgaaagagcacatgcagtattgtatggatcatcctgatgagattagcaagcttgctaaggtgaaggctcaagtctctgaagttaagggtgttatgatggaaaatatcgagaaggttcttgaccgtggtgagaaaattgagcttctggttgacaaaaccgagaaccttcgctctcaggcacaagacttcagaacaacggggacacagatgagaaggaagatgtggcttcagaacatgaagattaagctcatagttctcgccatcatcgtcgcactcattcttataatcgtgctctcagtttgccatggcttcaagtgttagaagcacataaaaaaaaaaaatcaaaaacactctttgagatctttctcactcggtcatcatattgattctaatgttaccgcttgaattggttttgtatagatagacacatatatttatgcttcttcatttgctatattgcttgcaacatatgatgctgatcccttgcgaaccagtatc

SEQ ID NO: 539 - DNA, 1199 bp, Oryza sativa
aactagaaaggaaacaaagggccttttttgaaaattccaccaaccaaatttgatttcttttcccatttccacccccatcatttcccctcccactacccaaagcgaaaccgacctttcccccttcttctcccctctcctacctcgccgagatctagccctagggttcgccaacttcaccggcggcgaggagcacgtcaccggcggcgagcacaggcggagggcgaggggagagagagagggaggaggacatggggcagcagtcgctgatctacgcgttcgtggcccgcggcacggtcatcctggccgagtacacggagttcaccggcaacttcaccaccatcgcctcccagtgcctcatgaagctcccggcgagcaacaacaagttcacctacaactgcgacggccacacgttcaactacctcgtggaggacggcttcacatactgtgtcgtagctgttgaatcagtagggcggcagattcccattgcattcttggatagagttaaggatgatttcacaaaaagatatgctggtggaaaagctgctactgctgctgcgaacagcctcaaccgagattttggatcgaaacttaaagaacacatgcagtactgtgtggatcatcctgaagagattagcaagcttgcgaaagtgaaggcacaagtttcagaagtcaaaggagttatgatggaaaatattgagaaggttcttgatcgtggagagaaaattgaactgctcgttgacaagaccgagaatctgcgttcacaggcccaagatttcaggcaggcaggaacacaggtaaggagaaagatgtggctgcaaaacatgaagatcaagctgattgttcttggcataataattgcgctcatccttatcataatcctgtccgtgtgccatggattcaaatgcaagtaggcataaattgactcattcaactgcacttacagtactgcttgcttggggcaaaaagggggggaaattggagaggtgtttggttctttctagtttgtgctctggctggttacggcgcctgagtgtttacgctgtcgtgtctgttgaatgctggttggtgactcggtcagtgggttgtgggttgaagtgtcgtgtatttttggatgctatgtgtgtatagcttggattttaacctccttgttctattattattattatatgatgattagattcacttaattgcccccggaa

SEQ ID NO: 540 - DNA, 1300 bp, Oryza sativa
gaccaaagtgcaaaaccccacctcgaattcgatttctttctcccctttttccacgcccaccttcgctcgctcaccatcctcatccccttttcccttctcctccaccccccccccccaaccacctcaccgccgacgacctcatcctcgtcggcgccgtcggattcaccagcgagggaggttgcggcggcggcggagagcgcgagggaggaaagcgggggaggtgaccgccagcgatggggcagcagtcgctgatctacgcgttcgtggcgaggggcacggtggtgctcgccgagtacacggagttcaccggcaacttcaccaccatcgcggcgcagtgcctccagaagctccccgcgagcaacaacaagttcacctacaactgcgacggccacaccttcaactacctcgtcgaggacggattcacatactgtgtagttgctgttgaatcagttgggcgacaaatccccattgctttccttgacagagtcaaggaagatttcaccaaaagatatggtggtgggaaagcagctactgctgcagcaaacagcctcaaccgagaattcggatcaaaacttaaggagcacatgcagtattgtgtggaccaccctgaggaaatcagcaagcttgcaaaggtcaaagcacaagtctcagaggtcaaaggagttatgatggaaaacattgagaaggttcttgaccgtggtgagaagattgaactgcttgtcgacaagactgaaaacctgagatctcaggcacaagatttcagacagcagggtacaaaggtgcggcgaaagatgtggttacaaaacatgaagatcaagctgatcgtcctgggcatcatcatcgcgctcatcctcatcatcatcctgtccgtgtgccatggcttcaagtgcaagtgagggtgttggcttcccagtcctccacattcaccttgccccccataataccgcctattcctggcgaaaaaaaagaccatatgtttttttttgttctgttagtcatgagtcctgccccgattcttgggtgttcgagtgtccctgatgtcgcgcttgattggtgtcggatagtgactgggtttatgggtcggagtcccgtgtatttttggacgctattcatgtatagcctgtatgctaccctcttttcgctctgctatatgagtagtaggtgttactacgtttgttcccccactttatatcttctcttactccacagctaaatcttagtaagaaggaacaacttgcattttcaaacctgtgatcttcataaataattttgattttggagagattattactcgatgacc

SEQ ID NO: 541 - DNA, 859 bp, Carthamus tinctorius
ggcggggattcccttcactttctctctctagaaactcctctctttctctctctcacacacacacacacacacaaacacgcacatcgttcttcggagagagagagatggggcaacagtcgctgatctacagcttcgtcgccagaggaacggtgattctgtcggaatacacggagttcaccggaaacttcaccagcatcgctgcgcagtgcctccagaagcttccggctaccaacaacaagttcacctacaactgcgatggccacaccttcaactatcttgttgaggatggattcacatactgtgttgtcgcggttgaatctgttggtagacaggtcccaatagcttttcttgagcgagttaaagaggacttcactaagaaatatggaggggggaaagctgcaacagctgttgccaacagtctgagcaaagagtttggacccaagctgaaggagcagatgcagtactgtgtggatcatccagaagagatcagcaagcttgcaaaggtgaaagcccaagtctcagaagtcaagggtgtgatgatggaaaatatcgagaaggttcttgaccgtggagagaagattgagcttctggtggacaaaacagagaaccttcgctctcaggcccaggatttcaggactcaaggcacccaaatcaggaggaagatgtggttgcagaatatgaaggtaaaactgatagttctcggtatcatcatcgccttgattctcattatcgttctatccgcttgtggtggcttcaattgtggcaagtaaaaaaaaaaattacatctttgcattcgggggggattttaggacggaaaaatctcawttcatggtaaaaaaaaatattcagggcttagttg

SEQ ID NO: 542 - DNA, 1112 bp, Carthamus tinctorius
gcagcagcaaggtgtttttcgttaaataaatttctaaaaagcggattttaaacctctttttcattcctttgtatctacgaaacccacaaatctcaccttctttttcctctcctccttcaaaatcaaatcaaatcaaatctcagatcagaattcctccatcttcacgtttccttccttccttcaatactctctctctctctctctctattatccatttatttctcattcttttcttaagcaagcactgctaggtttttatttactagggttttatatcaaaatcataatcataatcataatggggcagcagtctctgatctatagttttgtgtctagaggagccgtgatcctctccgagtacaccgagttcaccggaaatttcacttctatcgcatctcagtgcctccagaagcttcctgcaactaacaataagttcacctacaactgcgatggccacaccttcaattaccttgttgaagatggttttacatattgtgttgttgctgccgaatctgctggcagacaggtcccaatggcttttctcgaacgaattaaggaagactttaccaagaaatatgctgcagggaaagctgctaccgctgttgcaaatagcctgaacaaagaatttgggcctaagctgaaggagcagatgcagtattgtgtcgatcatcctgaagaaatcagcaagctttcgaaggtgaaggcccaggttacagaagtcaaaggtgtgatgatggaaaacattgagaaggttctagaccgtggagagaagatcgagcttctagtggataaaacagagaacctccgatctcaggcacaagattttaggacacaaggtacccaaatgaggaggaaaatgtggttgcaaaacatgaagataaagctgatcgttcttggtatcattatcgccttgattctcattatagttctatcggtttgtggtggtttcaactgtggcaagtgaagcatatgggttttcgttgttatcattttgttggtgtttcatttgccatttttggatgagagatacttgcattatgcagaattacaagagcctatgttttgggttcctagtgtatatttgtaccctttgagatatctatgatgtatac

SEQ ID NO: 543 - DNA, 916 bp, Carthamus tinctorius
tctctytctctaaatcaatccatttcttcttcttcttcttcttcttcttcttcttctggtggttgtggtggtggtggtcgccggcgacggagaagacaagttgtgtgtgactctgtgttatatatcatggggcaacagtcgttgatctacagttttgttgccagagggacggtgatcctggccgaattcacggaattcaccggaaatttcactaatatcgctgctcagtgtctccagaagcttcctgctactaataacaagttcacctactcttgcgatggccacacgtttaactatctcgttgaagatggattcacatactgtgtggttgctgtcgaagccgttggtcggcagattccgattgcttgcctcgagagaatcaaggatgaatttaccaagaaatatggtggagggaaagctgcaaccgctgttgccaatggtctgaataaggaatttggttccaagctgaaggagcagatgcaatattgtgtggatcatccagaagagatcagcaagctttcaaaggtgaaggcccaagtttcagaagtcaaaggtgttatgatggaaaacattgagaaggttcttgaccgtggagagaagatcgagcttttggttgataaatcggagaaccttcactctcaggcacaaggttttcggacagcaggaacgcagttgagaaggaagatgtggtttcagaatatgaaggttaaactgatagttttaggaatcttgattgcactcatcctcatcatagttctatctgcttgtcatggctttaaatgtggcaagtgaagtctatcctttgtttttctttttgcttttttcttcaccataaaaactgcttatattcagcttgtgcctttaaagtatttttgatacatacatatattaggaaacaatttgattgtttgaaaca

SEQ ID NO: 544 - DNA, 844 bp, Carthamus tinctorius
ttttcaaacccaaatctcttttcccccaaaatcagatcctccaagccctagggttaggttttctacttctcaattttgtagttcgaatcatcatgggccaacagtccctgatctacagttttgtgtctagaggcaccgtgattcttgccgagtacacagagttcaccggaaatttcacctctattgcttcccaatgcctacagaagcttcccgcaactaacaacaagttcacttacaattgcgatggacataccttcaattaccttgttgaagatggcttcacatactgtgttgttgctgctgaatctgctggccgacaagttccaatggcttttcttgagcgaaccaaggatgactttaccaagaaatatggtggtgggaaagcagctacagctactgccaatagtctgaacaaggaatttgggcccaagttgaaggagcagatgcagtattgtgtggatcatcctgaagaaatcagcaagctttcgaaggtaaaggcacaggtttcggaagtcaaaggtgtgatgatggagaacattgaaaaggttttggatcgtggtgagaagatagagctccttgtggataaaacagagaatcttcgctctcaggctcaagattttaggacacaaggtacacaaatgaggaggaggatgtggctgcagaatatgaagataaagctcatagttcttggaatcatcattgccttgattctcattatagttctctccgtttgtggtggcttcaattgcggcaagtgaagtacgtatatatattcatggtaaaacatctctggtttatttgtgttttcccgtgtttttattcgtacccttttgttgttaaagcc

SEQ ID NO: 545 - DNA, 666 bp, Senecio madagascariensis
  misc_feature (60)..(60): n is a, c, g, or t
ttgatctacagtttcgtagctacttgaacggtgattctatcggaatatacggaattcacncggtaatttcactagtatcgcagctcaatgtctccagaagcttcctgctaccaataataagtttacgtataattgcgatggtcatacgtttaattaccttgttgaagaaggattcacatactgtgttgtcgcggttgaagccattggcaggcaggttccaatcgcgtttcttgagcgcatcaaggacgactttactaagaaatatggtggtggaaaagctgcaacagctactgccaacagtctgagcaaagaatttggctccaagcttaaggaacagatgcaatattgtgtggaccatccagaagagatcagtaagctttcaaaggtcaaggctcaggtgtcagaagtcaaaggggtgatgatggaaaatatcgagaaggtccttgaccgtggagagaaaattgaggttttggttgataaaacagagaaccttcgctctcaggcccaagatttcaggacgcaggggactcaaatcagaaggaaaatgtggttgcagaatatgaagataaagctgatcgttcttggaatcattatcgctttaattcttattatagttctatccatatgcgggcggcttcaactgtggcaagtgaagcacatttatga

SEQ ID NO: 546 - DNA, 1214 bp, Sorghum bicolor
aaatttgatttcctttccatttccaccccaactatttcccctccttcaaccccacggagaagcgaaactgacctttccccctccctgcatcccacctcgcggagatctagtcctagggtttcgccagcggcgaggcctaagtcatcggcggcgagccaaactccacgagcggggaaagagggggaagcagagacgaaggtagacatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgatggccacaccttcaattacctcgtggaagacggattcacatactgtgttgttgctgttgaatcagtggggcaacaaattcccattgctttcatggatagggttaaggaggatttcacaaaaaggtatggtggtgggaaagctgctactgctgcagctaacagcctcaaccgagagttcggatcaaaacttaaagagcacatgcagtattgtgtggatcaccctgaagaggttagcaagctggccaaagtgaaggcacaggtttcagaagtcaagggtgttatgatggagaacattgaaaaggttctagatcgtggagagaagattgagctgcttgttgacaagaccgagaatttgcgctcacaggcacaagatttcaggcagcaaggaacaaatgtgaggagaaagatgtggttacagaacatgaaaatcaagcttatcgtcctgggaataataattgcacttattctgatcattatcctctctgtctgtcacggtttcaagtgccattaagcgcagaccagaatactgatacattcaactgcacctattatactgctgcttggagcaagaaaaagtatgatcttttgttctttcgctagtgtgctctggcccggtcattgtgcacaggtgttctacattgtctttgataaatgttggatggtgactgggttagctgtgtcaactgtcaaaactgtcgtgtatttttggacgctatgtatgtatagcctggatatgagtagacttactaaacttctccagttgtgactcaggagtctgctcctctggacaataatgtgcatcttgcattgacctcgtttagtgcaaaactgcaatttggaaaatatgggcacgtaatc

SEQ ID NO: 547 - DNA, 1263 bp, Sorghum bicolor
ctcccacggcaccttcattcccagacccctttcccctccccctcctccgccctcctcccccttctcgactcctccgacgcgcccagcgccatccggcgagctccaccgcaccaccggcggcagcgaaagtgcgggggctgagtctgtaggaggcggcggcggcggaggaggaggtgagccgagcagagtcgaggcgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaagacggattcacgtattgtgtagttgctgtcgaatcagttgggcgacaaatccccattgctttcctggacagagttaaggaagacttcaccaaaaaatatggaggtgggaaagcagctactgccgcagcaaacagcttgaatagggagtttggatcaaagcttaaagagcacatgcagtactgtgtggaccaccctgaggaggtcagcaagcttgccaaggtgaaggcccaagtctcagaagtcaaaggagttatgatggaaaacattgagaaggttcttgaccgtggtgagaagattgagctgcttgttgacaaaactgaaaatctgcgttctcaggcacaagatttcagacagcagggcaccaaggtgcggcgaaagatgtggctgcaaaacatgaaaatcaagcttatcgtcctgggcatcatcatcgcgctcatcctcatcatcatcctgtcggtgtgccacggcttcaagtgcggcagcaagtgaggagtggggtggtgggacttacagatgggcccgtgcctgcaccggcgagagaagaccatgtggagttttgttttgctcttttagtcgtcgtgtcgagtcctgcgctgattattcttggtggtcatcaaagggagttgttcctgatgtcggtgttgattgctgttggattggtcgggaagtgactgggtgaaccgggtgaaacgggggtgttgtgtcgtgtaattttggatgctactatttgtgcatgtatagcttgtgtgctactaccctggtccatgctgctgctactcctatatcagtagatgttacgtactacgtttgctccctggattgcaggcaatgcactgttcggctatgcccattttccacctgtggtgtgtggagatgaactga

SEQ ID NO: 548 - DNA, 1263 bp, Glycine max
aattctctctcttttaaaccctgctctccattttgtctcttcctttctctctctacaaagagtgcgtgtgagagtgagagagagagagagagggatttggaactttggatatctatagcgaaagcgtgacaccaccaaaaaccgaactgttcccagatctctctctcactcttccaacaatcgaaatccaaaaccctaccgacaccacactcaatcgaaattcttcattctcttctcatcgatggggcagaagtctctgatctacgcgttcgtgtcgcggggaacagtgattctcgcggagtacaccgaattcagcggaaacttcaactccatcgccttccagtgccttcagaagctccctgccaccaacaacaagttcacctacaattgcgacgcacacaccttcaattacctcgtcgacaatggctacacatattgtgttgttgcagatgaatcaattggaagacagttacccatggcttttctagagcgtgtcaaagatgaatttgtgtcaaaatatggtggtggaaaggctgccacagctcctgcaaacagccttaacaaggaatttgggccaaagttgagggaacatatgcagtactgtgttgatcatcctgaagagataagcaaacttgcaaaggtgaaagctcaggtttctgaagttaagggtgtcatgatggagaatattgaaaaggttctggacaggggtgacaagatagaacttctggtggacaagactgagaaccttcataaccaggcacaagatttcaggacttctggaaccagaatccgtcgaaaaatgtggctgcaaaacatgaagataaagctgattgtattgggaatattgatagcacttatcctgataatagtcctatctgtgtgtcgtgggttcaactgtggaaaatagcaccattctccgaggccttttatcatgttatttcaaccttgagattatcggagaaaagatactaatgaatggcatgagtttgtatgtaatatagatatagatatagtaaaggtcgtatgttggtcactttgatctacttataaatgcttttgaaaatataatttgggttgtcaaattgaaatttgatttccattttattcatattcatgaatcatgtaaatgtgtttcttgatcatattctttaatgattccagttacagcattttggcattgtcgacctttattagatttattgaacttgtggcctttcattcctgattccatcctacataaggagtggagaggttatttctttc

SEQ ID NO: 549 - DNA, 1126 bp, Glycine max
ctcactcatcgttctctctgttctttctctctcaaaggaaagaaaaggaaagaaaagaaaagaaaaagaagagagtgtaggtaaacagaagcacacactacacagttaccaaaatcaggttcaaacgcacagatctgggagaagagaagaagaagaagaagaagatgggacaggatcagaaccagagatcgctgatctacgcgttcgtgtctcgcggcacggtgattctcgccgagtacactgaattcagtggcaacttcaacacaatcgcgttccagtgcctccagaagctccctgcctccaacaacaagttcacctacaactgtgacggccacaccttcaactacctcgtcgacaacggattcacttattgtgttgttgcggatgaatcgattgggagacaggtgcctgtggcttttctggagcgtgtgaaggatgactttgtggccaaatacggcggcggaaaggcagcaaccgtggctgcgaacagcctgaacaaggaattcgggtctaagttgaaggagcacatgcagtactgtgttgagcatcctgaagagataagcaagcttgctaaggtgaaagctcaggtttctgaagttaaagatgtcatgatggagaacattgaaaaggttctggaccggggggaaaagatagagcttctggttgacaaaactgaaaatcttcatcaccaggcacaagacttcaggaattctgggaccaaaattcgtagaaaaatgtggctgcaaaacatgaagataaagctgattgtgttggcgattttgatagccctgatcctcataatagtcctttctgtctgccgtgggttcaattgtggaaaataaggcatcgttttccgacgaggagtcattttaccttgtgattattatatgaggaaaagatatcgaatgaatgcatgattttgtatgtagtaaaagtatcagatcgcttatactgttcattttaaaggtttcacagtatgatataagaatgcttttggaagtattttttttgtttgtctattgtagttcgattttcgttcattcatcttatcatcattctctcgcaattacgttctgtagcatttcagtgcaaagctcgactatttttcaaccagatttcgtatttc

SEQ ID NO: 550 - DNA, 1200 bp, Glycine max
ctttttgttccatcttccatgcttcaatttgaaagttttcccatttcaattctctctcacaccgctttagaaactttcctaaaccctgctctccattttcccttgtctcttcctttctctctctacaaagagtgtgtgtgagagagagaaggatttggaattttggataactagagcgaaagcgtgacaccaccaaaaaccgaactgttcccagatctctctctctctctctctcttccaacaatccaaatccaaatccaaaaccctaccaacaccacactcaatcgatcgatggggcagaagtctctgatctacgcgttcgtgtcgcggggaactgtgattctcgcggagtacacggaattcagcggaaacttcaactccatcgccttccagtgccttcagaagctccctgccaccaacaacaagttcacctacaactgcgacgcacacaccttcaattacctcgtcgacaatggctacacatattgtgttgttgcagatgaatcaattggaagacagttacccatggcttttctagagcgtgtcaaagatgaatttgtggcaaaatatggtggtggaaaggctgccactgctcctgtgaacagccttaacaaggaatttgggccaaagttgagggaacatatgcagtactgtgttgatcatcctgaagagataagcaagcttgcaaaggtgaaagctcaagtttctgaagttaagggtgtcatgatggagaatattgaaaaggttctagacaggggtgacaagatagagcttctggtggacaagactgagaaccttcataaccaggcacaagatttcagaacttctggaaccagaatccgtcgaaaaatgtggctgcaaaacatgaagattaagctgattgtattgggaatattgatagcacttatcctgataatagtcctatctgtatgtcgtgggttcaactgtggaaaataagccattcaccggggccttttataatgttatttcagccttttatcggaggaaagatactaatctatggcatgagtttgtatgtaatatagatatagatatagtaaaggtcgtatgttggtcactttgttctacttataaatgcttttgaaaatataatttgggttctcaatttgaagttcaaattccagtttatttataggcaagaatcatgtaaatgtgtttcttgatgttattcaatttttg

SEQ ID NO: 551 - DNA, 1009 bp, Glycine max
actcatcgtttctgttttctcttcttcctacattctctctagaaaagaaaagaaaggaaaagaaaagaaaagaaaaagaagggagtgcaggtaaagagaagcacacacttcacacacaaaccaaaaatcaggttcaaacacagatctgggagaagaagaagaagatggggcacgaccagaaccagagatcgctgatctatgcgttcgtgtctcgcggcacagtgattctcgccgagtacaccgaattcagcggcaactttaacacaatcgcgttccagtgcctccagaagctccctgcctccaacaacaagttcacctacaactgcgacggccacaccttcaactacctcgtcgacaacgaattcacttattgtgttgttgcggatgaatcgattgggagacaggtgcctgtggcttttctggagcgtgcgaaggatgattttgtggcgaaatacggtggcgggaaggccacgactgcggccgcgaacagcctgaacaaagaatttgggtccaagttgaaggaacatatgcagtactgtgttgagcaccctgaagagataagcaagcttgctaaggtgaaagctcaggtttctgaagttaaagatgtcatgatggagaatattgaaaaggttctggacaggggggaaaagatagagcttctggttgacaagactgaaaatcttcatcaccaggcacaagacttcaggaattctgggaccaaaatccgtagaaaaatgtggctgcaaaacatgaagataaagctgattgtgttggcaattttgatagccctgatcctcataatagtgctctctgtttgccgtgggttcaattgtggaaaataagcatcattttccgaggagtcattttaccttgttattttgaccttgtgattattttatgaggaaaagatatggaatgaatgcatgattttgtatgtagtaaagatatcagatcgtatactgttcattttaaaggtttcacagtatcatataagaatgctttggaaata

SEQ ID NO: 552 - DNA, 1362 bp, Glycine max
ttctacttcttcttcaacgctctttagtacagcggaagaacgaagcctcctcgttcttcttcttctgcgctttctctctccctctctagaaccgtaaccgtcgtttctttctttctctctcctcaaccagagataaagagtcaccttcttatttttctgaatctcgcggcgttgttctttctgctgctgcggctgtggttccggcggcgatgggacagcaatcgttgatctacagcttcgtcgctcgaggcaccgttatcctcgcggagtacaccgagttcaccggaaacttcaccggcgtggcggcgcagtgcctccagaaactcccttcctccaacaacaagttcacctacaactgcgatggccacaccttcaactacctcgtcgataacggattcacttactgtgtggttgccgttgagtctgctggacggcagattccaattgctttccttgaacgaatcaaggaggattttaccaagaaatatgctggaggaaaagcagcaacagcggctgctcagagcctcaacagagagtttggacctaagttgaaggagcagatgcagtactgtgttgatcacccagaggaaattagcaagcttgcaaaagtgaaggctcaggtttcagaagtcaaaggagttatgatggaaaatattgagaaggttcttgaccgtggggagaaaattgagcttttggtggataaaacagagaaccttcgctctcaggctcaagatttcaggcagcagggaaccaagattaggagaaagatgtggttccaaaacatgaagataaagctaatcgttctgggtatcataattgccttgattcttattattgttctttccgtttgtggtggcttcaactgtggtaaatgatgagtctttcccacgtcctggcttcaactgtggtatttgtctcctcacttgataagattgttgctagcagattgccattgcctcaactgtcgacgtagtgcttttgacttactttttgggatttacattcttccgtcttctccgatgatagatgttatatggcattgcttgtatagtgtgaattgtttagtctatcatcttgtctcccatagcgtaatgctaatctgtcattctctatagtttaggtgggagtttcagcatatggtttgaggattatgttttttaagtatgcttacatattaagaaaccaaccattacgtagttgagcttttttattaccaacttaccatattttttgttggacttgtgataatccgtgcgtttgtgtgtgaacgttttatccatcttcgaggccttgcttatgttctaattctaaacgctagtggtttttgttttaacttgttaattattaattcattcatttggt

SEQ ID NO: 553 - DNA, 1330 bp, Glycine max
cggcacggcgtggcatttatgtaattaaaaataaacccgagggcagttcaacaaactacaccctctttacttccatttcacgctttcttcaagacaacaaaataaaatacccttttttcttcttcttctctctcttcaacgctcgcttagtacagcggaataacgaagcctcctcgttcttcttcttccgccctttctctctctagaaccgtacggtcgtttctttctctctcctcaaccggagacagcgtcgccttcttttctgaatctcgcggtgttgttagttctgcggcggttgtagttccggcggcgatgggacagcaatcgttgatctacagcttcgtcgctcgcggcaccgtgatcctagcggagtacaccgagttcaccggaaacttcaccagcgtggcggcgcagtgcctccagaaactcccttcctccaacaacaagttcacttacaactgcgatggccacaccttcaactacctcgttgataacggattcacttactgtgtggttgctgttgagtctgctggacggcagattccaattgctttcctcgaacgaatcaaggaggattttaccaagaagtatgctggaggaaaagctgcaacagcggctgctcatagcctcaacagagagtttggacctaagttgaaggaggagatgcagtactgtgttgatcacccagaggaaattagcaagcttgctaaagtgaaagctcaggtttcagaagtcaaaggagttatgatggaaaatattgagaaggttcttgaccgtggggagaaaattgagcttttggtggataaaacagagaaccttcgctctcaggctcaagatttcaggcagcagggaaccaagattaggagaaagatgtggttccaaaacatgaagataaagctaattgttctgggtatcataattgccttgattctcattattgttctttccgtttgtggtggcttcaactgtggtaaatgagtcttcccacatcctggcttcaactgtggtatttgtctcctcacttgataagattgttgctagcagattgccattgcctctactgtcaacatagtgcttttgactttttgggatttacattcttccgacttctccgatgatgaatattatatggcattgcttgtatagtgtgaattatttagcctttatcatcttgtctccatagcataatgctaatctgtcattctctatagtttaggtgggagtttcagcatttggtgtgaggattatgttttttaattatgcttacatattaagaaatcaaccattacgtagttgagctttttattaccatatttttttatatgacttg

SEQ ID NO: 554 - DNA, 988 bp, Euphorbia esula
  misc_feature (7)..(10): n is a, c, g, or t
atctccnnnnaaaatctctccttccttcaaatcgatttccgctctgcaacaacaacaaatcctcctaacttccttctcttctctcactttcttcctctagggttagggttttgcttttgtttgttgttgtagcagagagactagatgggccagcaatcgttgatctacagcttcgtcgccagtggcaccgtgattttggctgattacacggagttcaccggtaacttcaccagcatagctgctcagtgtcttcagaaacttccggcgaccaacaataagttcacttataactgcgatggtcacactttcaactacctcgttgacaacggcttcacttattgtgtagtggcagttgagtctgttggtagacaagttccaattgccttccttgagagaatcaaggaggaattctccaagaaatatggtggagggaaagctgcaacagctgttgctaatagcctgagcaaagaattcgggtcaaagttgaaagagcagatgcaatactgtgttgaccaccctgaggaggtcagcaagcttgccaaagttaaagctcaagtttcagaagtcaaaggagtgatgatggagaacatagagaaggttcttgaccgtggagagaaaattgagcttctagttgacaaaactgaaaaccttcgctctcaggcccaagatttcagacagcaaggaaccaagatgaggaggaagatgtggctagcaaacatgaaaatcaagctgatagtgctgggtattttgattgctttgattctgataatagtattgtctgtttgtcatggcttcaactgtaacaagtagagattcacggaggatgaattttcatgtacctttttttgaggttattatattctgctatagtctaaatcatgagacatcttgtatagttttttaagtttttgaattctttgtactattgagtttcttttgtgatgtggaagtttgtcatttcagtgttattgatttattgcacttgttg

SEQ ID NO: 555 - DNA, 970 bp, Euphorbia esula
ccactttctctctctagaaaaagcaaaattcgaagaggaaaagacacgctctctcttcaaacctcagatctctggctccaattttgtaattgattgcttagaatttcaaaaatgagtcagaaatctttgatctacgctttcgtttctcgaggaactgtgattctcgcggagtataccgaattcagtggtaattttaactcgattgcttttcagtgccttcagaagcttccttctactaataataagttcacttacaactgcgatgctcataccttcaattatctcgtcgataatggcttcacatactgtgtagttgctgatgaatcagcaggaagacaaatacctatggcttttttggaacgtgtcaagcaagattttgtgacaaaatacggaagtggtaaagctgctactgctccagctaacagccttgacaaagaatttggacccaaactgaaagaacatatgcaatattgtgttgatcatcctgaagaggtgagcaagcttgcaaaggtgaaagctcaggtgtcagaagttaaaggagtcatgatggaaaacattgaaaaggtcttagatagaggggaaaaaattgaacttcttgtcgataagtcggagaccctgcataaccaggctcaagatttccgaagctcggggacgaagatccggaggaaaatgtggctacagaacatgaaaattaagctgattgttttgggaatactgattgctttgatcctgattatagtcctctcagtttgcaaaggtttcaactgtrgcaaatgagtggaatatcccaaggcttttttgtattttcagagctttggtgargttacgatgatgtataatatttgaatatatatatataatgtattwtgttwtaaatgtttgtagcaagaaactgaaatttcttggcatttttttgtagaacaatgagtttgkcmtttggatttgacattattatattattgygatacca

SEQ ID NO: 556 - DNA, 972 bp, Euphorbia esula
  misc_feature (9)..(10): n is a, c, g, or t
aacaacgcnntacacaagaaaataacaagagaaattagcgtacgataatagtaaacaacccaaatccagcaaatttctccattctccgatcttatcgtctttcctaatctcttccttttcgttattcttcttctctcattctctttttctctctgattattgttagggttagggtttttgctggtcgattagaaaaacagagggcacaaaaaraaatggggcaacagtctctgatctattgyttcgtcgctcgaggcaccgtcatccttgctgaatacaccgagttcacaggcaatttcaccagcatcgcttctcaatgccttcagaaattacctgcttctaacaataagtttacctacaattgcgatggtcataccttcaattacctcgttgaaaatggcttcacctactgtgtggttgcagttgaatctgctggtaggcaaattccaattgcatttctagagcgtgttaaggaagacttcaacaagcgatatggtggaggaaaagctgcaactgctcaggccaatggcctgaagagagagtttgggcccaaactgaaggaacatatgcagtattgtctggatcatcctgaagaagtcaacaaacttgcaaaagtgaaggctcaggtttctgaagttaagggtgttatgatggaaaatattgaaaaggttcttgatcgcggtgaaaagattgagttgctggtggataaaactgagaatctccgctcccaggctcaagattttagacaacagggaactaagatgaggaggaagatgtggattcagaatatgaagatgaagttgattgttttgggtattatcattgctttgattcttatcatagtgttatctgtttgtcatggattcaactgttaatctcgatgaattttggaggatgttgttcttgctccaagccgactctgacttgaggctcatcctgctaatttcacctttcttttaacgatccatctca

SEQ ID NO: 557 - DNA, 911 bp, Fragaria vesca
gaagagagagtaragaagaagaagaagaagaagaagatggggcagaagtcgctgatctacgccttcgtggcgcgaggcactgtgattctggccgagtacaccgaattcagcggcaatttcaactccatagccttccagtgcctccagaagcttcccgccaccaacaacaagttcacctacaactgcgacgcccacaccttcaactacctcgtcgacaatggcttcacgtactgtgtggtggccgatgaatcagctggaagacaagtgcctattgcttttctggagcgtgtgaaggatgattttgttgcaaaatatggtggtgggaaggctgctacagctgctgccaacagtcttaacaaggaatttgggtctaaattgaaggaacatatgcaatactgtgttgatcatcctgaggaaataagcaagcttgctaaggttaaggcccaggttacagaagttaaaggtgttatgatggagaacattgaaaaggttttggatagaggggaaaagatagagcttttggttgataagactgagacccttcatcatcaggctcaggacttccggaatgttgggactaaaatgagaaggaagatgtggctgcagaacatgaaggtgaagctgattgtcttgggaatcctgattgcattgatcctcatcataatcctctctgtttgccatggtttcaactgcggaaaatgagtcttcgcctggagtgtctcatcttgtcaatcccaacttctgagattgtgttattataatcggaatatcaaatatctgttgtgactctgtactcggtgatttctagatatatgtgggcagtagaggaagcgtattttttgtgtgaatggaactccctatatatgttactgtgttcttagaatgcataatgaagttgcttattctcatct

SEQ ID NO: 558 - DNA, 842 bp, Fragaria vesca
ttctctcccaaatccaccaaaccctttcttcctctgaaaatctcaaagctccatcaccacctagggttagggtttcgaatcgaatccgatggggcagcaatcgttgatctacagcttcgtggcgcgcgggaccgtgatcctcgccgagttcacggaattcaccggcaacttcaccggcatagctgctcagtgcctccagaagcttcccgccactaacaacaagttcacctacaactgcgacggccacaccttcaactacctcgtcgataatggcttcacatactgtgtagttgcagttgaggctcttggtcgacaagttcctattgccttcctcgagcgaatcaaggaagattttaccaatagatatggtggaggaaaagctgcgacagcagttgcaaatagtctgaacaaggaatttgggtctaagctgaaggagcatatgcaatattgtgtggatcaccccgaggagatcagcaaacttgctaaagtaaaagctcaggtttcagaagtgaaaggagttatgatggaaaatattgaaaaggttcttgatcgtggggaaaagatagaacttctggtggacaaaactgagaaccttcgctcacaggcacaagatttcaggcagcaaggaacccagatgaggaggaagatgtggtttcagaacatgaagatcaagctgatagttttgggaatcttaatcgccttgattctcatcattgtcctatctgtttgcaatggattcaagtgctgatgaatcctaagacgctttcaaggaatttggtggagtttctactgctgttatctacagtgctggtctacgtattattatttttggttacatacac

SEQ ID NO: 559 - DNA, 1188 bp, Saccharum officinarum
cgatttcttcctgcccttttcctttccacacgccctcccacggcacccctttcccctcctccctcctcccccttctcgaccgctccgacgcccccatcgctcccggcgagctccaccgcacaacttgcggcggcgaagagcggtggccgagtctgtaggaggcggagaaggaggaggaggtgagccggagccggagtagagccgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaggacggattcacgtattgtgtagttgctgttgaatcagtcgggcgacagatccccatagctttcctggacagagttaaggaagactttaccaaaaaatatggaggcgggaaagcagctactgccgcagcaaacagcttgaacagggagtttggatcaaagcttaaagagcacatgcagtactgtgtggaccaccctgaggaggtcagcaagcttgccaaggtgaaggcccaagtctcagaagtcaaaggagttatgatgggaaacattgagaaggttcttgaccgtggtgagaagattgagctgcttgttgacaaaactgaaaattgcgttytcaggcacagattttagacagcagggcaccaaggtcggccgaaagatgtggctccaaaacatgaagattaagctgattgtcctgggcatcatcatcgcgctcatcctcatcatcatcctgtcggtgtgccacggcttcaaatgcggcagcaagtgaggagtgggggtgggacttacagatgggccgtggctggcaccggtgagaagaagaccatgtggagttttgatcttttagtcgtcgtgttgagtcctgcgctgattattcatgatgagatcatcagagagttattattcctgatgtcggtgttgattgctgttggttggttgggaagtgactgggtgaaccgggtgaaagggggttgtgtcgtgtaattttggatgctactatgtgcatgtatagcttgtgtgctaccctggtccatgctgctactactcctatatcagtagatgttactacgtttgctcccca

SEQ ID NO: 560 - DNA, 1157 bp, Saccharum officinarum
cggacgcgtgggctttcccctcctccctcctccctcctcccccttctcgaccgctccgacgcccccatcgctcccggcgagctccaccgcaccagcggcggcggcgaagagcggtggccgagtctgtaggcggcggagaaggaggaggaggtgagccggagccggagtcgagccgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaggacggattcacgtattgtgtagttgctgttgaatcagtcgggcgacagatccccatagctttcctggacagagttaaggaagacttcaccaaaaaatatggaggcgggaaagcagctactgccgcagcaaacagcttgaacagggagtttggatcaaagcttaaagagcacatgcagtactgtgtggaccaccctgaggaggtcagcaagcttgccaaggtgaaggcccaagtctcagaagtcaaaggagttatgatggaaaacattgagaaggttcttgaccgtggtgagaagattgagctgcttgttgacaaaactgaaaatctgcgttctcaggcacaagattttagacagcagggcaccaaggtgcggcgaaagatgtggctccaaaacatgaagattaagctgattgtcctgggcatcatcatcgcgctcatcctcatcatcatcctgtcggtgtgccacggcttcaaatgcggcagcaagtgaggagtgggggtgggacttacagatgggccgtggctggcaccggtgagaagaagaccatgtggagttttgatcttttagtcgtcgtgttgagtcctgcgctgattattcatgatgagatcatcagagagttattattcctgatgtcggtgttgattgctgttggttggttgggaagtgactgggtgaaccgggtgaaagggggttgtgtcgtgtaattttggatgctactatgtgcatgtatagcttgtgtgctaccctggtccatgctgctactactcctatatcagtagatgttactacgtttgctc

SEQ ID NO: 561 - DNA, 1049 bp, Saccharum officinarum
ctctctcctccctcctcccccttctcgaccgctccgacgcccccatcgctcccggcgagctccaccgcacaacttgcggcggcgaagagcggtggccgagtctgtaggaggcggagaaggaggaggaggtgagccggagccggagtagagccgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaggacggattcacgtattgtgtagttgctgttgaatcagtcgggcgacagatccccatagctttcctggacagagttaaggaagacttcaccaaaaaatatggaggcgggaaagcagctactgccgcagcaaacagcttgaacagggagtttggatcaaagcttaaagagcacatgcagtactgtgtggaccaccctgaggaggtcagcaagcttgccaaggtgaaggcccaagtctcagaagtcaaaggagttatgatggaaaacattgagaaggttcttgaccgtggtgagaagattgagctgcttgttgacaaaactgaaaatctgcgttctcaggcacaagatttcagacagcagggcaccaaggtgcggcgaaagatgtggctccaaaacatgaagatcaagctgattgtcctgggcatcatcgtcgcgctcatcctcatcattatcctgtcggtgtgccacggcttcaagtgcggcagcaagtgaggagtgggggtgggacttacagatgggccgtgcctggcaccggtgagaagaagaccatgtggagttttgctcttttagtcgtcatgttgagtcctgcgctgattattcttgatgagatcatcagagagagttattattcctgatgtcggtgtttgattgctgttggttggttggaaagtgactgggtgaaccgggtgaaagggggttgtgtcgtgttaattt

SEQ ID NO: 562 - DNA, 1219 bp, Saccharum officinarum
ccctccttcgaccccacggagaagcgaaaccgacctttccccctcccccgcagcccacctcgccgagatctagcctagccctagggtttcgccagcagcgaggcctaagtcatcggcggcgagccaaactccgcgagcgggggaagagggggaagcagagacgaagaggcagccatggggcagcagtcgctgatctacgcgttcgtggcccgtggcacggtcgtactggccgagtacacggagttcaccggcaacttcaccaccatcgcctcccagtgcctcatgaagctccccgcaagcaacaacaagttcacctacaactgcgacggccacaccttcaattacctcgtggaagacggattcacatactgtgttgttgctgttgaatcggtgggacaacaaattcccattgctttcatggatagggttaaggaggatttcacaaaaaggtatggtggtgggaaagctgctactgccgcagctaacagcctcaaccgagagttcggatcaaaacttaaagagcacatgcagtattgtgtggatcaccctgaagaggttagcaagctggccaaagtgaaggcgcaggtttcagaagtcaagggtgttatgatggaaaacattgaaaaggttctagatcgtggagagaagattgagctgcttgtcgacaagactgagaatctgcgctcacaggcacaagatttcagacagcaaggaacaaatgtgaggagaaagatgtggttacagaacatgaaaatcaagctcatcgtcctgggaataatcattgcacttattctgatcattatcctctctgtctgtcatggtttcaaatgccattaagcacagaccagaatactgatacattcaactgcacctattataccgctgcttggagcaagaaaaaagtatgatcttttcttctttcgctagtgtgctctggcccggtcattgtgcacatgtgttctgcattgccttagtatttgataaatgttggatggtgactgggttagttgtgtcaactgtcaaaactgtcgtgtatttttggacgctatatatgtatagcctggatatgagtagatttactgaacttctccggaatgttgtgactcagtctcttgctcctcttcttctggacaattatgtgcgcatttggggcattttgcattgacctcgtttagtgcaaaagtgcagcttggaaaatatgagcacggaatcgatttcc

SEQ ID NO: 563 - DNA, 1137 bp, Saccharum officinarum
tttcccctcctccctcctccctcctcccccttctcgaccactcagacgcccccagcgcctccggcgagctccaccgcacaacttgcggcggcgaagagcggtggccgagtctgtaggaggcggagaaggaggaggaggtgagccggagccggagtagagccgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaggacggattcacgtattgtgtagttgctgttgaatcagtcgggcgacagatccccatagctttcctggacagagttaaggaagacttcaccaaaaaatatggaggcgggaaagcagctactgccgcagcaaacagcttgaacagggagtttggatcaaagcttaaagagcacatgcagtactgtgtggaccaccctgaggaggtcagcaagcttgccaaggtgaaggcccaagtctcagaagtcaaaggagttatgatggaaaacattgagaaggttcttgaccgtggtgagaagattgagctgcttgttgacaaaactgaaaatctgcgttctcaggcacaagatttcagacagcagggcaccaaggtgcggcgaaagatgtggctccaaaacatgaagatcaagctgattgtcctgggcatcatcatcgcgctcatcctcatcatcatcctgtcggtgtgccacggcttcaagtgcggcagcaagtgaggagtgggggtgggacttacagatgggccgtgcctggcactggtgagaagaagaccatgtggagttttgctcttttagtcgtcgtgttgagtcctgcgctgattattcttgatgagatcgtcagagttattcctgatgtcggtgttgattgctgttggttggttgggaagtgactgggtgaaccgggtgaaagggggttgtgtcgtgtaattttggatgctactattgtgcatgtatagcttgtgtgctaccctggtccatgctgctactactatatcagtagatgttactacgtttgctc

SEQ ID NO: 564 - DNA, 1123 bp, Saccharum officinarum
tcccccttctcgaccactcagacgcccccagcgcctccggcgagctccaccgcacaacttgcggcggcgaagagcggtggccgagtctgtaggaggcggagaaggaggaggaggtgagccggagccggagtagagccgaggcgatggggcagcagtcgctgatctacgcgttcgtggcgcggggcaccgtggtgctggccgagtacaccgagttcaccggcaacttcaccaccatcgccgcgcagtgcctgcagaagctccccgccagcaacaacaagttcacctacaactgcgacggccacaccttcaactacctcgtcgaggacggattcacgtattgtgtagttgctgttgaatcagtcgggcgacagatccccatagctttcctggacagagttaaggaagacttcaccaaaaaatatggaggcgggaaagcagctactgccgcagcaaacagcttgaacagggagtttggatcaaagcttaaagagcacatgcagtactgtgtggaccaccctgaggaggtcagcaagcttgccaaggtgaaggctcaagtctcagaagtcaaaggagttatgatggaaaacattgagaaggttcttgaccgtggtgagaagattgagctgcttgttgacaaaactgaaaatctgcgttctcaggcacaagattttagacagcagggcaccaaggtgcggcgaaagatgtggctccaaaacatgaagattaagctgattgtcctgggcatcatcatcgcgctcatcctcatcatcatcctgtcggtgtgccacggcttcaagtgcggcagcaagtgaggagtgggggtgggacttacagatgggccgtgcctggcaccggtgagaagaagaccatgtggagttttgctcttttagtcgtcgtgttgagtcctgcgctgattattcttgatgagatcatcagagagagttattattcctgatgtcggtgttgattgctgttggttggttgggaagtgactgggtgaaccgggtgaaagggggttgtgtcgtgtaattttggatgctactattgtgcatgtatagcttgtgtgctaccctggtccatgctgctactactcctatatcagtagatgttactacgtttgctc

SEQ ID NO: 565 - DNA, 1150 bp, Helianthus annuus
  misc_feature (128)..(128): n is a, c, g, or t
ttttttggtgcgtatagatctgaaaattcaaatgcgagattttcaacaaaacaaaacaccgcgtggcattaccgttatttccttgtaattacccaggcattttcataaaccacaccgtcaacaacacnagcccctcttttcatataccagacagaaccataatctctcttctcattcatttcaccttccactttctctcaaaacttcatccgattcctccacacgcatcaattgtttccggagacggagagtaggttgttactatgggacaacagtcgttgatctacagttttgtggccagaggaacggttattctgtcggaatacacggaattcactgggaatttcaccactattgctgctcagtgtctccagaagcttcccgcgaccaataataagttcacctacaactgcgacggtcacaccttcaactaccttgttgaagatggattcacatactgtgttgttgcggttgaatccattggcagacaggttccaattgcttgtcttgagcgcatcaaggatgacttcaccaagaaatatggtggcgggaaagctgcaactgctactgccaacagcctgaacaaagaatttggtcccaagctgaaggaacagatgcaatattgtgtggatcatccagaagagatcagtaagctttcgaaggtgaaggctcaggtttcagaagttaaaggggtgatgatggaaaacattgagaaggttcttgaccgtggagaaaagattgaaattctggttgataagacagagaaccttcgctctcaggcacaagatttcaggacacagggtactcagatgagaaggaaaatgtggttgcaaaatatgaagataaagcttatagttcttggcatcattatcgccctgattctcattatcgttctatcagcttgtggcggcttcaactgtggcaagtgaagcacattttattgaattgaaaacaccttgtcctacctatcttcatttgtttcttgttttatataakttttcatatgtaattttttgcctgattgcacttatcttcattctacataaaagattaaaagcttatattgagagacaatgtttgtatagcttgtatgaaactttatataaattatgtatgtcattatatgcaawaaactttcaaacccaaaaaa

SEQ ID NO: 566 - DNA, 969 bp, Helianthus annuus
atggggcaacagtcgttgatctacagtttcgtcgccagaggaaccgtgattctctctgaatacaccgagttcaccggaaacttcaccagcatcgccgctcagtgtctccagaagcttcctgcttccaacaacaagttcacctacaactgcgatggtcacaccttcaactatcttgttgaaggcggtttcacatactgtgttgtggcygtcgaatctgtcggtagacaggttccaatggcttttcttgagcgagtcaaggaggacttcactaagaaatatggcggtgggaaagctgcaacggctgttgccaatagtctgagcaaagaatttggtcccaagctgaaggagcagatgcagtactgtgtggaccatccagaagagatcagcaagcttgcgaaggtcaaagcccaggtttcagaagttaagggtgtgatgatggaaaacattgaaaaggttcttgaccgtggagagaagattgagcttctggtggataaaacagagaatcttcgctctcaggcacaagattttaggacacaaggtacacaaatgaggaggaaaatgtggttgcaaaacatgaagataaaattgatagttctcggaattatcatcgctttgattctcattatcgtcttatcggcttgtggcggctttaattgcggcaagtgaactgcatctttgcttccgggatttaggttcgtaaagttctctcgttcgtgttgtctcgtgtttatttgtttgccaatgatttttcttttgccggattcttttttggggtgacacggggtatctttcgtgacaaaaaaagatttataatgcaatatagtggttgtatagtttgtaccctaagtatgatttgacatcggtatattactaggaaaacaatttgattgcgggtttgtgggttttgttactctcaagactgatgcttgcagtgttctttgatgttatttgattttttgtatgaaaaaa

SEQ ID NO: 567 - DNA, 989 bp, Helianthus annuus
gggcattaatggagcctaaaccccaccatttcgaaaacccaaatcccctttacactttacccttttaacaaccaaatcagatcagattggccgctagggttttgtagatcaatcaacacctttgcaatcataatcatggggcaacagtcgttgatctacagctttgtgtccagaggcaccgtgattcttgctgagtacacagagttcaccggcaatttcacttctattgcttctcagtgtctccagaagcttcctacaacgaacaataagtttacttacaattgcgatggtcacacctttaattatcttgttgaagatggcttcacatactgtgttgtggctgctgaatctgttggcagacaagttccaatggcttttcttgagcgaatcaaggacgactttaacaagaaatacggtggtgggaaagctgctacagctatagccaatagtctgaacaaagaattcgcatctaagctgaaggagcagatgcagtattgtgtggatcatcctgaagaaattagcaagctttcaaaggtcaaggcccaagtttcagaagtcaaaggtgtgatgatggagaacattgaaaaggttctagatcgtggcgagaagatagagcttcttgtggataaaactgaaaatcttcgttctcaggcacaagattttaggacacaaggcacgcaaatgaggagaaaaatgtggctgcagaacatgaagataaaacttatagttcttggaatcatcatcgccttgattctcatcatagttctatcggtctgtggcggcttcaactgtggcaagtgaagtacatacacataatctctcattcttctgctttctagtttattgtttttgttcctattacaatctgatattgaaaagcctatgttgtgagaatgtttgtgtattttgtacctctagaccatggaaccgggctccattgctctttggtccatataactattagtataacttttggttgaatcraaaaa

SEQ ID NO: 568 - DNA, 1009 bp, Helianthus annuus
gacttttccgtattgaaaccataatctctcttttctytatttccggattttcaycactttctctctcttcacctctctctctagaatcactcgtcatccgcaccgtcacgcatcctccatttctctcaggtctcctccacatacggcggtgytcggtgacggtttgctgtttccgacgacggagagtaggttactatgggacaacagtcgttgatctacagttttgtggctcgaggaacggtgattctatcggaatacactgaattcaccggcaatttcactacaatcgctgctcaatgtctccagaagcttcctgctacgaataacaagtttacgtataactgcgacggtcatacgttcaactaccttgtcgaagaaggattcacatactgtgttgttgcggttgaatccattggcagacaggttccaattgcttttcttgagcgcattaaagatgacttcaccaagaaatatggtggtgggaaagctgcaacagctaccgccaacagtctgaacaaagaatttggccccaagctgaaggaacaaatgcagtattgtgtggaccatccagaagaaatcagtaagctttcaaaggtcaaagctcaggtttcagaagtcaaaggggtgatgatggaaaacattgaaaaggttcttgaccgtggagagaagattgaggttctggtagataaaacagagaacttacgctctcaggcacaagatttcaggacgcagggtactcagatgagaaggaagatgtggttgcagaatatgaagataaagctgatagttcttggtatcatactcgcattgattctcattatagttgtatcggcgtgtggcggcttcaactgtggcaagtgaaaccaatccaaaacygtcytttgttccttttttttcatrtatrttcttttaggcyggatgracttgaaaatttatatttggtgtatagcttgtacttgtatgaactttttgatatatrcawartarraaaatcagttttgggacaatc

SEQ ID NO: 569 - DNA, 959 bp, Helianthus annuus
agaaagcgtaagcctacaaatacaatttcaaaaacccaaaatccccctttacactttaccctttcaaaaccagatcaacaagattcacaaattctttcatttctccaacctcttcttccttctagggttttacttttgtagatcaatcaatggggcaacagtctttgatctacagttttgtctccagaggcaccgtcattctcgccgaatacacagacttcaccggcaatttcacctctattgcttctcagtgcctccagaagcttcctgcaaccaacaataagttcacatacaactgtgacggacacacctttaattaccttgttgaagatggcttcacatactgtgttgtggctgctgaatctgctggcagacaagttccaatggcttttcttgagcgaataaaagatgactttaacaaaaaatacagtggcgggaaagctgatacagctgttgccaatagtctgaacaaagaattcggacccaagctgaaggagcagatgcagtattgtgtggaccatcctgaagaaatcagcaagctttcgaaggtcaaggcccaggtttcggaagtcaaaggtgtgatgatggagaacattgaaaaggtcctggatcgtggcgagaaaatagaacttcttgtggataaaaccgagaatcttcgctctcaggcacaagattttaggacacaaggtacacaaatgaggagaaaaatgtggctgcagaatatgaagataaaacttatagttcttggaattattatcgccttgattctcattatagttctctcggtctgtggcggtttcaattgtggcaagtgaagtacattcttcttkkytatttgtttttwcatgttgctammatacattgactgcttgtatctatctaggacatgaaaattgcytcgtyggtcctttatttctagtacaattatattaatcttttctatcacgaaaatgtataaa

SEQ ID NO: 570 - DNA, 755 bp, Panicum virgatum
cacccccaccacctccggcgagctctacaccggcggcagcggaggagcgtgggggctgatcctaggaggcgaaagagcagcggagcggagacgaggcgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtattgtgtagtcgctgttgattcagtcggccggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaagcccaagtctcagaagttaaaggagttatgatggagaatatcgagaaggttctggaccgtggggagaagattgaactgcttgttgacaagactgaaaatctgcgttctcaggcacaagatttcaggcagcagggcaccaaggtgcggcggaagatgtggctgcagaacatgaagatcaagctgatcgttctgggcatcatcatcgcgctcatcctcatcatcatcctgtcggtgtgccacggcttcaagtgc

SEQ ID NO: 571 - DNA, 1009 bp, Panicum virgatum
cctttccacgcgcactacccaagctcctttcccccctcatccacccacttccggcgagctctacaccggcggcagcggaggagcgtgggggctgatcctagggggcgaaggagcagcggagcggagacgaggcgatggggcagcagcagctgatctacgcgttcgtggcgcggggcacggtggtgctggccgagtacaccgagttcaccggcaacttcaccaccatcgccgcccagtgcctgcagaagctccccgccagcaacaacaagttcacatacaactgcgacggccacaccttcaactacctcgtcgaggacggattcacgtactgtgtggttgctgttgagtcagttggccgacaaatccccataggtttcctggacagagttaaggaagatttcacgaaaaaatatggtggtggaaaagcagctactgcagcagcaaacagcttgaacagggagtttggatcaaaacttaaggagcacatgcagtactgtgtggaccacccagaggaggtcagcaagcttgccaaggtgaaagcccaagtctcagaagtcaaaggagttatgatggagaatattgagaaggttctggaccgtggggagaagattgagctgcttgttgacaagactgaaaatctgcgttctcaggcacaagatttcaggcagcagggcacccaggtgcggcgaaagatgtggctgcagaacatgaagatcaagctgatcgtcctgggcatcatcattgcgctcatccttatcatcatcctgtcggtatgccacggcttcaagtgctgattagtgatgatgagatggggagctttgctctgttagtggttgagtcgctgattattcttggtgatcacagagggttcctgatgtttgctctgtttgtgttcatgacggggttgagtgtcgtgtaattttgaatgctactattgtgcatatatagtttgtatgctaccctggcccgttacgctataaaagtaggagttactacgtttgctctcccc

SEQ ID NO: 572 - DNA, 1271 bp, Panicum virgatum
aggcaggcacctcccttccccgagcccccctttcccccctcctcctccacccgctgccccgcatccccaccacctccggcgagctctccaccggcggcagcggaagagcgggggtttgaggcgaaggagcagcggagcggagacgaggcgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtactgtgtagtcgctgttgaatcagttggtcggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaggcccaagtctcagaagttaaaggagtgatgatggagaatattgagaaggttctggaccgtggggagaagattgagctgcttgttgacaagactgagaatctccgttctcaggcacaagatttcaggcagcagggcaccaaggtgcggcgaaagatgtggctgcagaacatgaagatcaagctcatcgtcctgggcatcatcatcgcgctcatcctcatcatcatcctgtcggtgtgccacggcttcaagtgcggcagcaagtgaggacgacgacgagatgtggagtttttgctctgttagtggttgagtctgattattcttggtgatcacagagcgttcctgatgtctgttctgtggtggttgattgttggttggttggttggtcgggggaagtgactgggtgacgaaggtgttcgagtgtcgtgtaattttggatgctactattgtgcatgtatagcttgtatgctaccctggtcggtcccgctatatgagtagaagttattacgtttgctccccagatcttcgccgttcaacagtgtatagaaatagaggtcatttttcatctgtgacttccgactggtcattgtacgcgttgagcacgcacgcataggtggtcgcgtcgcgtgcttttctgtgtgccgcagcctccggtttgcttccggatgccggtaggcagttgcttcctggatgtggacttgaataacttggtgactggt

SEQ ID NO: 573 - DNA, 1026 bp, Panicum virgatum
cccgctcccccacatccgcaccacctccggcgagcgctccaccggcggcagcggaagagcgggggtctgatcccaggaggcgaaggagcagcggagccgagcggaggccatggggcagcagcagttgatctacgcgttcgtggcgcggggcacggtggtgctggccgagtacaccgagttcaccggcaacttcaccaccatcgcggcccagtgcctgcagaagctcccggccagcaacaacaagttcacctacaactgcgacggccacaccttcaactacctcgtcgaggacggattcacgtattgtgtagtcgctgtcgaatcagtcggccgacaaatccccattgctttcctggacagaattaaggaagacttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaagcccaagtctcagaagttaaaggagttatgatggagaatatcgagaaggttctggaccgtggggagaagattgaactgcttgttgacaagactgaaaatctgcgttctcaggcacaagatttcaggcagcagggcaccaaggtgcggcggaagatgtggctgcagaacatgaagatcaagctgatcgtcctgggcatcatcatcgcgctcatcctcatcatcatcctgtcggtgtgccacggcttcaagtgcggcaagtgaggacgacgacgagatggggagtttttgctctgttagtggttgagtctgattattcttggtgatcacagagctatcctgatgcctgttctgtggttgttgattgctgatggttggtcgggggaagtgactgggtgatggaggtgttcgagtgtcgtgtaattttggatgctactattgtgcatgtatagcttgtattgctaccctggtcggtcccgctatatcagtagaggttgttactacgtttgccctcc

SEQ ID NO: 574 - DNA, 1071 bp, Thellungiella halophila
ggttttcgttgttgttaagtcctctagatctgtagttcttcgcgacagcccataaaattctctggttagacggtagatcaggtcgaatcgaatcgaggatttagggtaaggaaaatggcgcagcaatcgttgatctacagtttcgtcgctcgcggcacggtgatcctcgtcgagttcactgatttcaaaggtaattttacctccatcgctgctcagtgtctccagaagctcccttcttcgaacaacaagttcacctacaactgcgatggtcacacgttcaactacctcgtcgaagatggattcacctattgtgttgttgcggttgattctgctgggcggcagattccgatggcctttctggaaagagtaaaagaggattttaacaagagatatggtggtggaaaggctgcaactgctcaagcaaacagcttgaataaagagtttggctctaagctgaaagagcacatgcagtattgtatggatcatccagatgagattagcaagcttgctaaggtgaaggcgcaagtgtcagaagttaagggagttatgatggaaaacatcgagaaggttcttgaccgtggtgagaaaattgagcttttagtggacaaaaccgaaaaccttcgctctcaggcacaagatttcagaacaacggggacgcagatgagaagaaagatgtggcttcagaacatgaagataaaactcattgttctggccatcattgtcgcactcattctcataatcgtgctctcagtttgtcatggtttcaagtgctaagcccagaaaattcaaaatcccctgagatctttctcattcggtactgccttttcttttattgttctaccatcattctaatgtttctgcttgaattggttttgtatagatagacatatatgtatgctacacatttcctatattgcttgcacctgatgacattttgatcccttgcgaaccagtatttgccaagagatcgaaaactattaaatgattttgccgattgatgactgtcttagctgtgctaggataatcatatgttataaatagaatatttaaatatgatatattttcgtggtg

SEQ ID NO: 575 - DNA, 1069 bp, Nicotiana tabacum
  misc_feature (1068)..(1068): n is a, c, g, or t
gtgtgggggtttgcgcaaaatcaaatttatctccctctctctctctctctctctttacatttttcagtttttgctctgttcaattcgaawagctagggtttttgttatggggcaacaatcgttgatctacagtttcgttgcgagaggaacggtgattttggctgagtatacagagttcacyggsaatttcacaagtatagcatcgcagtgcctccagaaacttcctgcttcmaataacaarttcacttacaattgtgayggycayactttcaactacctcgttgataacggcttcacatactgtgttgtagctgtggaatctgttggcagacaggtcccaattgcatttctggagagagtgaaggatgatttcaccaagaaatatggtggaggcaaagctgctacagctgttgctaacagcttgaacagggagtttgggcccaaaatgaaggagcagatgcaatactgtattgatcatccagaggaaatcagtaagcttgcgaaggtgaaggcccaggtttcagaagttaaaggtgtgatgatggaaaacattgagaaggtcctggatcgtggggagaaaattgaacttctggtggataaaactgagaatcttcgctcacaggcacaagatttcaagacacaaggaacgaaagtcaggagaaagatgtggttgcagaacatgaaagtaaagcttatagtcctggcaatcattgttgccttgattctggtcatagttctttcaatatgtcatggcttcaaatgtcattaattggggctcttttttcttatcatgccggttattgaactcaaaattcttaatttttctagcagtagcctgcccgttccttgtaattcttatcttttttttttgggtgatacattttactttattcttgtggaatgtggacgtatgatgaacagtgcatgtatagcttgtcatgctggaaactggctgtactrccgaaagcttctccttaggagctcattaggtcacacgattttaaccgtgaattacacttttgaaatatctgagccacacacaaaacaacacacagcggctgcaccggnt

SEQ ID NO: 576 - DNA, 894 bp, Nicotiana tabacum
gawttcggcacgaggctctccacaagtcaagagagagaaaaagtcacaaggatatagagagagaagagtgaagggtctccatagtctacaatttttctcttcttcgaaattctactttgtttacttgccaagcaaaatccaagaaaaaaccccaaaaaagaaaacccagatcggcgatccagcaagaaatcaaatgggtcagcagaaggctttgatctatgcgtttgtgggtcgtgggaattgtgatattggctgaatacacagatttcagtggtaacttcaactccatagcttatcagtgccttcagaagctccctgcttcccaataacaagttcacttacaactgtgatggtcacaccttcaattaccttgtcgataatggcttcacatactgtgtggttgctgaggagtccgttggaagacaagttccaatagcatttttggagcgtgttaaggatgattttgtgtcgaaatatgggggtgggaaggctgcsacagctcctccaaacagcctgaacaaggaattcggacctaagttgaaggagcatatgcagtattgtgctgaccatcctgatgaaattagcaaaattgcgaaggtgaaagcccaggtttcggaagttaaaggtgttatgatggaaaacattgagaaggttcttgatcgtggagaaaagatagagcttcttgtggataagacggagaaccttcatcaccaggcacaagacttcaggaatactggaacccaaatccggaggaaaatgtggctgcaaaacatgaagatcaagctgatagtgttaggtatcctgattgctttgatcctcatcattgtcctctcagtttgcaaggggttcaattgtggagagtaaacatgtttatgttgtgatgctacaattcta

SEQ ID NO: 577 - DNA, 988 bp, Nicotiana tabacum
ttcacatcatacgcatttgccatttctcctatttctctctctctctctatcgctttttctctctctagaactctactatactagctagggttttggtttcagccaagagaaatggggcaacagtcgttgatctacagcttcgttgcgcgaggaactgtgatcctcgctgaatacactgagtttacgggtaatttcacaagtatagcctcacagtgcctccagaaacttcctgcttccaataacaagttcacctataactgtgatggccatactttcaactatctcgtcgaagatggcttcacatattgtgttgttgctgtggaatctgttggaagacagattccaattgcatttctagagagaaccaaggaagagtttaccaagaaatatggtggaggcaaggctgctacagctgttgctaacagcttaaacagggagtttgggcccaaactgaaggaacaaatgcagtactgtgtagaccatccagaggaaatyagtaagcttgcaaaggtgaaggctcaggtttcggaagttaaaggtgtgatgatggaaaacattgaaaaggttcttgatcgtggygagaagattgaacttttggtggataagactgagaatcttcgctcacaggcacaagatttcaggacacaaggaacaacaatgaggaggaagatgtggttgcagaacatgaaaatcaagcttatagtcttgggaattattattgccttgattctgatcatagttttgtcagtatgtggtggtttcaattgtcattagtgtggttcctcatccttactaggctggatgttgattgaaaattgtgacacttaatctttgtagcagtggcatgtcagttccttataattctttttttcttttgttgtgacatcttttgttctatgctctgtatcatgagacrctgcctgtatagcttgtaatgctgaattcttttgagtatactattgaatgagtttccctcgttcaccagggc

SEQ ID NO: 578 - DNA, 1085 bp, Nicotiana tabacum
cattacggccgggggacgaaaaaagagtcatcctttgtcataatagattcaaaccttctctccctaaagtgtactgtactctctctctgcatagtccatacaagaagattataatctacactgttccttttgagttcatctttatgtagtttcgaagcaaaaaagcaaatccactataaaaaaccctagcaaattcagatcaccgacgctgaaaatctaatcggaaaagcatccagatggggcagcagaaggcgctgatctacgcatttgtggcacgtggcaacgtattattgtctgaatatactgatttcagcggcaactttaactccatagcctttcagtgcttacagaaacttcctgcttccaataacaagttcacttataactgtgatggccataccttcaattacctcgtcgataatggcttcacatactgtgtggttgctgaagagtctgttggaagacaagttccaattgcctttctggagcgtgttaaggatgactttgtgtcaaaatatggcggtgggaaggctgcaactgctactcctaatagccttaacaaggaattcggacctaaactaaaggagcatatgcactattgtgctgaccatcctgaggagataagtaaactagccaaggtgaaagcccaggtttcggaagttaagggtgttatgatggaaaacattgagaaggttcttgatcgtggagaaaagatagagctgcttgttgataagacagagaaccttcaccatcaggcacaggatttccggaatacggggacacaaatcagaagaaaaatgtggctgcaaaacatgaaggtcaaactcatagtattgggtattctgattgctttgatcctcatcatagttctctcagtttgtcatgggttcaattgtggaaagtgagcatgtttttgtgttctaatgctacatttgtatgagaaaagttcatggtatattgtcattattgatgcatttgatataaatgkctttgaaaagatacratgttwtattctrtatgtatattagatggaagaatcaacatttgcatatagattgcatgtgcaaaagggacccattttggtc

SEQ ID NO: 579 - DNA, 1013 bp, Solanum lycopersicum
aaattcatcttcgtcacgcttccccctttttatctttttcagttgcctcttcatacgcatttttatttctcctctctctctctcttaaattctctattgcttactataccagctagggttttgtttttttttacacagaaaaaatggggcaacaatcgctgatctacagtttcgttgcgcgaggaactgtgattctcgccgaatacactgaattcaccggtaatttcacaagtatagcttcacagtgcctccagaaacttccggcttctaataacaagttcacctataactgcgatggccatactttcaactatctcgtcgaagaaggcttcacatactgtgttgttgctgtggaatctgtcgggagacagatcccaattgcgtttttggagagaaccaaggaagagtttaccaagaaatatggtggaggcaaggctgctacagctgttgccaacagtttaaacagggagttcgggcccaagctgaaggagcagatgcaatactgtgtagatcatccagaagaaatcagtaagcttgcaaaggtgaaggctcaggtttcagaagttaaaggtgtgatgatggaaaacattgaaaaggttcttgatcgtggggagaagattgaacttttggtggataagactgagaatcttcgctcacaggcacaagatttcaggacacaaggaacaacaatgaggagaaagatgtggttgcagaacatgaagatcaagcttatagttttgggaattattattgccttgattctgatcatagttttatctgtgtgtggtggtttcaaatgtcactagtgtggtttgtcatcttactaggctggatgttgattgaaaattgtggcacttttgtagcactcactggcttggcagttccattataattcttttcttcttttattgtgatgtcttgcaatctatcgtctytgtatcatgtatagcttgtattgctgaattctactgagtatattattgaaagagtctccttcctagtttcaccccacc

SEQ ID NO: 580 - DNA, 957 bp, Solanum lycopersicum
tcggccgaattcccatggggatccgatgattcggtggggtcttcccaaaaaaacaaaattcatcgtttctctgtgcttgtacactttcacgcataaatatattcacatactttttatcggtgtttcatttttatcatttttgctctctgcaattcaaaatagctagggtttttgtctcttctcgagtgtgtgagaagagagaggaaaaatggggcaacaatcgttgatctacagcttcgttgcgcgaggaacggtgattctcgctgagtatactgagttcactggaaattttaccagtattgcatcgcagtgccttcagaaactccctgcttccaacaacaagttcacctataactgtgatggacatacttttaactacctcgtcgatgacggcttcacatactgtgttgtagctgtggagtctgttggcagacaggtcccaatcgcatttctggagagagttaaggatgattttaccaagaaatatggtggaggcaaagctgctacagctgttgctaacagcttgaacaaggagtttgggcccaaaataaaggagcagatgcagtactgtgttgatcatccagaggaaatcaacaagcttgcaaaggtgaaggctcaggtttcggaagttaaaggtgtgatgatggaaaacattgagaaggtcctggatcgtggggagaaaattgaacttttggtggataaaactgagaaccttcgttcacaggcacaagatttcaagacacaaggaacaaaagtgaggaggaagatgtggttgcagaacatgaagataaagcttatagtcctgggcatcatttttgccttgattatggtcatagttctttcaatatgtcatggcttcaattgtcattaattgatggtcatttattataacggtggttattgaactacaattcctaaacacttctagcagtaaaatgcctgatccttgtaattcaa

SEQ ID NO: 581 - DNA, 1220 bp, Triphysaria pusilla
gggaattacgccattacggccgggggttcatctctgtagctccttctttcctctttctcgctcttactttatccatcacattgaaacagtagctgagcaaaatcgagatctggggaaacaaatcaatcaaatagacgcgagaaaaccccaagctacgagtattatcatcttccctattcgattaggataaagctctgttgaaaaatggcccaaaacagccggaagacgctgatctacgcactggtggcgcgtggaacgccgccggtggtgctgtcggagtacacggagttcagcggaaacttcaattcaatagcctatcagtgtctccagaagctcccggccaccaacaataagttcacctacaactgcgataatcacaccttcaactacctcgttcacgatggcttcacatactgtgttgttgctgaagaatctgctggaaggcagttacctatagcttttctggagcgtgttagggatgaatttgtggcgaaatatgctgctggcaaggctgcaacagctcctgctaatggccttaacaaagaatttggaccaaagttgaaggagcatatgcaatactgcgttgagcaccctgaagagataagcaaactttccaaggtcaaggctcaggtttcagaagttaagggtgttatgatggagaacattgagaaggttctagatcgtggagaaaagatagagatactggtggataagactgagaatctccataaccaggcccaggacttcaggagcaccggtacgaaaatcaggagaaaaatgtggctgcaaaacatgaagatcaagttgatcgttttggcaattgtgattgcacttatcctcattatagtgctctctatctgcaagggattcaactgcggaaactgaattgcctactcgtcggatcatttgtagattgatctctgtgctgacccgattctgatacagcctttggaaatgattaaataattcgttttgtacgtattaaagcaggtaaggtatctatacaatatatcgctaaggacaacccttcatctttttttttctgagttacaataaattgtgcaaattttacgttattgttgtagttaagtgcatattgatgcatccactttggtttgaagtttgaaataattgactgaatttgttgacctcgtagaatactttataactatatgtctacttttcctaatattagtgacaggctcaatcttccatcggta

SEQ ID NO: 582 - DNA, 1130 bp, Triphysaria pusilla
gcggctttgctccccaaatgcgtctttcctctctctactttccaaagaatagtaccaacattttcctttctatatctcttatttatctctacatttttactttttacggtttccatacaaaagaatataaatctgcttggcctaggtttatcagggaaggaatagaaaatggggcagcaatcgttgrtctacagcttcgtggcgcgtgggacggtgatcctgtccgagtacactgagttctccggcaacttcaccggaatcgcatcgcagtgcctccaaaaactccccgctaccaacaacaagttcacctacaactgtgatggccacaccttcaactacctcgttgatgatggatttacatattgtgttgtggctattgagtctgtcggaagacagyttcctattgcatatcttgagcgagttaaggatgattttaccaagaaatatggtggaggaaaggctgctacagctgttgccaacagtcttaataaagagtttgggcccaaactgaaggagcagatgcagtactgtgtagatcatccagaggagatcagtaagctttcgaaggtgaaagctcaggtttcagaagttaaaggggttatgatggaaaacattgaaaaggttctcgatcgtggagagaagattgagcttttggtggataaaactgagaatctccactcgcaggcacaagactttaggacacaaggaaccaagatgaggagaaagatgtggttgcagaatatgaagataaagttgattgttcttggtattatcattgccttgatcttaatcatagttttatcagtttgtggtggattcaaatgccattagtgtgtgtaagtgtgtctcaataggttgtcgtcatcattcagctttgtttcccctaaattgttttggtgatacgttttgcccagttgctttattatgtatttttgtgatatataaatatttgtatagtttgtgacttgtgtatttgaatatattggataagagatgtttgaaatgtcgcggctgcggaaggagttggtcaccctcggtcaatatagagcagcagtatgtgtgtgcctttttctcttggaatctcatttataaattttagcgaaaattacaaatattaccttgatgttcca

SEQ ID NO: 583 - DNA, 1075 bp, Triphysaria pusilla
aaatggcatgttgactgtaatttcacaaattcacacagatacaagaaatttcaaatcatcgtccccggtatactcacgtttcctcttcaaatgactcgctttctctctctagacttctcaacaaaccattgccaataagtactatttcccttcttacttttattcgtgatacccccttcaaaactctctctctctctagatcacagataaagggcttcgactagggtttattggagcgagagacaaaggaaatagaaatgggacagcagtcgttgatctacggattcgtcgcgcgtgggacggtgatcctcgccgagtacacagagttcaccggtaacttcaccggaattgcagcgcaatgcctccagaaactccctgctaccaacaacaagttcacgtacaactgcgatggccataccttcaactaccttgtcgataatggattcacttactgtattgtggctgttgaatccgttggaagacaaattcctatagcatttcttgagcgtgttaaggaagattttaccaagaaatatggtggtggaaaggctgctacagctgtcgccaacagtctgaataaagagtttgggcctaaactgaaggagcaaatgcaatactgcgtggatcatcccgaagaggtcagcaaacttgctcaagtgaaagcgcaagtttcagaagtgaaaggggtgatgatggaaaacattgaaaaggttcttgaccgtggagagaaaattgagctattggttgataaaactgagaaccttcgctcccaggcccaagattttaggacacaaggaaccaaaatgaggagaaagatgtggttgcagaatatgaagataaagctgattgtccttggcatcattattgctttgatccttatcatagttttatcagtatgcggtggattcaaatgttaaagtgtgtgtgttggttgtcttttacttttcataggctgtccttgtggggaaggggaacacactcatatgttctgacatttgaacatcttttgtttcttataaatattttttggtgactctcagtttggccttttactgtaaactctattttgtaagac

SEQ ID NO: 584 - DNA, 872 bp, Juglans hindsii x Juglans regia
tgtgttggtcccggggatcggccattacggccggggattgatagcgagttcatctccctccaagacttttctctctttttttgttttcatttctctttcctagggttagggttgaggtgatcgattcgatggggcagcagtcgttaatctacagcttcgtggctcgagggacggtgatcctggccgaatacacggaattcagcggaaacttcaccggcatcgcctcgcagtgccttcagaaacttcctgcttccaacaacaggttcacctacaactgcgacggccacaccttcaattacctcgtcgacaacggcttcacttactgtgtggttgctgttgaggctgttgggcggcagatgccaattgccttcctcgagcgaatcaaggaggatttcacccagagatatggtggaggaaaagctgcaacagcagttgccaatagcttcaacaaggagtttgggcccaaattgaaggagcagatgcaatattgtgtagatcatccagaggagatcagcaagctggctaaagtgaaagctcaggtttcggaagtcaaaggagttatgatggaaaatatagagaaggttcttgaccgtggagaaaagattgagcttctggtggataaaacagagaaccttcgttctcaggcacaagatttcaggcagcaaggaacccagataaggagaaaaatgtggttccagaacatgaagataaagctgatagttctgggtatcctggttgccttgattctcatcatagttctatccgtttgtggtggtttcaattgcggtaaaaagtgaattgcttcacgatttcattaatgccggtttacctatagtgtttttggttacacggtccacttctactgtatgttg

SEQ ID NO: 585 - DNA, 1119 bp, Triticum aestivum
caaagcgaaaccgacctttcccccttcccctcccctcccctcccgcagcagcctcgccgagatccaatccggcagcccccctcccccgccggcggcgagctccagcggagaggcggcgaagcgcgcgggaggagccatgggccagcagtcgctcatctacgcgttcgtggcccgcggcacggtggtgctggccgagtacaccgagttcaccggcaacttcaccaccatcgcctcccagtgcctcgtcaagctccccgccagcaacaacaagttcacctacaactgcgacggccacaccttcaactacctcgtcgaggacggcttcacatactgtgtggttgctgtggaatcagtggggcaacagatgccaattgctttcttggttcgggttaaggacgatttcagcaaaagatatgctggtgggaaagctgctactgctgcaccaagcagcctcaacagagagtttgggtcaaaactcaaagagcacatgcagtactgtgtagaccaccctgaagagataaacaagctcgctaaagtgcaagcacaagtttcagaagtcaagaacgtgatgatggaaaacattgagaaggttcttgatcgcggggagaagattgagctgcttgttgacaagacagagaatctccgctcacaggcccaagatttcaggcagcaaggaacacaggtgaggagaaagatgtggctacaaaacatgaagatcaagctgattgtcctgggcatcatcgtcgcgctcatcctcatcataatcctgtcggtgtgccatgggttcaactgtggcaagtccaagtgaggactactcgaggtcgtgagacacattcaactgtccttatattactgctgattcgagcaaaacccatatatggtgcttagtgttctttcttctctagtgtgcgctggcccgggccgtggtgcctgtgggtgggtctgtgttttcgttgtcgtcgtgttgggatgttcgcttaccgccggatgggtggtggctgggtcggcgggtcgtgtatttttggacgctatgtatgtatagcttggatcttgacatctttgttctattgttatatgatgatgaggatgagtagtagatttacttaattggagtcggaa

SEQ ID NO: 586 - DNA, 1123 bp, Triticum aestivum
accgacctttcccccttcccctccccctcacccctcccctcccgcagcagcctcgccgagatccaatccggctgccccccaactcccccaccggcggcgagcgactcggcgagagggagagagcgagggcggagcgaggacgagcgggcggagccatggggcagcagtcgctgatctacgcgttcgtggcccgcggcacggtggtgcttgccgagtacaccgagttcaccggaaacttcaccaccatcgcctcccagtgcctcgtcaagctcccggccagcaacaacaagttcacctacaactgcgacggccacaccttcaactacctcgtcgaggacggcttcacatactgcgtggttgccgttgaatcagtggggcaacagatgccaattgctttcttggttcgggttaaggatgatttcagcaagagatatgctggcgggaaagctgctactgctgcaccaagcagcctgaacagagagtttggatcaaaactcaaagagcacatgcagtactgtgtggaccaccctgaagagataaacaagctcgctaaagtgcaagcacaagtttcagaagtcaaaaacgtgatgatggaaaacattgagaaggttcttgatcgtggggagaagattgagctgcttgttgacaagacagagaatctccgctcacaggcccaagatttcaggcagcaaggaacacaggtgaggagaaagatgtggctacaaaacatgaagatcaagctgatcgtcctgggcatcatcgtcgcgctcatcctcatcataatcctgtcggtgtgccacggattcaactgcggcaagaagtgaggacaagtcgaggtcgtgagacacattcaactgcccctatattactctgctgattcgagcaaaaaccatatatatggtgcttagttcttttcttgtttagtgtgcgctggcccgggccgtggtgcctgtgggtgggtctgtgttttcgttgtcgtcgtgttgggatgttcggttaccgctggatgggtggtggctgggtcggcgggtcgtgtatttttggacgctatgtatgtatagcttggatcttgacgcctttgttctattgttatatgatgatgatgagtagtagatttacttaa

SEQ ID NO: 587 - DNA, 1138 bp, Triticum aestivum
caaagcgaaaccgacctttcccccttcccatcccacctcccctcccctcccgcagcagcctcgccgagatccaatccggcagcccccctcccccaccggcggcgagcgagccagcgagagggcggagagcggcggggaagcacgcgggaggagccatggggcagcagtcgctcatctacgcgttcgtggcccgcggcaccgtggtgctggccgagtacaccgagttcaccggcaacttcaccaccatcgcctcccagtgcctcgtcaagctcccggccagcaacaacaagttcacctacaactgcgacggccacaccttcaactacctcgtcgaggacggcttcacatactgtgtggttgctgttgaatcagtggggcaacagatgccaattgctttcttggttcgggttaaggatgatttcagcaagagatatgctggcgggaaagctgctactgctgcaccaagcagcctcaacagagagtttggatcaaaactcaaagagcacatgcagtactgtgtggaccaccctgaagagataaacaagcttgctaaagtgcaagcacaagtttcagaagtgaaaaacgtgatgatggaaaacattgagaaggttcttgatcgtggtgagaagattgagctgcttgttgacaaaacagagaatctccgctcacaggcccaagatttcaggcagcaaggaacacaggtgaggagaaagatgtggctacaaaacatgaagatcaagctgatcgtcctgggcatcatcgtcgcgctcatcctcatcataatcctgtcggtgtgccacggattcaactgcggcaagaagtgaggacaactcgaggtcgtgagacacattcaactgcccctatattactctgctgatttgagcaaaaaccatatatatggtgcttagttcttttcttgtctagtgtgcgctggcccgggccgtggtgcctgtgggtgggtctgtgttttcgttgtcgtcgtgttgggatgttcggttaccgctggatgggtggtggctgggtcggcgggtcgtgtatttttggacgctatgtatgtatagcttggatcttgacgcctttgttctattgttatatgatgatgagtagtagatttacttaatcggagtcaaaaaaaaaa

SEQ ID NO: 588 - DNA, 1161 bp, Zamia vazquezii
atcgggggaagggggggagggcgcgggttgacattttagcagggcgttttcccttcatttcaagggcattttggggcacattccccattccaagagtcccgattgaacaaggaatgcgtcaaggcttccacggctgcccgcaggaggtttctttcccttctagaaggattgtccaaatccccaattgaagtattacttgccttcccttcgcgtcgggggggtttatttgttgagttgagttgaaaaatccacggatccgagggtttgatttttggtagggttgtttcagaatggggcaccagtctctcatatacagttttgttgcaaggggcacggttgtccttgcaaagtacaccgaatttacgggcaattttacaagcattgcatcacagtgcctgcaraagctcccggccagcaataataaattcacatacaactgcgataaccacacctttaactaccttgttgaagatggtttcacatattgtgtagtagcagttgaatcggttgggagacaaataccaatagcctttttggagcggatcaaagaagattttaagaggagatatggaggtggaaaagctgacactgctgttgctcatggcctcaataaagaatttggaccaaaattgaaagagcatatgcaatattgtgttgaccacccagaagagatcagcaagcttgcaaaagtgaaggctcaggtttcagaagttaaaggtgttatgatggaaaatatagaaaaggtccttgatcggggtgagaagattgaacttytggttgataaaacagagaaccttcgttttcaggcccaagacttccaaaagcagggtacacagttacgcaggaaaawgtggttccagaatatgaaagttaagmtgattgttcttgggatattggttgccttgattyttataatagttctttcagtatgccatggattcaagtgttgacaatgctacaaaactgtatggtccatttgtactgctgtattagccttgtttggctatcggtcttgtttattatgtgtgttatagtccctcctaaatgtgggsttcaggtgacataattttgtgctgtttttatagaggatatataacttggggagtcatgacttaatgacacattaatatggcggtcgtaatgttgtgaatttcacacttt

SEQ ID NO: 589 - DNA, 1023 bp, Hordeum vulgare
agagccaggtttgccctagcccccccgcgcaccggatcgccacctcttccgcggccgcacaaactgtcgaaaccaccacaattccacaaatttgcctsccctctttttccccaggctaaacaacccatccagagccggagaacgtcagaggaatccagaggcacccccgagtttgttggcgatgttgcgcgcgggaggaagccggctcgtcgcgcccggactccggcgcttcctcggcccgggcgccggcgagagggccgcgccggggctggcggcggcgggggcgagggcgtaccacgagcgggtggtggaccactacaacaacccgcggaacgtggggtccttcgacaaggacgaccccaacgtcggcaccgggctggtcggcgcgccggcctgcggcgacgtcatgaagctgcagatccgtgtcgacgaaggcaccgggaagatcgtcgacgcctgcttcaagaccttcggctgcggctccgcaatcgcgtcatcctccgtcgctaccgaatgggtgaagggaaagcaaatggaggaagtagtgagtatcaagaacactgagattgcaaagcacttgtcacttccaccagtaaagctccattgcagcatgcttgctgaagatgcaattaaagctgccgtgaaagattatgaatcaaagaaggcgaagctgggagacagccctgcggagaaggctgccgaagcatgaacatgttcccaccatgaaggatgttgatcgtctgtgatgcatctgctcctagtaaagatatatgcttctgttttatgagggtgggaaacggtgtgcaatgtcacaaactccagtgttgtagcatgtatcataaggacgaacacgaacaatttggaataaacgtgctgtcatgttaggagaagttgtgcatgtatagcagctgctaagaaaatttgtgcatgtatagcaactgcttggaagtctttaagtacactttatgtcatttgcctgttccgaaaacattcgttctatcttgtgggttattttgttgaatc

SEQ ID NO: 590 - DNA, 834 bp, Brachypodium distachyon
aggttaaacaaatccatccaaagccggagagaggcagaagaatccagaggcacttccaagtttgttggcgatgttgcgcacgggaggaagtcggctcgtcgccccggggctccggcggctcctcggccctagcggccgcgagggggcggcgccgggactgtcggcggcgggggtgagggcgtaccacgagcgggtcgtggaccactacaacaacccgcggaacgtggggtccttcgacaaggacgaccccaacgtcggcaccgggctggttggcgcgccggcctgcggagacgtcatgaagcttcagatccgcgtcgacgagggcacggggaagatcgtagacgcctgcttcaaaaccttcgggtgcggctccgccatcgcgtcgtcctccgtcgctactgaatgggtgaagggaaagcaaatggaggaagtagtcactatcaagaacactgagattgcaaagcacttgtcacttccaccagtaaagctccattgtagtatgcttgcggaagatgcgattaaagctgctgtgaaagattatgaagcaaagaaggctaaggtgggagacagccctgcagagaaggttgctgaagcatgaacatgatatggatgcttctgttctctgagggtgggtaatagtgtgtaacgttcacagactccggtggcggagcatgtatcataaggatggacacgaccatgttgaaataattgtgctgtcatattaggaaagtttgtgcttgtataacagctgtctggtacggctgcctgatccaccaagataattttcaatcttggggttttattcgttgatgaattaattcacgcctgagatga

SEQ ID NO: 591 - DNA, 934 bp, Festuca arundinacea
ggcacgaggctctcccccaccccccaggttaaacaatccatccatccrsagccggagagcgtcagaagaatccagasgagscaaacctccgagattgttggcgatgctgcgcacgggaggaagtcggctcgtggccccggcgctccggcggctcctcggcgagagggcccagccggggctggcggcggcgggcgccagggcgtaccacgagcgggtggtggaccactacaacaacccgcgcaacgtcggctccttcgacaaggacgaccccaacgtcggcaccgggctcgtcggcgcgccggcctgcggcgacgtcatgaagctgcagatccgcgtcgacgagggcaccggsaagatcgtcgacgcctgcttcaagaccttcggatgcggctccgccatcgcmtcgtcatccgtcgctactgaatgggtgaagggaaagcaaatggaggaagtagtgactatcaagaacactgagatcgcaaagcacttgtcacttccaccagtaaagctccactgcagtatgcttgctgaagatgcaattaaagctgccgtgaaagattatgaagcaaagaaggcgaagctgggagatggccctgcagagaaggctgctgaagcatgaacacgcagttcctgtcatgaggggtattaaccatctgccatgcatctgctctagtgatgatatatgcttctgttatctgatggtgggaaatagtgtgtaattttcacaaactccggtgatgttgcatgtatcgtaaggattaacacgaacagcttggaataaaagtgtggtcatgttaggaagaagttgtgtgtgcatagcagctgaaaaatcgtgcatgtatagcagctgcttggaagtattgtagtgatacttgctgatgtaagatgcaaatctactgtttggtttttctttgtgatgctgttagggttttgt

SEQ ID NO: 592 - DNA, 854 bp, Leymus cinereus x Leymus triticoides
aaacaacccatccagagccggagaacgtcagaagaatccagaggcacccccgagtttgttggcgatgttgcgcgcgggaggaagccggctcgtcgcccccggactccggcggctcctcgkcccgggcgccggcgagagggcagcgccrggtctgacggcggcgggggcgagggcgtaccacgagcgggtggtggaccactacaacaacccgcggaacgtggggtctttcgacaaggacgaccccaacgtcggcaccgggctggtcggcgcgccggcctgcggcgacgtcatgaagctgcagatccgtgtcgacgaaggcaccgggaagatcgtcgacgcctgcttcaagaccttcggctgcggctccgcaatcgcgtcgtcctccgtcgctaccgaatgggtgaagggaaagcaaatggaggaagttgtgagtatcaagaacactgagatagcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaacatgttcccgccgtgaaggatgtcgacggtctgcgatgcatctgctcctagtaaagatatatgcttctgttctatgagtgtgggaaatggtgtgcaatgtcacaaactcragtgttgtagcatgtatcataaggatgaacacyaacagtttgaaataaatgtgctgtcatgttaggagaagttgtgcatgtatagcagctgctacgaaaatttgtgcatgtatagcaactgcttggaagtcttaaagtacacttgatgtca

SEQ ID NO: 593 - DNA, 873 bp, Zea mays
accgccgcacaacaaatagaaccacgcccacaattctgaacaacgcagagaaaagaaaaccgctccaatccggaagctgaaaatagcagaagaatccagaggcgactccaggtttgtcggcgatgctgcgagcgggaggcaggcggctcctcgccccggggctccgtcggctcggcctgggcacaggcgcctccggcgaggcgggtcctgccgcggcggcggcgggggtgagggcgtaccacgagcgggtggtggaccactacaacaacccgcggaacgtaggttccttcgacaaggacgaccccaacgtcggcactgggttggtcggcgcgccggcctgcggcgacgtcatgaagctgcagatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatcgcgaagcacttgtcccttccaccagtaaagctccattgcagcatgcttgccgaggatgcgattaaagctgctgtaaaagactacgaagccaagaagtcgaagatggggcagaagggtgaagacagcccttcagagaaggctgctgaagcatgaaaggttctgccgtgaagtatattgtgctgatacgtttctcagtccatgactatccgccgcatattgccaaagataaatgattctgtttgtgaggcgagggattgtgtgtaatgttcacgaagtgtggtagtgcggcatgtggctcaactgttttaaggatggtgacgactgatttcaaataaatttgctgtcatcgtagaattagaag

SEQ ID NO: 594 - DNA, 890 bp, Zea mays
gaaagcgcgcctaagtagtcattaaaacacgaactttaaccaaacagcacgggaaccacgcccaaacgaagagaaaagagaagaacctcaatccggaagcgaaaaggaccagaagaaaccagaggcgactccaggttcgtgggcgatgctgcgcgcgggagctaggcagctccttgccccggggctccggcggctcggtctgggcaccggcgccgccggtcaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatgaaagtttctgccttttttaagtgtaattgagctgatatgtttctcagtccatgactccccgctgcttcagataaatgcttctgattgcgaggcgaggcgagggaccgcgtgtaatgttcacaaattctggtagtgcggcatgtgccttaactcttttgaggatggtgacaaccaatttcaaataaatttggtgccatcttaga

SEQ ID NO: 595 - DNA, 826 bp, Zea mays
ctctttccccaggttaaacaacccatccatagccggagaacgtcagaagaatccagaggcacccccgagtttgttggagatgttgcgcgcgggaggaagccggctcgtcgcccccggactccggcgtctcctcggcccgggcgccggcgagagggcggcgccggggctggcggcggcgggggcgagggcgtaccacgagcgggtggtggaccactacaacaacccgcggaacgtcgggtctttcgacaaggacgaccccaacgtcggcaccgggctggtcggcgcgccggcctgcggcgacgtcatgaagctgcagatccgtgtcgacgaaggcaccgggaagatcgtcgacgcctgcttcaagaccttcggctgcggctccgcaatcgcctcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaagatgatatatggttctgttctatgagggtgggaaatgatgtgcaatgttcacacactccagtgttgtagcatgtatcataaggatgaacacgaacagtttgaaataaatgtgctgtcatgttaggagaagttgttcatgtatagcagctgctacgaaaatttgtgcatgtatagcaactgcttggaagtcgtaatgtatactgtcatttgcccgttac

SEQ ID NO: 596 - DNA, 855 bp, Pseudoroegneria spicata
cccatcctgggccagagaacgtcagaagaatccagaaggcacctccgagtttgttggcgatgttgcgcgcgggaggaagccggctcgtcgcccccggactccggcggctcctcggcccgggcgccggcgagagggcggcgccggggctggcggcggcgggggcgagggcgtaccacgagcgggtggtggaccactacaacaacccgcggaacgtggggtccttcgacaaggacgaccccaacgtcggcaccgggctggtcggcgcgccggcctgcggcgacgtcatgaagctgcagatccgtgtcgacgaaggcaccgggaagatcgtcgacgcctgcttcaagaccttcggctgcggctccgcaatcgcgtcgtcctccgtcgctaccgaatgggtgaagggaaagcaaatggaggaagtagtgagtatcaagaacactgagattgcaaagcacttgtcacttccaccagtaaagctccattgcagcatgcttgctgaagatgcaattaaagctgccgtgaaagattatgaatcaaagaaggcgaagctgggagacagccctgcagagaaggctgccgaagcatgaacatgatatatgcttctgttctatgagggtgggaaatggtgtgcaatgttgacaaactccagtgttgtagcatgtatcataaggatgaacacgaacagtttgaaataaacgtgctgtcatgttaggagaagttgtgcatgtatagcagctgctacgaaaatttgtgcatgtatagcaactgcttggaagtcttaatgtacacttgatgtcatttgcccgttccaaaaacatttggatctatcttgtgggttattttgtaaaaaaaaaa

SEQ ID NO: 597 - DNA, 841 bp, Secale cereale
ccacgcgtccggaacgtaagaagaatccagaaggcacccccgagtttgttggcgatgttgcgcgcgggaggaagccggctcgtcgcccccggacttcggcggctcctcggcccgggcgccggcgagagggcagcgccggggctggcggcggcgggggcgagggcgtaccacgagcgggtggtggaccactacaacaacccacggaacgtcggttctttcgacaaggacgaccccaacgtcggcaccgggctggtcggcgcgccggcctgcggtgacgtcatgaagctgcagatccgtgtcgacgaaggcaccgggaagatcgtcgacgcctgcttcaagaccttcggctgcggctccgcaatcgcgtcgtcctccgtcgctactgaatgggtgaagggaaagcaaatggaggaggtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgctgaagcatgaacatgatatatgcttctgttctatgatggtgggaaatggtgtgcaatgttgacaaactccagtgttgtagcatgtatcataaggatgaacacaaacaacttgaaataaatgtgctgtcatgttasgagaagttgtgcatgtatagcagctgctacgaaaatttgtgcatgtatagcaactgcttggaagtcttaagtacacttgatgccatttgtctgttcgaaaaacatatggttctatattgctggttattttgttc

SEQ ID NO: 598 - DNA, 926 bp, Sorghum bicolor
gcagagaaaaaaaagaaaagaactcgctccgaaccctgcgatcagaagaatccagactccagaggcgactccaggtttgtgggagatgctgcgcgcaggaggcaggctgctcctcgccccggggctccggcggttcggcctgggcaccggcgccgccgccggcgaggcgggccctgccgccgcggcggcgggggtgagggcgtaccacgagcgggtggtggaccactacaacaacccgcggaacgtcggttccttcgacaaggaggaccccaacgtcggcactgggctggtcggcgcgccggcctgcggggacgtcatgaagctgcagatccgcgtcgacgaggactccggcaagatcgtcgacgcctgcttcaagacctttggctgcggctccgccatcgcgtcctcgtccgtcgctactgaatgggtcaagggaaaaccaatggatgaagttttgacaatcaagaacactgagattgcaaaacacttgtcccttccaccagtaaagctccattgcagcatgcttgctgaggatgcgattaaagctgctgtgaaagactacgaagccaagaaggtgaagatggggcaaaagggtgtagacagtccttcagagaaggctgctgaagcatgaaagtttctgccatgaagtatactgagctgatatgtttctcagtccatgactccctgccacttattgttgccaaagataaatgcttctgtttgtgaggcgagggattgtgtgtaatgttcacaaactctggtagtacggcttgtggcttaactcttttaaggatggtgacgaccaatttcaaataaatttgctaccatcttagaattagaagaaagtacttctatgtgcatgtacaagagctgtttctagaagtgttatctgtcaacatacgtaatggaattacggtcaccgttgc

SEQ ID NO: 599 - DNA, 659 bp, Saccharum officinarum
aaaagaagtcgctccaatccggaagccgaaaagatcagaagaatcgagaggcgactccaggtttgcgggagatgctgcgcgcaggaggcaggcggctcctcgccccggggctccggcggctcggcctgggcaccggcgccgccgccgccgccggcgaggcgggcccggccgccgcggcggcgggggtgagggcgtaccacgagcgggtggtggaccactacaacaacccgcggaacgtcggctccttcgacaaggaggaccccaacgtcggcactgggctggtcggcgcgccggcctgcggggacgtcatgaagctgcagatccgcgtcgacgaggactccggcaagatcgtcgacgcctgcttcaagacctttggctgcggctccgccatcgcgtcctcgtccgtcgctactgaatgggtgaagggaaaaccaatggatgaagttttgacaatcaagaacactgagattgcaaagcacttgtccctttcaccagtaaagctccattgcagcatgcttgctgaggatgcgattaaagctgctgtgaaagactacgaagccaagaaggcgaagatggggcaaaagggtgaagacagtrcttcagagaaggctgctgaagcctgaagtttctgsccgkgagtatattgagctgatgtgttt

SEQ ID NO: 600 - DNA, 1024 bp, Panicum virgatum
aaaaggattcctccaattcggaaaccggaaagaccagaagaatccggaggcagctccaggatcgtgggcgatgctgcgcgcgggaggcaggcggctcctcgccccggggctccggcggctcggctttggcgccgccggcgaggcgggcccggccgcggcgggggcgagggcgtaccacgagcgggtggtggaccactacaacaaccctaggaacgtggggtcgttcgacaaggacgaccccaacgtcggcaccgggctggtcggcgcgccggcctgcggcgacgtcatgaagatgcagatccgcgtcgacgaggactccggcaagatcgtcgacgcctgcttcaagaccttcggctgcggctccgccatagcgtcctcatccgtggctactgaatgggtgaagggaaaaccaatggatgaagttttgactatcaagaacactgagattgcaaagcacttgtcgcttccaccagtaaagctccactgcagcatgcttgcagaggatgcgattaaggctgctgtgaaggactacgaagccaagaaggcgaagatggggcaaaagggcgaagacagcccttcggagaaggctgctgaagcatgaacgtgaagtttctgccatgaagacacggcacttgcatattttgattcccgaatccaccatcatgcatctgcaaagataaatgctactggccgtaaggtgggggattatgtgtaatgttcacaaactctggtactgcagcatgtatcataactcgggtacggagagggagcaatttcaaataaatctgctgccatcttagaaaagagtatgttcatgtacaagagctgtgtctagaagtgctgtttggctgtacgttatttatgtacaatacaacttgctcgtcgatgcacttcgaaaggaaattcgcacttcgacgatgcctttgctcgtcggaaatacgcacttcgacgatgcctttgctcgtcggaaattcgaatattacgaccaaataaaaggtgtaatttgccggtataggcaaatccg

SEQ ID NO: 601 - DNA, 894 bp, Panicum virgatum
gagaaaagaaaaaggattcctccaatccggaaaccgggaaggagcagaagaatccggaggggagctccaggattgtgggcgatgctgcgcgcgggaggcaggcggctcctcgccccggggctccggcggctcggcttcggcgccgccggcgaggcgggcccggccgcggcggcggcggcgggggcgagggcgtaccacgagcgggtggtggaccactacaacaaccctaggaacgtggggtcgttcgacaaggatgatcccaacgtcggcaccgggctggtcggcgcgccggcctgcggcgacgtcatgaagatgcagatccgcgtcgacgaggactccggcaagatcgtcgacgcctgcttcaagacgttcggctgcggctccgccatagcgtcctcgtccgtggctactgaatgggtgaagggaaaaccaatggatgaagttttgactatcaagaacactgagattgcaaagcacttgtcgcttccaccagtaaagctacattgcagcatgcttgcggaggatgcgattaaagctgctgttaaagactacgaagccaagaaggcgaagatggggcaaaagggcgaagacagcccttcagagaaggctgctgaagcatgatcgtgaagtttctgccatgaaggttttccagtcatgcatctgcaaagataaatgcttctggccttaaggtgggggattgtgtgtaatgttcacaaactctggtactgcagcatgtatcataactcaaggatggagacgaacaatttcaaataaatctgctgccatcttagaaaagagtatgttcatgtacaagtgctgcgtctcgaagtgttgtttggctgtacgttacttatgtgcaattagtaagtttttttttgggtgcagaatgctacc

SEQ ID NO: 602 - DNA, 840 bp, Triticum aestivum
aaacaacccatccatagccggagaacgtcagaagaatccagaggcacccccgagtttgttggagatgttgcgcgcgggaggaagccggctcgtcgcccccggactccggcgtctcctcggcccgggcgccggcgagagggcggcgccggggctggcggcggcgggggcgagggcgtaccacgagcgggtggtggaccactacaacaacccgcggaacgtcgggtctttcgacaaggacgaccccaacgtcggcaccgggctggtcggcgcgccggcctgcggcgacgtcatgaagctgcagatccgtgtcgacgaaggcaccgggaagatcgtcgacgcctgcttcaagaccttcggctgcggctccgcaatcgcctcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaagatgatatatggttctgttctatgagggtgggaaatgatgtgcaatgttcacacactccagtgttgtagcatgtatcataaggatgaacacgaacagtttgaaataaatgtgctgtcatgttaggagaagttgttcatgtatagcagctgctacgaaaatttgtgcatgtatagcaactgcttggaagtcgtaatgtatactgtcatttgcccgttccaaaaacactcggttctatattgttggtta

SEQ ID NO: 603 - DNA, 876 bp, Triticum aestivum
ccaggttaaacaacccatccggagccggagaacgccagaagaatccagaggcacccccgagtttgttggcgatgttgcgcgcgggaggaagccggctcgtcgcccccggactccggcggctcctcggcccgggggccggggagagggctgcgccggggctggcggcggcgggggcgggggcgagggcgtaccacgagcgggtggtggaccactacaacaacccgcggaacgtcgggtctttcgacaaggacgaccccaacgtcggcaccgggctggtcggcgcgccggcctgcggcgacgtcatgaagcttcagatccgtgtcgacgaaggcaccgggaagatcgtcgacgcctgcttcaagaccttcggctgcggctctgcaatcgcctcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgagcatgatatatgcttctgttctatgagggtgggaaatggtgtgcaatgttcacaaagtccagtgttgtagcatgtatcataaggatgaacacgaacagtttgaaataaatgtgctctcatgtttggagaagttgttcatgtatagcagctgctacgaaaatttgtgcatgtatagcaactgcttggaagtcgtaatgtacaatttgtcatttgcccgttccaaaaaacattcggtactatattgctggttattttgttgagcttgtctgca

SEQ ID NO: 604 - DNA, 939 bp, Triticum aestivum
tagccccttgccgcgcaccggatcgccacctcttccgacttccgcggccgcataaactgtcgaaaccacaactccacaaatttgcctcccctctttccccaggttaaacaacccatccggagccggagaacgtcagaagaatccagaggcacctccgagtttgttggcgatgttgcgcgcgggaggaagccggctcgtcgcccccggactccggcgtctcctcggcccggacgccggcgagagggctgcgccggggctggcggcggcgggggcgagggcgtaccacgagcgggtggtggaccactacaacaacccgcggaacgtcgggtccttcgacaaggacgaccccaacgtcggcaccgggctcgtcggcgcgccggcctgcggcgacgtcatgaagctgcagatccgtgtcgacgaaggcaccgggaagatagtcgacgcctgcttcaagaccttcggctgcggctccgcaatcgcgtcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaacatgatatatgcttctgttctatgagggtgagaaatggtgtgcaatgttgacaaactccagtgttgtagcatgtatcataaggatgaacacgaacaacttgaaataaatgtgatgtcatgttaggagaagttgtgcatgtatagcagctgctaagaaaatttgtgcatgtatagcaactgcttggaagtcttaaaagtacacttgatgtcatttgcccgttctaaaaaatattcggttcta

SEQ ID NO: 605 - DNA, 732 bp, Triticum aestivum
  misc_feature (302)..(302): n is a, c, g, or t
  misc_feature (576)..(576): n is a, c, g, or t
  misc_feature (648)..(648): n is a, c, g, or t
  misc_feature (697)..(697): n is a, c, g, or t
cgctccaatccggaagctgaaaatagcagaagaatccagaggcgactccaggtttgtcggcgatgctgcgagcgggaggcaggcggctcctcgccccggggctccgtcggctcggcctgggcacaggcgcctccggcgaggcgggtcctgccgcggcggcggcgggggtgagggcgtaccacgagcgggtggtggaccactacaacaacccgcggaacgtaggttccttcgacaaggacgaccccaacgtcggcactgggttggtcggcgcgccagcctgcggcgacgtcatgaagctgcanatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatygcgaagcacttgtcccttcamcagtaaagctccattgcagcatgcttgccgaggatgcgattaaagctgctgtaaaagactacgaagccaagaatccgaagatggggcagaagggtgaagacanccttcaagagaaggctgctgaacatgaaagttctgcccgtgaattatattgtgctgatactttcctcatccnagactatcccgccgcatattgcccaaagataaagatcctgttttgtgangcgagattgtgtgttatgttcaacaagtgtgggaa

SEQ ID NO: 606 - DNA, 1202 bp, Brachypodium distachyon
gatgtgggagtcggtggcgctcacgctggccggcgccgccgggaacagcataggcaaggtcctccagaagaagggcacccaaatcctccctcctctctccttcaagctcaaggtgatacgcggttacgcgctcaacaggctctggatcagcgggttcctcttggacatgtgcggcgccgccctcatgctcaccgcgctgtcgcaggcaccggtctctgtcgtgcaaccaattgcaggctgtggcctcgcaatactctgtgtcttctcccacttttacctcaaggaggtcatgaatggcctcgattggattgccatcacgttggccggtcttggcaccataggagttggcgttggaggggaggagcagaaagtggaagagatcccccttttcaatataccttggctggtgctatctgttgtcatcttgtttgttctgctcaacacttggcttcatatctacaaaaggcaaaggcgtgaacaagagttgactggacctgaagtgatcgaggaggtcatatacggcttagaatcaggcattttgtttgggatttcatcagtgatctctaagatgggatttgtgatgtctgaaatgggctttccgaagattgttgtgccagctgccatttcttgtagtgtggcatgcagtgccgtgggatttgtttatcagactcgaggtcttaagcatgggagggcaattgttgtgtccacatgtacatcagtagcatctattgtgtctggtgttgtagctggtatggttgcactcgatgaacatctacccacagctcctacaagccgtttttttctcttactcggatggttcttcattattacgggagtgatacttcttgttacttcaacccgattgattgcgcgcctacctaagcccgtgcagaagtttttgaagagcaatatggaacgttcacacagcatcaggaggcctggctcagcccgtgggaaggatcccatccaaagcacaacaatccatgcgtcgtcattacatatactaacctctccaggaaaagagaaggcctagaacaactgctgctagaacatgactgtctcacctcattatttaaatctttatgtgaatgtacaagtctagagtagcatcttaaaaatttgggttgattgttcaatatacagactgcccttaataggtctaacagaagttaataaatttcctatgaattttgatcaacgta

SEQ ID NO: 607 - DNA, 1521 bp, Leymus cinereus x Leymus triticoides
  misc_feature (8)..(10): n is a, c, g, or t
aggacgcnnnccggccacctcctcccctccctctcccctcgtggtctcctcctccgccaacacccaaaaagctctagggaaacccccccacgcgcgcgcctggtgccggatcggatcggggatgtgggagtcggtggcgctcacgctggccggcgccgccgacaacagcatcggcaaggtcctccagaagaagggcaccctcatcctccctcccctctccttcaagctcaaggtcatacggggctacgcgctcaacaggctctggatcagcggcttcctcctggacatgtgcggcgccgccctcatgctcacggcgctctcgcaggcgccggtctctgtcgtgcagccgattgccggctgcggcctcgccatactctgcgtcttctcccmyttttacctcaaggaggtcatgaatggcctygattggatcsccatcacaatggcyggtctyggcacgataggagtcggtgtyggaggggargagcaraaagtggaagagattccccttttcagtataccytggctggtgctcaccgttgtcatcttgtttgttctgctcaacacttggcttcatatctacaaaaagcaaaggcgcgaacaagagttgactggacctgaagtgatcgaggaggtcatatacggcttagaatcaggcattttgtttgggatttcatcagtgatctctaagatgggatttgtgatgtctgaaatgggctttccgaagattgttgtgccagctgccatttcttgtagtgtggcctgcagtgctgtgggatttgtttaccagactcgaggtctcaagcatgggagggcaattgttgtgtccacatgtacatcggtggcatctattgtgtctggtgttgtggctggtatggttgcacttgacgaacatctgccgacagctcctgcaggacgtttttttctcttgcttggatggttcttcattattacaggggtgatacttcttgtcacttcaacccgattgattgcacgcctacctaagcctgtgcggaaatttctgaagagtaatatggagcgttcgcacagcatcaggaggcctggatcagcccgagggaaggatcccaaccaaagcacaacaatccatgcatcgtcattacaaatactaacctctacaggaaaagagaaggcatagaacagctgctggtggagcaagattgtcytaacacctttgatgggtcctgtcrytgtttaaawyattatgtgratgtacaagtctagagtagcatctyaaaagtttgggctggttgctcatatactsrctgcccttataggtctaacagaagttmgkaaaatctcctgtgaattttggtcaagttacataycttcctgtggtcagttgtaagtggtataktcrtttgttctyttcccttccgaatcttgtgtttgcgtgtttgtgctttgcttgcagcactattatcttttgctttgagagtgcgtgggaaggggcatgtatgtcatgtttggatgttttgggctacttgatacaaaattcttgtgata

SEQ ID NO: 608 - DNA, 1463 bp, Pseudoroegneria spicata
  misc_feature (4)..(4): n is a, c, g, or t
  misc_feature (6)..(9): n is a, c, g, or t
cgcncnnnnacgcgacccaggcaccaacgagacaccaccggcggcacccacgctcgggcacgggggcgcacgacgagaaaaggacgccacctcctcggctcatccccctcgtggtctcctcctccgcccacacccacaccaaaaagctctagggaaacccccacgcgcgcgcctggtgccggatcggatcggggatgtgggagtcggtggcgctcacgctggccggcgccgccggcaacagcatcggcaaggtcctccagaagaagggcaccctcatcctccctcccctctccttcaagctcaaggtcatacggggctacgcgctcaacaggctctggatcagcggcttcctcctggacatgtgcggcgccgccctcatgctcaccgcgctctcgcaggcgccggtctctgtcgtgcagccaattgccggctgcggcctcgccatactctgcgtcttctcccatttttacctcaaggaggtcatgaatggccttgattggatcgccatcacaatggccggtatcggcacgataggagtcggtgtcggaggggaggagcagaaagtggaagagattcccctgttcagtataccttggctggtgctcaccgttgtcatcttgtttgttctgctcaacacttggcttcatatctacaaaaagcaaaggcgcgaacaagagttgactggacctgaagtgattgaggaggtcatatacggcttagaatcaggcattttgtttgggatttcatcagtgatctctaagatgggattcgtgatgtctgaaatgggctttccgaagattgttgtgccagctgccatttcttgtagtgtggcctgcagtgctgtgggatttatttaccagactcgaggtctcaagcatgggagggcaattgttgtgtccacgtgtacatcggtagcatctattgtgtctggtgttgtggctggtatggttgcacttgacgaacatctgccgacagctcctgcaggacgtttttttctcttgcttggatggttcttcattattacgggggtgatacttcttgtcacttcaacccgattgattgcgcgcctacctaagcctgtgcagaagtttttgaagagtaatatggagcgttcgcacagcatcaggaggcctggatcagcccgagggaaggatcccaaccaaagcacaacaatccatgcatcgacattacatatactaacctctacaggaaaagaaaaggcctagaacagctgctgatgaagcaagattgtcttaacacctttgatgggtcctgtagttgtttaaatcattatgtggatgtacaagtctagagtagcatcttaaaagtttgggctggttgctcatatactgactgcccttatataggtctaacagaagttcggaaaatctcctgtgaattttgatcaagttacataccttcctgtggtcrgttgtaagtggtatattcgtttgttctctyaa

SEQ ID NO: 609 - DNA, 1843 bp, Oryza sativa
gcacacgcgacccaccagcaagaaggcaccaaaacgaccacgagcacgcgccaccaacaccggccgcggcggctgcaggacataggaggatatcgcgagatatcacgggcgcgcggccgaaaaagcgcaggctaccacgcgagaagcgaacgcgacccggccaccaccacacctctcctccagctcgcggtctcctcctcctcggctcctcccaaaaaagagctctagaataaaagagaaggggaaaccccccccccaaatcccacgccgctcggctcaccgagtgctgcatcggatcggatcgggacggcggtggcggacgcgagatgtgggagtcggtggcgctcacgctggccggcgccgccggaaacaacgtcggcaaggtcctccagaagaagggcacccacatcctccctcccctctccttcaagctcaaggtgattagggcgtacgcgttgaacaggctctggatcagcggattcctcatggacatgtgcggcgccgcgctcatgctcaccgcgctctcgcaggcgccggtctccgtcgtgcagccgatcgccggctgtggcctcgccatactctgcgtgttctcccatttctacctcaaggagtccatgaacgggctcgactgggtcgccatcacattggccggtctaggcacgataggagttggtgttggaggcgaggagcagaaagtggacaaaattccactgttcaatataccttggctggtgctctccattgtcatcttgtttgtaggttcttctcaacacttggcttcatatctacaaaaggcaaaggcgtgaacaagagttgactggacctgaagtgatcgaggagatcatatatggattggaatctggcattctgtttgggatttcatcagtgatatctaagacaggattcgtgatgtctgaaatgggttttccaaagattgttgtaccggctgccatttcttgtagtgtgggctgcagtgctgtgggatttgtttatcagactcgaggtctgaagcatggaagggcaattgttgtgtccacttgtacatcagttgcatctattgtgtctggcgttgtagctggtatgattgcgcttgatgaacatcttcccacagctcccacgggccgcttttttctcttacttggatggttcttcattattacaggagtgatacttcttgttagttcaacccggataattgctcggctacccagatctatgcagaagtttttgaagagtaatgtggagcgtacccacagcatcaggaggcctagctcagcgcgaggaaaggaccccatcccaagcacaacaatccatgcatccacattgcatctgctaacatctccatcgaaagagaaggcctagaaaaagttcctgctggagcaagattgttttggcacctcaaatgtgccatgttgtttaattgactcctgatgtgaatgtaaagtctagagtagcatctttaaagtttgggttggtgatatcgtatactgcttgtctgctcttattgatctatacagcctctttggaaaacttaaccttgcattttgaccaggtttcatcttttcattcggttagttggcaactgctaaatcggtttgttctgttgcatgaaagttttttttttcttttgtttgaggtactgactactgttatgccttttctcgagcttgtgtaagtaaaggcatttaacagctctttgttatgtttttacaccagaatgacatctacaataagcagtgttatgtttttacaccgtgataataaggcaatggttttgcaacagctattgcctgctgactgctgggtgctttactataaaagtactactccgtactagttggac

SEQ ID NO: 610 - DNA, 1653 bp, Sorghum bicolor
ggcagcagcagagagacagggaggagaggacaccgccccaaagctccgagccgcggcacctgcaagcacgggcgcgcggccgagaaaagcgcagccctgccgcgactctgccacctctccctcgtggtctcctcctccacttgctcctgctcctccagacctccacccctccaaaagggagccggcccccaatccctcttagcccggcgcacggcgcaggaaggggttcgatcggatcggcgccgtcggaggcgagatgtgggagtcggtggcgctgacgctggcgggcaccgccggcaacaacatcggcaaggtcctgcagaagaagggcaccctcatcctccctcccctctccctcaagctcaaggtggtcaaggcgtacgcgtctaaccagctctggatcagcggtttccttatggacatgtgcggcgccgcgctcatgctcaccgcgctctcccaggcgccggtctccgttgttcagcccattgctggttgcggtctcgcaatactctgcgttttctcccatttttacctcaaggaggttatgaacggcctcgattggattgccatcacgctagctggtctcggcaccataggtgtgggtgttggaggcgaggaacagaaagttgatcagatacctcttttaaatataccctggctagtgctctccattgtcatcttgtttgtactgctcaacacatggcttcatatgtataaaaagcaaaggcgcgagcaagagttgactggacctgaagtgatcgaggagatcatatatggcttagaatctggcattttgtttgggatttcttcagtgatctctaagatgggatttgtgatgtccgagatgggttttccgaagattgttgtgcctgctgccatttcttgtagtgtttgctgcagtgcagtgggatttgtgtatcagactcgaggcctcaagcatgggagggcaattgttgtatctacgtgtacatcagtggcatctatagtgtctggtgttgtagctggcatgattgcacttgatgaacatctgcctaaagctcccacagctcgatttctcctcttactgggatggttcttcatcatctctggagtaatactgcttgttagttcaacccgattgattgcacgtctgcctaggcctgttcagaagtttttgaagagcaacatagagcgaacccacagcataaggaggcctggttcagcacgagggaaggatgccatcccaacaacaacaatccatacgtcgtcactacacttgcttacttctccaacaaaggagaaggcctagaaaaatgttgccactagagcaactttgtttcggcacctcacgtttgtcatgtcattatttgattgaatggttccgtgaacgtagtctagagtagcatcttaaaagtttgggctggttattcaccatactgccctttataggtctaacagaaacttggaaaaatattgctgagtttttatcaggtctcgtcttttgtttggttgctgagtgcaaaatctggagctggtatcgcgcagtgcaacctcaatgatcacaggctgggaaatgttacccaatgtcattgattggtggcatgatttctttgtcaaatcagttccatgacatttggcaatttttgccgaaaaaagaaaatgcagcagtaagcc

SEQ ID NO: 611 - DNA, 1502 bp, Triticum aestivum
cgagagagcacgcaccaccggcggcacccacgctcgggcacgggggcgcacgacacgacgagaaaaggacgccacccggccacctcctcggctcctccccctcgtggtctcctcctccgcccacacccaaaaagctctagggaaacctcctggtgccggatcggatcggggatgtgggagtcggtggcgctcacgctggccggcgccgccggcaacagcatcggcaaggtsctccagaagaagggcacccwcatcctcccgcccctctccttcaagctcaaggtcatacggggctacgcgctcaacaggctctggatcagcggcttcctcctcgacatgtgcggcgccgccctcatgctcaccgcgctctcgcaggcgccggtctctgtcgtgcagccgattgccggctgcggcctcgccatactctgcgtcttctcccatttttacctcaaggaggtcatgaatggccttgattggattgccatcacaatggccggtctcggcaccataggagtcggtgtmggaggggaggagcagaaagtggaagagatyccccttttcagtataccttggctggtgctcaccgttstcatcttgtttgttctgctcaacacttggcttcatatctacaaaaagcaraggcgcgaacaagagttgactggacctgaagtgatcgaggaggtcatatacggcttagaatcaggcattttgtttgggatttcatcagtgatctctaagatgggattcgtgatgtctgaaatgggctttccgaagattgttgtgccagctgccatttcttgtagtgtggcctgcagtgccgtgggatttgtttaccagactcgaggtctcaagcatgggagggcaattgttgtgtccacatgtacatcagtggcatctattgtgtctggtgttgtggctggtatggttgcacttgacgaacatctgccgacagctcccgcaggacgtttttttctcttgcttggatggttcttcattattacgggggtgatactacttgttacttcaacccgagtgattgcgcgcctacctaagcctgtgcagaagtttttgaagagtaatatggagcgttcacacagcatcaggaggcctggatcagcccgagggaaggattccaaccaaagcacaacaatccatgcctcgacattacatatactaacctctacagggaaagagaaggcctagaggtgctactggagcatgactgtcttaacacctttgatgggtccaatcactaatgtgaatgtacaagtctagagtagcatctcaaaagtttgggctggctgctcatatactgactgcccttatagatctaacagcaacagaagttcgtaaaatctgctgtgaattttgatcaagttacataccttcctgtggtcagttgtaagtggtatattagtttgttctcttcccttccgaatcttgtgtgcgtgtttctgctttacttgcagcaccattatattttgcttttaagaaaaaaaaaa

SEQ ID NO: 612 - DNA, 1928 bp, Zea mays
acgcttgctcttctcactccctcctcagctagcctgcttgcttcgagcctagctgtctccgtccgtctagctccagctctccctcgaggcccggaacgcgaggacgacgaagagcagagccccagccagccacaatgccgtcgtcggggatcaccgcggtggacgcggccgccaaggggatgaagctggagcggtacgccagcgggggcgcgctgctgctgcgccgggcgaccagcgccaagctcgtgtccgcgtcgtcgcacctgctcttccgcgccaccgtgctggccacgctcgcgctcgtcttcctcttcacgctgcactacccgtccctcctctcgcgctccttccacctctccgccggcggcggcggcggcgccgacgacggcgcgcgctcctccgcctcgcaccgcagcctgctcatgtcctcggcgtcgtacgggggcgccgcgtgggagaaggaggtgcggcggagcgccaggccgagccgggacgggggcatctccgtgctggtcaccggcgccgcgggcttcgtgggcacgcactgctcgctcgcgctgagggcccgcggcgacggcgtcctgggcctcgacaacttcaactcctactacgacccgtcgctgaagcgcgcgcgccaggcgctgctggccagccgcggcgtcctggtgctcgacgccgacatcaacgacgccccgctgctggagaggctcttcgacgtggcggcgttcacgcacgtgctgcacctggccgcgcaggccggggtgcggtacgccatggaggcgccgcagacgtacgtggcgtccaacgtggccgggctcgtcagcgtcttggaggtggcggccaagcacgccgacccgcagccggcggtcgtctgggcctcgtcctcgtccgtgtacgggctcaacaccgacgcgcccttctccgaggaccaccgcaccgaccgcccggcgtcgctgtacgcggccaccaagaaggccggcgaggccatcgcgcacgcctacaaccacatctacgggctctccatcaccggcctccgcttcttcaccgtgtacgggccgtggggccgccccgacatggcctacttcttcttcgcccgcagcatcgtggccggcgagcccgtcacgctgttccgcgccgccgacggctccgacgcgcgccgcgacttcacctacatcgacgacgtcgtcaagggctgcctcggcgcgctcgacaccgccggcaagagcaccggctccaggtccggcagaaaaagcgggccagcgccgctccgcgtctacaacctcggcaacacctcccccgtgcccgtcacccggatggtggccatcctcgagaagctgctgggcaggaaggccaacaagcgcgtcgtcaccatgcccagcaacggcgacgtgcctttcacccacgccaacgtcagccacgccgcgcacgacttcggctaccgccctaccacctccctcgaggccggcctccgccacttcgtcgactggttcgtcagctactataagctcgacgccaagatcgccaagcccgccgccgccgacgacgacaagcccgcgaagaagaagaagaagaacaaagccatgtcggcgtcgtcgtgatcgtacgttcatcgatcaagcacacacgggcacacagaaacagagcaccgccaccgccaagcacagtcaccaagtgtgtattctctagctagttctcggaggcctttttcttttctttttgtctgtaaccatgtattgttcaagccctcgctacatacttgctcctcctccttatgctgatagtgcttagtaggaaggaataatgatgcaaataactgttgcattcatattggtacgtagatatataaaaaaaagatcaaacagaggaggagtgaggacagattgaagaaagatcaagtcactggctccccccctctagctccctaccct

SEQ ID NO: 613 - DNA, 1405 bp, Sorghum bicolor
caaggggatgaagctggagcggtacgccagcgggggcgcgctgctgctgcgccgggcgaccagcgccaagctcgtgtccgcgtcgtcgcacctgctcttccgcgccaccgtgctcgccacgctcgcgctcgtcttcctcttcacgctgcactacccgtccctcctctcgcggtccttccacctctccgccggcgccggcgacgactcagcaggcggcggagcgcactccacctccgcctcgcaccgcagcctgctcatgtcgtcctcggcgtcggcgtcgtacggcggcgccgcgtgggagaaggaggtacggcggagcgccaggccgagccgggacgggggcatctccgtgctggtcacgggcgccgcgggcttcgtgggcacgcactgctcgctcgcgctcaaggcccgcggcgacggcgtgctcggcctcgacaacttcaactcctactacgacccgtcgctgaagcgcgcccgccaggcgctcctggccagccgtggcgtcgtcgtgctcgacgccgacatcaacgacggcctgctgctggagaagctcttcgacgtcgcggcgttcacgcacgtgctgcacctggccgcgcaagccggggtgcggtacgcgatggaggcgccgcagacgtacgtggcgtccaacgtggccgggctcgtcagcgtcttcgaggtggcggccaagcacgccgacccgcagccggccatcgtctgggcctcctcctcctcggtgtacgggctcaacaccgacgcgcccttctccgaggaccaccgcaccgaccgcccggcgtcgctgtacgcggccaccaagaaggccggcgaggccatcgcgcacacctacaaccacatctacgggctctccatcaccggcctccgcttcttcaccgtctacggtccctggggccgccccgacatggcctacttcttctttgcccgcagcatcgtcgccggcgagcccatcacgctgttccgcgccgccgacggctccgacgcgcgccgcgacttcacctacattgacgacgtcgtcaagggctgcctcggcgcgctcgacaccgccggcaagagcaccggctccaggtccggcaagaagagcgggcccgcgccgctccgcgtctacaacctcggcaacacatcccccgtgcccgtcacccggatggtcgccatcctcgagaagctgctcggcaagaaggccaacaagcgcatcgtcaccatgcccagcaacggcgacgtgcccttcacccacgccaacgtcagccacgccgcccacgacttcggctaccgccccacaacctccctcgaggccggcctccggcacttcgtcgactggttcgtcaactactacaagctcgacaccaagatcgccaagggcgcccgcagcagcgccgccgccgacaagccggcg

SEQ ID NO: 614 - DNA, 1957 bp, Oryza sativa
ggcggctaaaagtatccaagcatctgtctgcaactctgcatcatagcggccggggtgccactctgcagtctctcactgtgctggacatggagtccggcgggatactcccaccatccgagacatgcgccggctccggttcaccggacggccgcggcggctggcgcgccgcgcgcttcctcatcgccgtcgggttcctggagcgcatcgggttcaacggcgtgcagggcaacctggtgatgtacctgagcgggccgatgggcatgtcgacggcggcggcggccgccggcgccaacgcctggggcgggacggtgctggtgctgacgctcgtcggcgcgctcgccgccgactcgcggctcgggcggtaccgggcaatcgtggccgccggcgtgctccatctgctgagcttgggcatgctgacgatctcatcagtgatgcaaccaacgcaccaacacccggtgagctgccatgacgccgccgccgcctgctcgccgccgccaccgccatcgccatctctcggccgcctcgtcttcttccacgccgcgctctacctgcttgcgctggcgcagggcttccacaacccgtgctcggaagccttcggcgccgaccagttcacgccgccgagcgaccctggcgcgcgcgcgtcccggagctcctacttcaactggtacaacttctccagttcctgcggctacgccatctccaacaccgccatgagctacgtcgaggacaacgtcagctggaccgtcgggttcgccgcgtgcttggccaccacggcggtgtacctccccgtcttcttgctcggcacggcggcgtaccgcgccgagcaacccatcgacggcgcgctgctcgcgctgctcgccaagaagtccttgtcagccacgcgcgtgtggacggcgagggtgtttccccggaaggacgccatttgcacggaacggcttctgctggcgaaagaagaagaggtagaacatggcaagggtttcgtcgtcaagctgcttccgatctgggtgaccagcatagtgttcgccgccgtcatctcgcagcaggtaacgctgttcaccaagcagggcagcacgatggaccgccgcgtcgccgtgggcgggggcgtcttcgtcctgccgcccgccgcgctgcaggacgtcatcagcgccaccatgctcaccgtgctgccggcctacgaccgcgccctcgtgccgctcgcgaggcgcttcacgggccaccccgcgggcatcaccacgctccagcgcgtcggcgccggcatggccacgtgctgcctccacatggtcgtggcggcgctcgtcgaggccaaacggctccgcgccgcgagcgacgccgggctgccggcggacgccaccgtgccgatgagcgtgtggtggctggtgccgcagtacgccctcgtcgggctatcgaaggtgttcggcgtcatcgggctccaggagttcttctacgaccaggtgcccgacgacctccgcagcgtcgggctcgccatgtcgctgagcgcgcagggcgtcgggagctacgccagcagcgcgctcgtgtcggcgatcgactgggcgacgacgaggagaggaggagagagctggttctccgacgacatcaaccgcgcgcacctcgactacttctactggctcctcgccgcactcgccgcattggatgtcgccgttttcgtgtacattgcaaagcgatatgtctacaggaacaaagacgagcaatgattcttctgtttttttttatatatatatctgaaaaatggttcgcatggggaagatcagaagatgtatgctagtgtagtttgaacatacattgcattttcgcagcatttgcatgtataattatagtcctattgaaaatgcatgtggttgtataatttgacatgctaggacaatccaatgctattttttttttcctgttcgcatgtttcgaaaatcttgtgttccaaatgtgcattaaaaggagcaaa

SEQ ID NO: 615 - DNA, 3485 bp, Brachypodium distachyon
agaagaggaagaaaaagtatggacaccaacacccaaggcctcctcctgccccggtccgatggcgccgtccccggcgtcgtggacttccgcggcggccccgcgcctcgcgcctccaccggccgctggtccgccgcaatgtttgtcctcggtgtggagatcgcggagaggttcgcgtaccacggggtgtcggcgaacctgatcagctacctgacgggcccgctgggggagtccacggcgggggccgccgcggcgatcaacgcctggagcggcgtcgccacgatgctgccgctgctcgtggcgtgcgtcgccgacgcatggctcgggaggtaccgcaccatcgtgctcgcctccctcctcttcgtcgtgagcatgggcatgttaaccctctcctcggcgctgccggcgttccactccgacggctgcagcagcttcacctccaagtcgctcgcttgctccccttccccggtgcaagtcaccatcttctacatctccctgtacctggtggcgctggcggaggccgggcacaagccctgcgcgcaggcgttcggcgcggaccagttcgaccagcaccaccccaaggagtccgtctccaggagctccttcttcaactggtggtacttcggcatgtgctccggcaccgccgccaccaccatggtgtccagctacatccaggacaacatcggctggggcctcggcttcggcatcccctgcctcgtcatggtcttcgctctcgccatgttcttgctcggcacgcggaggtaccgctactacacttccacccggtccagccccttcgctcgcctcgccagagcgctcattgcgctcatcagaggctccaaatcgagccaatctgacaagtatgttcactgttccactctcattcgttctaaatttgttgtttggccatgagatttctcaatgcagactcttgtcagacttaataagagtactaattaatttggttgtgctttgtgataacagcgctcttgccagtgaggatgatgagttcaacaccgagcaccgcgaggaagtgagaggcctgctgcggctgttccccatctgggcgacgtgcatcatctacgccgtcatcttctcccaatcttcgacgttcttcacgaagcaggcggcgacgctggaccggcggatcggccagagcttcaaggtgccgccggcggcgctgcagacgttcatcagcgtgaccatcatcaccttcatcccggtgtacgaccggctcttcgtgcccgtggcgcggcggttcacgcgcctgtcctcggggatcaccatgctgcagcggatcggcacggggctggtgctggcgatggtggccatggccgtggcggcgctcgtggagatgaagcggctcggcgtggcgagggacgccggcctcgtggacgaacccaaggcggcgctgccgatgagcctgtggtggatggtgccgcagtacgtgctgttcgggctctccgacgtgttcgccatgatcgggctgcaggagttcttctacgaccaggtccccgacgcgctccgcagcctcggcctcgccttcttcctcagcatcttcggcgtggggcacttcctcagcagcttcctcatatccgccatcgacggcgccaccaagaagagcggggccagctggttctccaacaacctcaaccgcgcgcacctcgactacttctactggctcctcgccgggctctgcgccgtggagctcctcgcgttcctcatcgtttcgcgcgtttatgtgtacaagaagagggtggcgcatcatgacgacgtcttcgattttcgtcatgggtgcgttccaatctctctttgttcacgccgacggcgggccttcttgttgttgatcgcttgtttgcatgcagcaatggagattgcggagaggttcgcgtacaagggcgtggcgtcgaacctgatccagtacctgacggggccgctggggcagccgatggcgcgcgcggcggcgtccatcgacgcgtggaagggcgtctcccagatgctgccgctgccgctcgcctgcatcgccgacgcctggctcggccgctaccgcgccatcgtcctcgcctccatcctcttcatcctggtcagtcacaagctcgatcacaattcgattcgaggagaagtatcccgatctctgatttttctttctccctggaaactatccagagcatgggcacgttgtctctgtcgtcggcggtccgcatcttcggggccggcgggcacgtcgccgtcttctacgtggcgctgtacctggtggcgctgggcgagggcgcgcacaagccgtgcgcgcaggcgttcgccgccgaccagttcgacgacaaggaccccaaggagtccgtggcgcggagctccttcttcaactggtggtacctgggcatgtgctccggcaccgccgtcaccatcatggtctccagctacgtccaggacaacgtcggctggggcctcggcttcggcatcccctgcatcgtcatcgccgtctccctcgccgtcttcctcctgggcacccgctcctaccgctactacaccaccaaggagcccagccccgtcgcccgcgtcggcaaggcgttcttcacattgatcaagagctggagatcgaaacatcgcaccaagtatgtaacaattcgatcgaactcctcagatctgtttctttaattgcccgtgcgacgtctgctgatgtgaaagttcgtacggtgtgcagcccggcgagcagtgccaaagtcgagggcggcgacagcgccgaggatctcgtcgaggaagtgaagagcgtcttccgcctgctgccaatctgggcgtcctgcataatctacgccatcatcttctcccagacgtcgacgttcttcaccaagcaggcggcgacgctggaccggcggatcgggcccagcttcaaggtgccgcccgcggcgctgcagacgttcatcagcatcagcatcgtcgtcttcatcccggtgtacgaccggctcttcgtccctttggcccggcgctacacggggaggccgtcggggatcaccatgctgcagagggtcggcgtcgggctggcgctctccctggccgccgtcgtcctctctgctctcgtcgagatgaagcggctccgcgtcgcgtctgcagccggcctcgtgaacaccccgaagacgcagctcccgatgacgctgtggtggatggtcccgcagtacatcctcatcggcgtgtccgacgtgttcgccatgatcgggctgcaggagttcttctacgaccaggtgcccgacgccgtgcgcagcctcgggctcgcgctgttcctcagcatcttcggcgtcggacacctcctcagcagcttcctcatatcggtcatcgacggcgccaccaagaagaacggggccagctggttctccaacaacctcaacaaggcgcacctcgactacttctactggctcctcgccgggctctgcgccgtggagctcgttgccttcttgttcttctcgcgactttatgtctacaagaaaaaggccggcgat

SEQ ID NO: 616 - DNA, 1909 bp, Zea mays
acctgacaacacacacacacacacacgtagctgtggcgcaggggggcgcggcaatggacgcaaacactctcctcctgccctgctccgacggcgccgtcgccggcgcggtggacttccgcgggcgccccgcgtcccggtccggcaccggccgatggtccgccgcgatgttcgtcctcggggtggagatagcggagaggttcgcgtaccacggggtgtcggcgaacctgatcagctacctgacggggccgctcggggaatccaccgcgggcgcggcggctgcgatcaacgcgtggagcggggtggcgaccatgctgccgctgctgatggcgtgtgtggccgacgcctggctcgggcggtaccgcaccatcgtcctcgcctccctcctcttcgtcgtgagcatgggcatgctgaccgtctccgcgctcccggcgttccaccacgacggctgcagcagctacgcctccgcctccagaccgctggcctgctccccgccccccgtgcaagtgggcgtcttctacgtctccctgtacctggtggcgctcgcggaggccgggcacaagccctgcgcgcaggcgttcggcgcggaccagttcgaccagaacgacccaaaggagtccgcgtccaggagctccttcttcaactggtggtacttcggcatgtgctccggcaccgccgtcaccaccatggtgtccagctacatccaggacaacgtcggctggggcctcggcttcggcgtcccctgcctcgtcatgctcttcgcgctcctcatgttcttgctcggtaccaggaattaccgctactacacgtatactgaatcgagcccatttgctcgcctcgccacagctttcgttgcgctcatcaaaggctccaaatcgagacaacatgacggcactcttgcgagcgacgacgccgggcaccgtgaagaagtgaaaggcgtgctgcgcctgttccccatctgggcgacgtgcatcatctacgccgtcatcttctcgcagtcgtccacgttcttcacgaagcaggccgcgacgctggaccggcgggtcggctcgactctgcgcgtgccaccggcggcgctgcagacgttcatcagcgtgaccatcatggccttcatcccggtctacgaccgcgcgttcgtgccccttgcgcggcggcttacgcgcctctcgtccggtatcaccatgctgcagcggatcggcacggggctcgtcctggccctggttgccatggtcgtggcggcgctggtggagatgcggcggctcgccgtggcgagggacgccgggctcgtggaccagcccaaggcggcgctgccgatgagcctgtggtggatggtcccgcagtacgtgctgttcgggctctcggacgtgttcgccatgatcggcctgcaggagttcttctacgaccaggtccccgacgcgctgcgcagcctcgggctggccttctttctcagcatcttcggcgtaggacacttgttcagcagcttcatcatctccgccatcgacggtgccaccaagaagagcggagcgagctggttctccaacaacctcaatcgcgcgcacctcgactacttctactggctgctcgccgggctctgcgccgtggagttggctgctttcatcatcgtctcgcgcgtttacgtgtacaagaagaggatgtctcacgacaataatgctgctgccatgtagatcagtagacgtgacttttaccgtgctgtgaatggcgatacaatatgattgaggtgtagagaaagagaacgaaaaaaccttttgtacgctaaacctggacactaaactgacttttacggacggtcggcaatcggcataatagtgccggtttgttagcaaccggcagtgctagcgtttattgggaaaaaaaattctatgcaggagccctatacaaatacttcatccac

SEQ ID NO: 617 - DNA, 1865 bp, Oryza sativa
atgcagggcacgcgccgaccacgcactcgcggcatgcccgcgcgcgccgccgcgccgccgccacgcgccctggatctgatccaccagagacgcaacgcgacccaccacgacgcgacgatggccagccacgccgtcaccgatgcgctcctcctgccgcgctccgagggcgccgtcgccggggccgtcgacttccgcggccgcccggcctcccgcgcctccaccggccgctggtccgccgcaatgttcgtcctcggggtggagatcgcggagaggttcgcgtaccacggcgtgtcggcgaacctgatcagctacctgacgggaccgctgggggagtcgacggcgggggcggcggcggcgatcaacctgtggagcggcgtcgcgacgatgctgccgctgctggtcgcctgcgtcgccgacgcctggctcggccgctaccgcaccatcgtgctcgcctccctcctcttcgtcgtgagcatggggatgttaaccctctcgtcggcgctcccggcgttccacggcgacggcggcggctgcagctacacctccaagtcgctgtcctgcgctccctccaccgcgcaggtggccatcttctacgtgtcgctgtacctggtggcgctcgccgaggccgggcacaagccgtgcgcgcaggcgttcggcgccgaccagttcgaccagaacgacgccaaggagtccgtctccaggagctccttcttcaactggtggtacttcggcatgtgctccggcaccgccatgaccaccatggtgtcctcctacatccaggacaacatcggctggggcctcggcttcggcatcccctgcctcgtcatggcgttcgccctcgccatgttcttgctcgggacaaggaactaccgctactacgtctccacccagtccagccccttcgctcgcctcgccagagcgttcgtcgcgctcatcagaggatccaaagacgacgctcttgccgtcgtggacgatgacgacggcggcgaccaccgagaggagctgagaggcgtgctgcggctgttcccgatatgggcgacgtgcatcatctacgcggtgatcttctcccagtcgtcgacgttcttcacgaagcaggcggcgacgctggaccggcggatcggcgagagcttcagggtgccgccggcggcgctgcagacgttcatcagcgtcaccatcatcgccttcatcccggtgtacgaccgggcgttcgtgcccgtggcgcggcggttcacgcgcgcgtcctcggggatcaccatgctgcagcggatcggcacgggcctcgtgctggcgctcgccgccatggtcgtcgcggcgctggtggaggcgaggcggctcggcgtcgccagggacgccggcatggtggacgaccccaaggcggcgctgccgatgagcctgtggtggatggtgccgcagtacgtgctgttcgggctctccgacgtgttcgccatgatcggcctccaggagttcttctacgaccaggtccccgacgcgctgcgcagcctggggctcgccttcttcctcagcatattcggggtgggtcacttcttcagcagcttcatcatctccgccattgacggcgccaccaagaagagcggggcgagctggttcgccaacaacctcaaccgcgcccacctcgactacttctactggctcctcgccggcctctgcgccgtcgagctcgtcgcgttcgtgttcgtgtcgcgcgtttacgtgtataagaagagggttcctcacaacggttgtgatgtcatgtagaagtagaggttagctagctaattcttgtgcatgttcttgtgaaatctgaaaatgtttgtacaggtgattaaatcctagaaagtgaataaaaccttgatacttaagctctg

SEQ ID NO: 618 - DNA, 1832 bp, Panicum virgatum
gagtccaccacacaaacgcagctgcagcgcgcggcggtggcaaatggacgccagcaccctcctcctgccctgctccgacggcgtcgtcgccggcgcggtcgacttccgggggcgcccggcgtcccgggccggcaccggccggtggcccgccgcgatgttcgtgctcggggtggagatagcggagaggttcgcgtaccacggcatatcggcgaacctgatcagctacctcacggggccgctcggggagtcgacggcgggcgccgcggcggcgatcaacgcgtggagcggcgtggcgacgatgctgcctctgctgatggcgtgcgtggccgacgcctggctcgggaggttccgcaccatcgtgctcgcctccctcctcttcgtcgtgagcatgggcatgctgaccgtctccacgctcccggtgttcaaccacgacggctgcagcagctatcactccaaatcgctcgcgtgctccccatcccccgtgcaggtgaccgtcttctacgtctccctgtacctggtggcgctcgccgaggccgggcacaagccctgcgcgcaggcgttcgccgccgaccagttcgaccagcacgaccccaaggagtccgagtcgaggagctccttcttcaactggtggtactttggcatgtgctccggcaccgccgccaccaccttggtgtccagctacatccaggacaacgtcggctggggcctcggcttcggcatcccctgcctcgtcatggtcttcgcgctcctcgccttattgctcgggaccaggagctatcgctactacacgtccaccgagtcgagcccctttgctcgcctcgccagagcgttcgtggcgctcatcaggggaaccaaatccagccaatgcgaaagtctcctgaccgacgacgacgagcaccgggaagaagtgaagggcgtgctgcgcctgttccccatctgggcgacgtgcatcatctacaccgtcatcttctcgcagtcgtcgacgttcttcacgaagcaggccgcgacgctggaccgccggatcgggtcgacgctccgcgtgccggcggcggcgctgcagacgttcatcagcctcaccatcatggcgttcatcccgatctacgaccgcgcgttcgtgcccgcggcgcggcggttcacgcgcctctcgtcccggcatcaccatgctgcagcggatcggcacagggcttgtcctggccatggtcgccatggtcgtggcggcgctggtggagatgaggcggctcggcgtggcgagggacgccggcctcgtggaccagcccaaggcggcgctgccgatgacgctgtggtggatgctgccacagtacgtgttgttcgggctgtcggacgtgttcgccatgatcgggctccaggagttcttctacgaccaggtccccgacgcgctgcgcagcctcgggctggccttcttcctcagcatcttcggcgtgggccacttcctgagcagcgtcctcatctccgccatcgacggcgccaccaagaagagcggcgcgagctggttctccaacaacctcaaccgcgcgcacctcgactacttctactggctgctcgccgggctctgcgccgtggagctggccgcgttcgtcgtcgtttcccgcgtatatgtgtataagaagagggcgtctcacgacaatggtgccgtcatgtagatgcgcagaaacatgcttactgctgtgaattgtgacatagtaatataggatcgaggctaaagctgaaccgagcttttgattatgtttgacacttttgattaatccctgtaccgagctcagcagcttcatttcgtcaaaaaaaggttcagcagctgaagcagacttgtgatc

SEQ ID NO: 619 - DNA, 2129 bp, Brassica napus
atcaactccattgaataattgaacttttgagtagactccgatgggttttctggtggatacacaaaaggaaggaggcggacattcatggggctgcgtcaggagtttggtccgaaggaaacaggtcgactctgctgctaatggacattctcatcatcaacagctcgctaaagcccttactgtttctcacctggttgctattggtgtgggagcaacaataggagcaggagtgtatattcttgtgggaacagttgcaagagagcactcaggaccatctcttgctttgtcatttcttattgctggaatcgcagctgcactttctgccttttgctatgctgaactctctagtcgttgtccctccgctggcagcgcctatcactattcctacatttgtgtcggcgaaggtgttgcgtggttgatcggttgggcactgattctggaatacactattggtggctctgctgttgcccgtggcatttcccctaatctggcattgatttttggtggtgaagatggtttgccttcattcttagcccgtcagcagatcccaggccttgacgttattgtggatccatgtgctgctattcttgttttcattgtaactggctttttgtgcctgggaatcaaggagagcacattcgctcaggggattgtgactgcagtcaatgtgtgtgtcttgttatttgtcatagtagctggcagttatctgggattcaagactggttgggctggttatgaactccccacagggttatttccattcggagtggatggaatgttcgctggttctgccacagtattctttgcattcattgggtttgattcacttgcaagtactgctgaggaggtgaaaaacccacaacgggatttaccaattgggattggtcttgcactctttctgtgttgttctctctacatgatggtctccattgtaattgtcggcttagttccttactatgccatggatcctgacactcccatatcctctgcgtttgctagtcatgacatgcaatgggctgtatacttgataactttaggagctgtcatggctctctgctcagctctaatgggttcccttctccctcagccgcgaattctgatggcaatggctagggatggtctgctgccttctgttttctcagacgttaatagacgcactcaggttcctgttaaagcgactgtagcaacggggctttgtgcagcaaccttgtccttctttttggatgtttcacagcttgcaggcatggtgagtgttgggacacttctggcatttacaatggtggcaatctcagtgttgatactcagatatgttcctccggatgagctacctcttccggcatcccttcaggatagaatcgaccctgtttccgtcatacctggtgaaacaaagtcatcccatcatgttggcacttccagtaacagtaccaaacaaccgttaattggcgagaatgatgcttctgttatggagaagcaagaagctcttggattctgggttttgagcgaagaaaacagaaggaaggtcggtggatggagcattatgttcacttgcattggagccttccttctaagttattcggcgtcaagcatcaacttcccagggtttattagatatccactgtgtggtattggtggaagtctcctccttgctggtttgattgctctgagttccatagatcaggatgatgctaggcacacttttggacattctggaggtttcatatgcccgttagtgccactcctgccaatcatatgcatcctaatcaacatgtaccttttggttaaccttgggtctgcgacatgggctcgtgtgtctgtgtggctggtgattggagtgttggtgtatgttttctatggaagaaagcacagttccctggccaatgcagtttacgtaacaacagctcatgcggaggagatatatcgtgaacatgaagcttctctggcataatagtctgtgagaaaggcaactctttggtaacaaaagctgtactgttattttgatttggatgaaacaagactcgctcccacccgctttgtaaatatcatatatatatatatatatatgtctatatttcatcataaattcataatcagamacaattctcraaaatcttctgcataatctcataattcct

SEQ ID NO: 620 - DNA, 2211 bp, Raphanus sativus
ggggcagtgccttcttttctcacgccaccaataattcatttctctctttttttatcttaaaggggaaagaaagagatcattttgtatctgcatacgccgccgtgttacaatcaattcaactacattgaataactgaaacttttgaggagactccgatgggtttcctggtagatacgcaaaaggaaggaggcggatattcatggggctgcgtcaggagtttggtccgaaggaaacaggtcgactctgctaatggacattctcatcattcagctcgctaaagcccttactgtttctcacttggttgctattggtgttggagcaacgataggagcgggagtgtatattcttgtgggaacagttgcaagagagcactcaggaccatctcttgctttgtcctttcttattgctggaatcgccgctgcactctctgccttttgctatgctgaactctctagtcgttgtccctctgctggcagcgcctaccactattcttacatttgtgtcggcgaaggtgttgcgtggttgatcggttgggccctgattctggaatacaccattggtggctctgctgttgcccgtggcatttcccctaatctggcattgatttttggtggtgaagatggtttgccttcattcttagcgcgtcaccagatcccaggtcttgatgttgttgttgatccatctgctgctattcttgttttcattgtaactggccttttgtgtcttggaataaaggagagcacatttgctcagggaatgttactgcagccaatgtgtgtgtcttgttatttgtcatcgtagctggcagctatctgggcttcaaaactggttgggctggttatgatcttcccacagggttatttccattcggagtggatggaatgtttgctggttctgctacagtcttctttgcattcattggctttgattcacttgcaagtactgctgaggaggtgaaaaacccccaacgtgatttaccaattggaattggtctagcactgtttctctgttgttctctctacatgatggtctccattgtaattgttggcttagttccttactatgccatggatcctgacactcccatatcctctgcgtttgctagtcatgacatgcaatgggctgtatacttaataactttaggagctgtcatggctctctgttcagctctaatgggttcccttctccctcagccgcgaattctgatggcaatggctagggatggtctgctgccttctcttttctcagatgttaatagacgtactcaggttcctgttaaagcgactctagcaactgggttttgcgctgcaaccttgtccttctttttggatgtttcacagctcgcaggcatggtgagtgttggcacacttttggcatttacaatggtggcaatatcagtgttgatactcagatttgttcctccggatgagctacctcttccgtcatctcttcaacagagaattgattctgtttccttcatatctggtgaaacaaagtcatccgatcatgttggcacttctagtaacagttccaaacaaccgttaattggcgagaatgatgcttcggttatggagaagcaagaagctcttggattctgggttctgagcgaagaaaacagaaggaaggtcgctggatggagcattatgttcacttgtattggggccttccttctaagttattcggcgtcaagcctcaacttcccagggtttattagatatccactgtgtggtgttggtggaagtctcctccttgctggtttgattgctctgagttctatagatcaggatgatgccagacacacttttggacattctggaggttttatatgcccgttagtgccactcctgccaatcatatgcatcctcatcaacatgtaccttttggtaaaccttggatctgcgacatgggctcgtgtatctgtgtggctggtgattggagtgttggtgtatgttttctacggaagaaaacacagctctctggctaatgcagtttacgtaactacagctcatgcggaggagatatatcgtgaacatggagcttctttggcatagtttgtcaactcttttgtaacaaaagctgtactgttattttgatttggatgaaacaaagactggcgtaatcacctctcaaacactttgtaaataacattatatatatgtataattcatcataaattcataatcaggaaagaccatcttcccaaaaaaaaaa

SEQ ID NO: 621 - DNA, 1589 bp, Hordeum vulgare
  misc_feature (1547)..(1547): n is a, c, g, or t
  misc_feature (1570)..(1570): n is a, c, g, or t
actgcctgtcctgtcctgtcccgtcccttccccgaagaattccccaattcaaagagatctctctcctcacatccacctcactcgctcgctcgctcgctccctgctgccatcccgcggccgggcatgtcgtcgtcgggggccggcgaggagggsscgttgcccgtggagctccgcaagggcgccaacgggctcgacaaggtcgtgctccgccagggcccccgcatctccgccgaggtgtacctgtatggtggccatgtaacatcatggaaagatcagtttggggaggagctgcttttcgttagtaataaggctattttcaaacctccaaaagctatacgtggaggtataccaatctgctttcctcagttttccaacttcggacatctggaagctcatggatttgcaaggaacaagatctggactgttgacactgatccaccaccatttccagtaccgatctctagtagagcttacatcgatttaatccttaaacctactgacgaagacttaaagatctggccacatagttttgagtaccgtctgaggattgcacttggacctggtggagatctgatgctgacttcacgtataaggaataccaatgcagatggaaagccattctcttttacctttgcatatcacacgtacttctcaatttctgatataagtgagatacgtgtagaaggcctggaaactctggattacctagacaacttacaggatagggcccgcttcactgaacaaggcgatgctattgtttttgaatctgagttggatagaatatatctgggcacaccgtcaaaaattgccattattgatcatgagaagaaaagaacatttgttgtgaggaaaggaggccttccggatgctgttgtttggaacccctgggacaaaaaagctaaggcaatggcagattttggggatgacgaatataaacgcatggtatgtgtggaagcagctgctatagaaaagccgattactctgaagcctggcgaggagtggactggaaaattggaactatctgcagttccgtctagttattacagtggtcaattggacccagatcgtgttattcaggattcagttgttccggaggattctgtcagctagcccttagtcaacttctgtgcaggtagactattaatatcatatgcacaagggaaatggcagccacgagtgtcaaaacatttcttccattctattcaaatctttgttgttttcggcgtacctaccggaacagagcgaaaatctcaacattgatttctgtttcgggatccacatgacataaagggacaaatcagtgtttgtaccctgcatagggatgatcgaagaaacatcttagatgggttgtaaaataaatttataactgtattttcttttctttatcactttcttttattcccagatgcttaagtttcatagtgtggccaaaaggcgaagatgatgtcaaaccacctttcagataaacacacatgatgtgtaaacatgccaatattttgagctgcatggctcggtggttgtggaaccatgtttatttggatgcaatntgcctgcgctgtgcaattatgcnccgttggatggttatttga

SEQ ID NO: 622 - DNA, 1123 bp, Brachypodium distachyon
ggaagagaagaattccccaattaagatctccttcctcctcctttcgcctcgccacctccagcctcactcgctgctgctattcccgacatgtcgtcgtcggtagccggcgccggcgaggagagtggcgccgcggcgccgcagggcccggcgcccgtggagcgctgcaagggcgtgaacggcctcgagaaggtcgtcctccgcgaggtccggggcagctccgccgaggtgtacttgtacggtggccatgtcacatcatggaaagatgagcatggggaggagctgctttttgtcagtaataaggctattttcaaacctccaaaagctatacgtggaggtataccgatctgctttcctcagttttccaactttgggcatctggaaccacatggatttgcaaggaacaagacctggactgttgaagctgatccaccaccatttccagtaccaatctccagtaaagcttacatcgatttaatccttaaacctactgaagaagacgtaaagatctggccacatagttttgagtaccgtctgaggattgcacttggacctggtggagatctgatgctgacttcacgtataaggaataccaatgcagatgggaagtcattctcttttaccttcgcatatcacacgtacttttcaatttcagatataagtgagatacgagtagaaggccttgaaactctggattacctagacaacttacaagatagagcccgcttcactgaacaaggcgatgctattgtttttgaatctgaactggacagaatatatctgggcacaccgtcaaaaattgccattattgaccatgagaagaaaagaacatttgttgtgaggaaaggaggccttcccgatgctgttgtttggaacccctgggacaaaaaggctaaggctatggcagattttggggatgatgagtataaacgcatggtatgtgtggaggcagctgctatagaaaagcaggttactctgaagcctggtgaggagtggactggaaaattggaactgtctgcagtcccatctagttattacagtggtcaattggatcctgatcgtgttattcaggattcaactgtcccagaggattcaatcagctagcccttagtcaatttctgcgcag

SEQ ID NO: 623 - DNA, 1784 bp, Oryza sativa
aaaaggcttgtacaccgacaaaatgcgtcgaagaaacgccaaggttttttatcgcctttagcggttagcgcatcagaacgcaacagcaaagcaaaacccaatcaaatccttttcctccaaatctcgccaaattcttcgagcgagacacgtataaactctcactcgctcactcacacctcacacgctgctgctgctgcttctcgatgaggaatattttttttgcttcggttaaagcaacgctaattccccgcgtcgcaagcatgcgtttctaggagaaagtaaagcttgcgtttttgagactaaagcttgcgttttttgttttttaattgtggagtttgggaggaggaggggaaaaaatcgcgatcaggaaaaggcatctcgagaataattatttaagtccccagagcgagcagtgacgcgaaattccccaggagagatctccatctccacctccactgctcaggcggggatgtcgtcggcggcgtcggcgtcggcggccggaggggcaggcgaggagggcgccgccgccgccgcgcagccgcagcaggaggggccggtggtgacctgcaagggcgtgaacgggctcgacaaggtcgtcctccgggaggtccgaggcagctctgccgaggtgtacctgtatggcggccatgtcacatcatggaaagatgagcatggagaggagctgctttttgttagtaataaggctattttcaaacctccaaaagctatacgtggagggataccaatctgctttcctcagttttccaacttcggaaatctggacccacatggctttgcaaggaacaggacctggagtgttgaaaatgatccaccaccatttccagtaccaacttctaataaagcttacgtcgatttaatccttacgcatactgaagaagatctaaagatctggccacatagttacgagttccgtctgagagttgcacttggacctggtggagatctgatgctgacttcacgtataagaaataccaatgcagatggaaagccattctcatttacatttgcatatcacacatacttttcaatatctgatatcagcgaggtgcgagtagaaggcctggaaactctggattacctagacaacttacaagagagaaatcgatacactgaacaaggggatgcaattgtttttgaatctgaattggacagaatatatctgggcacaccgtcaaaaattgccattattgatcatgagaagaaaagaacatttgttgtgaggaaaggtggccttcctgatgctgttgtttggaacccttgggacaagaaggctaaggctatgtcagactttggggatgacgaatataaacgcatggtctgtgtggaggcagctgctatagaaaagccgattactttgaagcctggtgaggagtggactggaaagttggaactgtctgctgtcccatctagctattacagtggtcagctggatcctgatcgtgttcttcaggattcaagtgtcccggaggactcaatcagctagtccttagtggatatttgtccaggtagactattatatcatatgcataagggacattggcaacaaggagtgtcaaaacgtttattccattctattcaaatctttgttgttttttggcatgcatatctgaactgaggaatttcaaaattgatttacgttttgatatctacataacgtaaggggacgggtcggtattaataccctgtatatgcatgtttgaagtgagaaacatctcattgggttgtaaaataaaaatcaatactgtatctcttttttgatcggc

SEQ ID NO: 624 - DNA, 1571 bp, Sorghum bicolor
cggaaattccccaaatcgacctcgacccagcccatctacctctctccacttgcgcttcctctgcctctccctccagctcctctgctccgctccgctccgctcggcctcggcgtgcggtgctcggctcgctgcggctcggtccggcgcgaaggacaccatgtcggcctcggcgtcgtcgccgccggcgggagaggagaacaagcaggaggcggcgccagtcaggcactgcaagggcgtcaacgacctcgacaaggtcgtgctccgcgaggtccggggcagctccgcagaggtgtacttgtacggtgggcatgtgacatcatggaaagatgagcatggagacgagttactttttgttagcaataaggctattttcaagcctccaaaagctatacgtggaggaataccgatctgctttccacagttttccaactttgggaatctggaacaacatggatttgcaaggaatagaacatggtgtgttgatgatgatcctccaccatttccagtgccaacctccaatacagcttttgtggacttgatcctcaaacctactgaagaggatttgaagatctggcctcatagttttgagtaccgcctgagggttgcacttagtcctggtggtgatttgatgctaacttcacgtataagaaacactaatgcagatgggaagtcattctctttcacttttgcataccacacatacttcaagatttctgatatcagtgaggtgcgagtagaaggtttggaaactctggattacctagataacttacaagatagagcccgtttcactgaacaaggcgatgcaattgtttttgaatccgaactggacagaatatatctgggcactccgtcaaaaattgcgattattgaccatgagaagaaaagaacatttgttgtgaggaaaggaggccttcctgatgctgttgtttggaacccctgggataaaaaagcgaaggctatgtcagattttggggatgatgaatataaacgaatggtatgcgtggaggcggcggctatagagaagcctgtcactctgaagcctggtgaggagtggactggaaagttggaactttctgctgtgccatctagttattacagtggtcagctagatcctgaccgtgtgattcaggattctactgtcccggaggactcaatcagctagtccttaagtctattttgcgcaggtagagcattacatcatatgcataagagatgctggcaacaaggattgtccacatgtttcttccattctattcaaatctttggtgttttctattcggagtacatatccgaaccaaggaatgtgaaattggttttcattttttaggatctatgccgcataatattggcatagtggacaagtcggtgttcataccctgtatagggatgtttaaaggatgtttccatgtgttgtaaaataaaagaaaattcctctttatatttgatcgattcttttttcttaatacatataataagttttatactggatctagaaaatagagctggtgtagaaatggtggacatatgtggtttctgaatattccggctctataacttcttatagatgc

SEQ ID NO: 625 - DNA, 1401 bp, Saccharum officinarum
ccagactccacytgcgcttcctcccccccaccccaggctccagcttccgctgctccgctcggcctcggcgtgcggtggtgctcgctgctgctcggtccagcggaaggacaccatgtcggcctcggcgtcgtcgccgccggcgggcgaggagaataggcaggaggcggcgcccgtcaggcactgcaagggcgtcaacgacctcgacaaggtcgtgctccgcgaggtccggggcagctccgcggaggtgtacttgtatggtgggcatgtgacatcatggaaagatgagcatggagatgagttactttttgttagcaataaggctattttcaagcctccaaaagctatacgtggaggaataccaatctgctttccacagttttccaactttgggaatctggaacaacatggatttgcaaggaataggacatggtgtgttgataatgatcctccaccatttccagtgccaacctccaatacagcttatgtggacttgatcctcaaacctactgaagaggatttgaagatctggcctcatagttttgagtaccgcctgagggttgcacttagtcctggtggtgatttgatgctaacttcacgtataagaaacactaatgcagatgggaagtcattctctttcacttttgcataccacacatacttcaagatttctgatatcagtgaggtgcgagtagaaggtttggaaactctggattacctagacaacttacaagatagagcccgtttcactgaacaaggcgatgcaattgtttttgaatccgaactggacagaatatatctgggcacaccgtcaaaaattgccattattgatcatgagaagaaaagaacatttgttgtgaggaaaggaggccttcctgatgctgttgtttggaacccctgggataaaaaagcaaaggctatgtcagattttggggatgatgaatataaacgaatggtatgcgtggaggcggctgctatagaaaagcctgtcactctgaagcctggtgaggagtggactggaaagttggaactttctgctgtgccatctagttattacagtggtcagctagaccctgaccgtgtgattcaggattctactgtcccggaggactcaatcagctagtccttaagtctatttttgcgcaggtagagcattatatcatatgcataagagatgctggtaacaaggactctccacatatttcttccattctattcaaatctttggtgttttctattcggagtacatatccgaaccaaggaatgtgaaaatggtttccgttttttaggatctatgtggtataatggacaagttggtgtwcatgtcttgaaacgagaaacatcttccatgagttgtaaaataaaagaaaattcctctttatatttgatcatttttttttgtct

SEQ ID NO: 626 - DNA, 1529 bp, Panicum virgatum
ccacgcgtccggagtcgagtaggcgctgtccggaaattccccaattaagcccaccgtacctgcctctccgcttctctgcctccaggctccagtagctccactgctccgcccgcccggcgtgctcgccgctgctcgcgggaggggacatgtcggcctccgcgtcgacgccggccggcgaggagaagcaggagctggcgcccgtggtgcagtgcaagggcgtcaacgacctcgacaaggtcgtcctccgcgaggtccggggcagctccgccgaggtttacctgtatggtgggcatgtgacatcatggaaagatgatcatggagatgagttactttttgttagcaataaggctattttcaagcctccaaaagctatacgtggaggaataccaatctgctttccacagttttccaactttggaaatctggaacaacatggatttgcaaggaatagagtctggaccattgatactgatccaccaccatttcctgtgccaaccaccaatacagcttatattgatttaatccttaaacctacggaagaggatttgaagatctggcctcatagttttgaataccgtctgagggttgcacttagtcctggtggtgatttgatgctaacttcacgtataagaaacactaatgcagatggaaagtcattctctttcacctttgcataccacacatacttcaagatttctgatataagtgaggtgcgagtagaaggcctggaaactctggattacctagacaacttacaagacagagcccgtttcactgaacaaggagatgcaattgtttttgaatccgaactggacagaatatatctgggcacaccatcaaaaattgccattattgatcatgagaagaaaagaacatttgttgtgaggaaaggaggacttcctgatgctgttgtttggaatccttgggacaaaaaggcaaaggctatgtcagattttggtgatgatgaatataaacgcatggtttgtgtggaggcagctgctatagagaagccggttactctaaagcctggtgaggaatggaccggaaagttggaactttctgctgtgccatctagttattacagtggtcagctagaccctgaccgtgtgattcaggattcaagtgtcccagaggattcaatcagctagtccttactgtaattctgtgcaggtagagcattatatcatgtataagggacactggcagcaaggattgtcacaacgtttttctttctattctattcaaatctttgttgttttctgttcggggtgcatatcgaaccaagggatgtgaaattggtttactttttttggatctacgtgacataaaggacaagtcagtgttcgtaccctgtatatggatgtttgaggcgagaaacatcttccatgggttgtaaaataaagaaaaaaaaatcctctctaccgttagttcattgtctttagatgtaagttctatattaaacctaggaagcagagatgttgtggaaatggacacacataatgtgcgaactgttccaggcattgtagctt

SEQ ID NO: 627 - DNA, 1521 bp, Triticum aestivum
gaagaattccccaattaaaagagatctctctctcgtcacatccacctcactcgctcgcttcctgctgccattccgcggccggacatgtcgtcgtcgggggccggcgaggagggcgccgccgcgccgcaggggccgctacccgtggagcaccggaagggcgccaacgggctcgacaaggtcgtcctccgcgaggcccggcgcatctccgccgaggtgtacctgtatggtggccatgtaacatcatggaaagatgagcatggggaggagctgcttttcgttagtaataaggctattttcaaacctccaaaagctatacgtggaggtataccaatctgctttcctcagttttccaacttcggacakctggaagctcatggatttgcaaggaacaagatctggagtgttgacactgatccaccaccatttccagtaccaatctctagtagagcttacatcgatttaatccttaaacctactgatgaagacttaaagatctggccacatagttttgagtaccgtctgagggttgcacttggacctggtggagatctgatgctgacttcacgtataaggaataccaatgcagatggaaagccattctcttttacctttgcatatcacacgtacttctcaatttctgatataagtgagatacgagtagaaggcctggaaactctggattacctagacaacttacaagatagggcccgcttcactgaacaaggcgatgctattgtttttgaatctgagttggacagaatatatctgggcacgccgtcaaaaattgccattattgatcatgagaaaaaaagaacatttgttgtgaggaaaggaggacttccggatgctgttgtttggaacccatgggacaaaaaagctaaggcaatggcagattttggggatgacgaatataaacgcatggtatgtgtggaagcagctgctatagaaaaggcgattactctgaagcctggcgaggagtggactggaaagttggaactatctgcagttccgtctagttattacagcggtcaattggacccagatcgtgttattcaggattcagttgttccggaggattcagtcagctagcccttagtcaagttctgtgcaggtagactattaatatcatatgcacaaggaaaatggcagccacgagtgtcaaaacatttcttccattctattcaaatctttgttgttttcggcgtacctaccgcaacagagcgaaaatctcaacattgatttctgtttcagtatccacatgacataaaggaacaaatcagtgtttgtaccctgcatagggatgatcgaagaaacatcttagatgggttgtaaaataaatttataactgtattttcttcttttaccagtttcttttatgcktaagtttcrtagtgtggccaaaaggcgaagatgatgtcaaaccacctttcagataarcacacatgatgtgtaaacatgccaaggttttgagctgcatggcttggtggttgttgaaccatgcttatttggatgcaattgtgc

SEQ ID NO: 628 - DNA, 2236 bp, Oryza sativa
aagatccatacctaccaaccaaacttgaattggtttagtagtgttgcctccagcctcctcctcctccaacctctctcccaacaaaagcatttcatagcctaattcaatcattatagagggaaaagcagcaagaattaaggtgtagcaacctgcaaaaatgcgcgccaaagtggagctagccgtcctcctcttggtcctcgtcggcgtcgccgccgggacccggccgccgtcggcgccgccgccggtgacggaggacacacttcagaaggtggccggctcgctggaaatgtacgtcgacgagctccctcagatgcccaagatctacggcttctccatgagacacggtcacccctctcccattcgtctcaccatcggcatgtaccagaagaaatggaaattccaccgcgacctgccggcgagcaccgtgttcgtgttcgggacgtcggcggcgacggccacgttcccggggcccaccatcgaggcagcgcagggggtcccactgtcagtgacgtggcagaactacctccccgcgcgccacatcctcccgtgggaccccaccgtgcccaccgccatcccgcgccgcggcggcgtccccaccgtcgtccacctccacggcggcgcccacccgccgcagtccgatggcagcgccttcgcctggttcaccgccggcttcggcgagaccggcccggcgtggtcgacgccgacgtacacctaccccaacgcgcagtcccccggcgtgctctggtaccacgaccacgccctcggcctcacccgcgccaacctcctcgccggactcctcggcgcctacgtcatccgcaacccggcggtggaggcgccgctcggcctcccctgcggcgatgagttcgaccgcgtcctcatgctcgccgaccggagcttctacgccgacggctccatctatatgaactacaccggcatcatccccaacatccacccgcagtggcagccggagtacttcggcgaggccatcaccgtcaacggcaaggcatggccgttcctcgccgtcgcccgccgccgctaccgcttccgcatcatcaacaccagcaacgcgcgctacttcaacctctccctcaccaacggcctccccttcaccgtcgtcggctccgacaccaactacctctccaagccggtcaccgcggcgagcctcctcgtctccgtcgccgagacgttcgacgtcgtcgtcgacttctcccagtccaccagctccgaggcggagctggtcaacacggcgccgtacccgtaccccgacggccaagcgcccaacgacctcaacggcaaggtgatgaagttcgtgatctcgccggcgaaggcgaaggacacctccagggtgccggcgaagctgctcgactacgtcgctgtcgccgaggaagaggcagtgcagaggcggtacatcgtgatgtacgagtacgaggacgccgccaccggcaacccgacacacctgtacatcaacgggaagaggctggaggacccggcgacggagacgccgcggccggggacgacggaggtgtgggaggtgatcaacctgacgccggacaaccacccgctccacctccacctcgcgacgttccaggcgacgcgcgtccgcgggctcgtcgacgaggacgcgttcaagggctgcatggcgaagctcaacgacgcggtgaggtgcaacgtgagccggcacgccgtcggcgaggaggtggcggtgccggagcacgagaaggggtggaagaacgtggtcaagatcgcgccggggtacatgacgacgatcgtcgtcaagttcttcatggtcgacagcggcaagccgtacccgttcgacgccacggccgagcccggctacgtctatcactgccacattctggatcatgaggacaacgccatgattcgcccgctaaagctgatcaaatgaagacatttttaaggaaatgatgatcagagtacaagaagcaatccagtaccaagtgtaaatgggatccctgaacagagaaaagcaatgagattataatttattttagaaattgtttaagatgttgtatcacaataacttaataagctgtaggccatgtgtttgtactttgtaggtaaagtaagcatttgttttaggagacagaaagcaaaaaactatgtctcctaaatttgtcatagttgtccttcctttttcactctgttcttcatgtattcttgactctgctaaatgccaaataatgaaagttattctctccaactttcagtctttttc

SEQ ID NO: 629 - DNA, 916 bp, Hordeum vulgare
cccttcacacgcccgcccgcgcgcgccacggacgcagcaatggccgccctcgccgsctccatcgmcacctccacggcgttcgccgcgaagccgcgcctgtcccgcccgccggcgcgcctmtmcgtstcctgctccgcgtccagcggcgacaacaacaacagcacckssacccctcgcttscgcctscatcaagaccttmtcggccgcgctggcgctctsctccgtgctcctctsctccgccgccacctmcccgccccccgcggctgccgacatcgccggcctgaccccgtgcaaggagtccaaggccttcgccaagcgggagaagcagtcggtcaagaagctcaactcgtcgctcaagaagtacgcgcccgactccgccccggcgctcgccatccaggccaccatcgacaagaccaagcgccggttcgagaactacggcaagttcggcctgctctgcggctccgacggcctgccccacctcatcgtcagcggcgaccagcggcactggggcgagttcatcacccccggcgkgctcttcctctacatcgccggctggatcggctgggtcggacgcagctacctcatcgccgtcagcggcgagaagaagcccgscatgarggagatcawyatygacgtcgagctygccgccaggawcatccccaggggcttcatctggcccgtygccggataccgggagctcatcaccgggaaactcgttgtcggacgacggccgcactcggttactaagaaacttccatgcgtgcctgcctgcctggtaggctaatcggtccccaatcactagggccccggaagatgagggccttgggcggccaactgttgggccttgggggtggaccttaaaggaacatgggaaaagggaaccctttttgtttttaagaaactgaaccccatcttg

SEQ ID NO: 630 - DNA, 1180 bp, Hordeum vulgare
acccactcgcgccacgccccttatcccctcctcttacaaacccacacaaactaatcatcgcccaccaccctccaacgatcaccaaccaaaacccctccacacgcccgcccgcgcgcgccacggacgcagcaatggccgccctcgccgcctccatcgccacctccacggcgttcgccgcgaagccgcgcctgtcccgcccgccggcgcgcctctccgtctcctgctccgcgtccagcggcgacaacaacaacagcaccgccaccccctcgctctccgcctccatcaagaccttctcggccgcgctggcgctctcctccgtgctcctctcctcggccgccacctccccgccccccgcggccgccgacatcgccggcctgaccccgtgcaaggagtccaaggccttcgccaagcgggagaagcagtcggtcaagaagctcaactcgtcgctcaagaagtacgcgcccgactccgccccggcgctcgccatccaggccaccatcgacaagaccaagcgccggttcgagaactacggcaagttcggcctgctctgcggctccgacggcctgccccacctcatcgtcagcggcgaccagcggcactggggcgagttcatcacccccggcgtgctcttcctctacatcgccggctggatcggctgggtcggacgcagctacctcatcgccgtcagcggcgagaagaagcccgccatgagggagatcatcatcgacgtcgagctcgccgccaggatcatccccaggggcttcatctggcccgtcgccgcataccgcgagctcatcaacggcgacctcgtcgtcgacgacgccgacatcggctactaactagctgccatgcgtgcgtggttggctagtcggtcccaagtcagatgggcagcggaggatgagggcttgtggtgtcgatctgtgtgggcttggtgtaggagctgataggatcatggagaaatggaacctctcttgtatttaagaaactgaacccaatcttgtataactattgtgttctctcttcacacgtgtgtattttaccattgttcaaattgttgagaacgatttcatgatgcacagcctactatgagtgcaactgcatcaacatacataggaaactcaactcagaaaaaaggttgatttttgttataagaatacaagccaaatatctaaaaaaaaaa

SEQ ID NO: 631 - DNA, 1041 bp, Brachypodium distachyon
aactaattggccgcgcacgcgcctcccctgatcagccaggaaggaatccaactcccaccacacgcccccacgacgcgcgcgccagcagcaatggccgccctcgccgcctccatcgccacgtccaccgccttcgcctccaagccgcgcctctcctcccccaccccgcgcgcgcggctctccgtctcctgctccgccaccggcgacaacaacaacaacaacccctctctggccaccgccgccaagaccttctccgcggcactcgccctatcctccgtgctcctctcctcggcggccaccttctccccacccccggccgccgccgacatcgccggcctgaccccgtgcaaggactccaaggccttcgccaagcgcgagaagcagtcggtcaagaagctcacctcctccctcaagaagtacgcccccgactcggccccggcgctcgccatccaggccaccatcgagaagacgcagcgccggttcgagaactacgggaagttcggcctgctctgcggctccgacgggctgccccacctcatcgtcagcggcgaccagcggcactggggcgaattcgtcacccccggcgtgctcttcctctacatcgccggctggatcggctgggtcggcaggagctacctcatcgccgtcagcggcgagaagaagcccgccatgagggagatcatcatcgacgtcgagctcgccgccaggatcatccccagggggttcatctggcccgtcgccgcctaccgcgagctcatcaatggtgacctcgtcgtcgacgacgccgacatcggatactaattggcgggccgtgcgtgcacgcatggttggctagtcggtcggtccccggtcagctgggcaatggggggatgtgaaggcttgtggtgcctgtgtgggcttggtgtaggagctgatcgataggataaaggaggaatggaagctctcttgtatctaagaaactgaaatcttgtataactgtacctctcttgtgtgtattttgccaagttcaaattgttgagaacgatttcatgttgcagagcatac

SEQ ID NO: 632 - DNA, 962 bp, Festuca arundinacea
ggcacgaggctctctgtccacacgcccagcgcgcrcgccacgsacgcagcagcmgcagcaatggccggcctcaccgcctccatcgccacctccacggccttcgccgccaagccgcgcctgccscgctcgcccgcgcgcctcaccgtctcctgctccgcctcctccaacgacaacaccmcrccctccctctccgcgtccgtcaagaccttctccgcggcgctcgcgctctcctccgtcctcctctcctccgccgccacctccccgcccccrgccgccgccgacatcgccggcctcacyccctgcaaggagtccaaggccttcgccaagcgcgagaagcagtcggtcaagaagctcacctcctcgctcaagaagtacgcgcccgactccgcgcccgcgctcgccatccaggccaccatcgagaagaccaagcgccgcttcgacaactacggcaagttcggcctgctctgcggctccgacggcctgccccacctcatcgtcagcggcgaccagcggcactggggcgagttcatcaccccgggcgtsctcttcctctacatcgcgggrtggatcgggtgggtcggcaggagctacctcatcgccatcagcggcgagaagaagccmgccatgagggagatcatcatcgacgtcgagctcgcgtccaggatcatccccaggggcttcatctggcctgttgccgcgtaccgcgagtggatcaacggtgacctcgtcgtcgacgacgccgacatcggctactaagcatgcgagcttggttggctagtcggtccacagtcagatgggcagcggaggacgatgagggcctgtggtgtctgtttgcgtgggtttggtgtaggagctgataggatcatggagaaatggaacctctcttgtacttaagaaactgaaatcttgtataactattgtgctctctcttcgtgtattttacattgttcaagtcattcgta

SEQ ID NO: 633 - DNA, 996 bp, Leymus cinereus x Leymus triticoides
gcacgaggcgatcgcgagccaaaccccctccacacgcccgcccgcccgcgcgcgccacggacgcagcacccgcagcaatggccgccctcaccgcctccatcgccaccaccaccgccttcgccgcgaagccacgcctgtcccgcccgcccgcgcgcctctccgtctcctgctccgcgtccggggacaacaccaccaccccgtcgctctccgcctccatcaagaccttctcggccgccctggcgctgtcctccgtgctgctctcctccgccgccacctccccgccgcccgcggccgccgacatcgccggcctgaccccgtgcaaggagtccaaggccttcgccaagcgcgagaagcagtccgtgaagaagctcaactcgtcgctcaagaagtacgcgcccgactcggcgcccgcgctcgccatccaggccaccatcgagaagaccaagcgccggttcgagaactacggcaagttcggcctgctctgcggctccgacggcctgccccacctcatcgtcagcggcgaccagcggcactggggcgagttcatcacccccggcgtgctcttcctctacatcgccggctggatcgggtgggtcggccgsagctacctcatcgccgtcagcggcgagaagaagcccgccatgcgggagatcatcatcgacgtcgagctcgccgccaggatcatccccaggggcttcatctggcccgtcgccgcctaccgcgagttgatcaacggcgacctcgtcgtcgacgacgccgacatcggctactaattagcggccatgcgtgcgtgcatggttggctagtcggtcccaagtcagatgggcagcggaggaggggttgtggtgtcgatctgtgtgggcttggtgtaggagctgataggatcctggagaaatggaagctctcttgtatttaagaaactgaacccaatcttgtataactattgtgttctctcttcacatgtgtgtgttttaccattgttcaaattgttgraaa

SEQ ID NO: 634 - DNA, 1114 bp, Zea mays
gcgcgtccccccttatcccgagcgcgtttctttccgatcccaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagtgtgtcgctcgcatcctccgtgaagacgttctcggccgcgctggctctgtcgtcggtgcttctctcctcggccgccacctcccctccccccgcggccgctgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgagttgggcagtcgtcgtacgtgggaaacatggcttttggtgtaggaggaaggaatggaagtggtctgttgtacttaaagaaactagatgaagaagtcttgtataactgaaactttacccctctcttgtgtatgatgtattcaccttcgtcttgaaaattcttgagaacggtttcatcttgcatacattttgctagtgaagggtcgaatcagctgaccagatgagataaataagagacaataagaattctttgctttcagt

SEQ ID NO: 635 - DNA, 1007 bp, Zea mays
acccactcgtgcgccgcggccttatcccaaagttgcattgcatccatcgtgcctgatctccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgccacccgcctcctccccagggggttcatctggcccgtcgccgcctaccgcgagctcatcaacggggacctcgtcgtcgacgacaaggacatcggctactactagctgcgcttgttcacctgcttgcactgtgcatatatattgctgctgccgagctgggcgcttggatagtacgtggggaaacatggatggcttttggtgtaggagctgcatgctttgctagggctatctggtcatgtaggaaatggaagctctgctgtactttaagaaacttgatgaaacctttgtataactc

SEQ ID NO: 636 - DNA, 1017 bp, Pseudoroegneria spicata
ctcgatcgatcacgcatcaaacccctccacacgcccgcccgcccgcgcgcgcgccaaggacacgccggacgcagccgcagcaatggccgccctcaccgcctccatcgccacctccacggccttcgccgccaagccgcgcctggcccgcccgccggcgcgcctctccgtctcctgctccgcgtccggggacaacaacaccaccaccccctcgctctccgcctccatcaagaccttctcggccgccctggcgctctcgtccgtcctcctctcctcggcggccacctccccgccgccggccgcggcagacatcgccggcctcaccccgtgcaaggagtccaaggcgttcgccaagcgagagaagcagtcggtgaagaagctcaactcgtcgctcaagaagtacgcgccggactcggcgccggcgctcgccatccaggccaccatcgagaagaccaagcgccggttcgagaactacggcaagttcggcctgctctgcggctccgacggcctgccccacctcatcgtcagcggcgaccagcggcactggggcgagttcatcacccccggcgtgctcttcctctacatcgccggctggatcgggtgggtcggccgcagctacctcatcgctgtcagcggcgagaagaagcccgccatgcgggagatcatcatcgacgtcgagctcgccgccaggatcatccccaggggcttcatctggcccgtcgccgcctaccgcgagctcatcaacggcgacctcgtcgtcgacgacgccgacatcggctactaatcagcggccatgcgtgcgtggttggctagtcggtcccagtcccaggtcagatgggcagcggaggatgagggcttgtggtgtcgatctgtgtggacttggtgtaggagctgataggatcctggagaaatggaagctctcttgtacttaagaaactcaacccaatcttgtataactattgtgttctctcttcacatgtgtgtattttaccattgttcaaattgttgagaaccatttca

SEQ ID NO: 637 - DNA, 1139 bp, Oryza sativa
cacgatacaaacccgcaaacccactccgatcgcaaatactctctctcgccgatagcagcagcagcagcaatggccgccctcgccgccgcatccaccgccttcgccgccaagccgcgcctggcgcgcgcgccgtcgtccccggccgcgcggttctccgtgtcgtgctccgcgtcgggcaacaacggcggcgccggcgagatggcgcagtcgctggcggcgtcggccaagacgttctccgcggcgctggcgctgtcctcggtgctgctctcctcggcggcgacgtcgccgccccccgccgccgccgacatcgccgggctgacgccgtgcaaggagtccaaggcgttcgcgaagcgggagaagcagtccatcaagaagctccagtcgtcgctcaagaagtacgcgccggactccgcgccggcgctcgccatcaacgccaccatcgagaagacgaagcgccgcttcgagaactacggcaagttcggcctgctctgcggcgccgacggcctcccgcacctcatcgtcagcggcgaccagcggcactggggcgagttcatcaccccgggcttgctcttcctctacatcgccggctggatcggctgggtcggcaggagctacctcatcgccatcagcggcgagaagaagccggccatgagggagatcatcatcgacgtcgagctcgccgtcaagctcctcccgagggggttcatctggcccgtcgccgcctaccgtgagctcatcaccggcaacctcgtcgtcgacgacgctgacatcggctactgatcaccacatggatgcttggctactcaagccccaggtgagttgatttggcagtggaggaagagggctcgtgcatggtgatttgtgtggtttgggtgtagaagctgataggatcatggaggaatggaagatctgttgtacttaagaaaaactaagtcttgtataccgtacctctctcttgtgtgtatttaccatcttaagattcttgagaacaattccttcgtgcaattctcgtgctgttgtcgctgcagctgcagagagattttcaatcgtatgtactccagcataaagtagatagaaactcatctgaccgggacaaactagattaattgaattgaattaggcgtagtgcatcaatatca

SEQ ID NO: 638 - DNA, 871 bp, Secale cereale
  misc_feature (20)..(20): n is a, c, g, or t
cgcgcttgcccgcccgccgngcgcctctccgtctcctgtccgcgtccgggacaacaccaccccctcaatctccacctccatcaagaccttctcrgccgcsctsgcgctctcgtccgtcctcctctcctccgccgccacctccccgccgccggcsgcsgccgacatcgccggcctgaccccgtgcaaggagtccaaggcgttcgccaagcgggagaagcagtcggtgaagaagctcacctcgtcgctcaagaagtacgcgccggactcsgcgcccgcgctcgccatccaggccaccatcgacaagaccaagcgccggttcgagaactacggcaagttcggcctgctgtgcggctccgacggcctgccccacctcatcgtcarcggcgaccarcggcactggggcgagttcatcacccccggcgtgctcttcctctacatcgccggctggatcgggtgggtcggccgcagctacctcatcgccgtcagcggcgagaagaagccggccatgagggagatcatcatcgacgtcgagctcgcctccaggatcatccccaggggcttcatctggcccgtcgccgccttccgcgagctcatcaacggcgacctcgtcgtcgacgacgccgacatcggatactaattagctgccatgcgtgcgtggttggctagtcagtcccaggtcagatgggcagcggaggatggaagagggctcgtggtgtcgatctgtgtgggcttggtgtaggagctgataggatcatggaggaatggaagctctcttgtatttaagaaactgaacccaatcttgtataactattgtgttctctcttcacatgtgtgtgttttaccattgttcaaattgttgagaacgatttca

SEQ ID NO: 639 - DNA, 1236 bp, Sorghum bicolor
aaagctccaccccgcacacagtgccaataagctcgtctctttctccccagctccagctccacgccggacgcagcagcagcagcagaagcagaagcagaagcagaagcagagatcgatggccgccctcgccgcctcctccacggccgccttcgccgcgaagccgcgcctccctcgcgcgcgcctctccgtggcctgctccgccaccggcgacggcaacgccaacagcgtgtcgctcgcgtcctccgtgaagacgttctcggcggcgctggcgctgtcgtcggtgcttctctcctcggccgccacctccccaccgcccgcggccgccgacatcgcggggctgaccccgtgcaaggagtccaaggcgttcgcgaagcgggagaagaactcgatcaagaagctcacggcgtcgctgaagaagtacgcgcccgacagcgcccccgcgctcgccatcaacgccaccatcgagaagacgaagaagcggttcgagaactacggcaagttcgggctgctctgcggcgccgacggcctgccgcacctcatcgtcagcggcgaccagcggcactggggcgagttcatcacccccggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcgtaccgcgagctcatcaacggagacctcgtcgtcgacgacaaggacatcggctactactaactgcgtgctgcacctgcttgcacatcgctgctggcgagggcgcagtgcgtatgtggggaaagatcgatggcttttggtgtaggagctggtagggggaaggaatccaagtgatctgttgtacttaaaagaaactggatgaaagccttgtataattggacttctatctcttgtgtgtattcaccttcatgaaaattcttgagaatatgcttcaaaaagataatcttgagaacaatttcattttgcattgcgttgccacttgcgtgttaatcgtcagtgaagaggtataacttcccaattagttagagcacaaaattaaaacacagaattggttcaagtgctcgactagagggaagtaccaagttatagtttagaaggtaattttatctagttttttggagatgctcttaaacaaaagctgatgtgagtgttgg

SEQ ID NO: 640 - DNA, 999 bp, Panicum virgatum
tcccagagctcgtcacctcttcctcctcagctccacgcctcgctcgcgcgcgcgccccggacgcaccaccaccagcagagatggccgccctcgccgcctcctccacggccgccttcgccgccaagccgcgcctgccccgcgcgcgcctctccgtggcctgctccgccaccggcggcggggacagcagcagcagcggcagcggcgtctcgctcgcctcctccgtcaagaccttctcggccgcgctggcgctgtcgtcggtgctcctctcctcggccgccacctcccctccgcccgccgccgccgacatcgccggcctcaccccgtgcaaggagtccaaggcgttcgccaagcgcgagaagaactcgatcaagaagctgaccgcctcgctcaagaagtacgcccccgacagcgcccccgcgctcgccatcaacgccaccatcgagaagaccaagcgccgcttcgagaactacggcaagttcggcctgctctgcggcgccgacggcctgccgcacctcatcgtcagcggcgaccagcggcactggggcgagttcatcaccccgggcctgctcttcctctacatcgccggctggatcgggtgggtcggcaggagctacctcatcgccatcagcggcgagaagaagcccgccatgagggagatcatcatcgacgtcgagctcgccacgaggctcctccccagggggttcatctggcccgtcgcagcctaccgcgagctcatcaacggagatctcgtcgtcgacgacaaggacatcggctactactaagcgcacctgcatggctggtggcgaccggcgagttgggcagcgactgtgttggggaagatgcatggcttgtggtgtaggagctaataggatgatggaggaatggaagctctgttgtacttaagaaactggatgaagccttgtataactgtacctctctcttgtgtgtattcaccttcttgaaaattcttgagaacgatttcattttgcattgcgtttc

SEQ ID NO: 641 - DNA, 1036 bp, Triticum aestivum
caaacccctccacacgcccgcccgcgcgcgccaaggacacgccggacgcagcaatggccgccctcgccgcctccatggccacctccacggccttcgccgccaagccgcgcctggtccgcccgccggcgcgcctctccgtctcctgctccgcgtccagcggcgacaacaacaccccctccctctccgcctccatcaagaccttctcggccgcactggcgctctcgtccgtgctcctctcctccgccgcgacctccccgccgccggcggccgccgacatcgccggcctgaccccgtgcaaggagtccaaggcgttcgccaagcgggagaagcagtcggtgaagaagctcaactcgtcgctcaagaagtacgcgcccgactcggcgcccgcgctcgccatccaggccaccatcgagaagaccaagcgccggttcgagaactacggcaagttcggcctgctctgcggctccgacggcctgccccacctcatcgtcagcggcgaccagcggcactggggcgagttcatcaccccgggcgtgctcttcctctacatcgcggggtggatcgggtgggtcggccgcagctacctcatcgccgtcagcggcgagaagaagcccgccatgcgggagatcatcatcgacgtcgagctcgccgccaggatcatcccgaggggcttcatctggcccgtcgccgcctaccgcgagctcatcaacggcgacctcgtcgtcgacgacgccgacatcggctactaagtagctgccatgcgtgcgtggttggctagtcagtcccaggtcagatgggcagcggaggatgagggcttgtggtgttgatctgcgtgggcttggtgtaggagctgataggatgctggagaaatggaagctcgcctcttgtatttaagaaactgaacccaatcttgtataactattgtgttctctcttcacatgtgtgtattttacaattgttcaaattgttgagaaccatttcatgatgcacagcataccatgagtgaaaatgtgccaacatgcataggaaactcaac

SEQ ID NO: 642 - DNA, 1029 bp, Triticum aestivum
cgatcacgaatcaaacccctccacacgcccgcccgcccgcgcgcgcgccaaggacacgccggacgcagcagcaatggccgccctcaccgcctccatcgccacctccacggccttcgccgccaagccgcgcctggcccgcccgccggcgcgcctctccgtctcctgctccgcgtccagcggcgacaacaccaccccctccctctccgcctccatcaagaccttctcggcggccctggcgctctcctccgtcctcctctcctccgccgccacctccccgccgccggctgccgccgacatcgcgggcctgaccccgtgcaaggagtccaaggcgttcgccaagcgggagaagcagtcggtgaagaagctcaactcgtcgctcaagaagtacgcgcccgactcggcccccgcgctcgccatccaggccaccatcgagaagaccaagcgccggtttgagaactacggcaagttcggcctgctctgcggctccgacggcctgccccacctcatcgtcagcggcgaccagcggcactggggcgagttcatcacccccggcgtgctcttcctctacatcgccggctggatcgggtgggtcggccgcagctacctcatcgccgtcagcggcgagaagaagcccgccatgagggagatcatcatcgacgtcgagctcgccgccaggatcatccccaggggcttcatctggcccgtcgccgcctaccgcgagctcatcaacggcgacctcgtcgtcgacgacgccgacatcggctactaatcagcggccatgcgtgcgtggttggctagtcggtcccaactcagatggacagcggaggatggatgagggcttgtggtgtcgatctgtgtgggcttggtgtaggagctgataggatcctggagaaatggaagctctcttgtatttaagaaactgaacccaatcttgtataactattgtgttctctcttcacatttgtgtattttaccattgttcaaattgttgagaacaatttcatgatgcacagcatattatgagtgaaa

SEQ ID NO: 643 - DNA, 1038 bp, Triticum aestivum
acacatcaaacccctccacacgctcgcccgcgcgcgccacggacgcagcaatggccgccctcaccgcctccatcgccacctccagcgccttcgccgcgaagccgcgcctggcccgcccgccggcgcgcctctccgtctcctgctccgcgtccagcggcgacaacaacaccccctcgctctccgcctccatcaagaccttctcggccgcgctggcgctctcgtccgtgctcctctcctccgccgccacctccccgccgccggcggccgccgacatcgccggcctgaccccgtgcaaggagtccaaggcgttcgccaagcgggagaagcagtcggtgaagaagctcaactcgtcgctcaagaagtacgcccccgactcggcccccgcgctcgccatccaggccaccatcgagaagaccaagcgccggttcgagaactacggcaagttcggcctgctctgcggctccgacggcctgccccacctcatcgtcagcggcgaccagcggcactggggcgagttcatcacccccggcgtgctcttcctctacatcgccggctggatcgggtgggtcggccgcagctacctcatcgccgtcagcggcgagaagaagcccgccatgcgggagatcatcatcgacgtcgagctcgccgccaggatcatccccaggggcttcatctggcccgtcgccgcctaccgcgagctcatcaacggcgacctcgtcgtcgacgacgccgacatcggctactaagtagctgccatgcgtgcgtggttggctagtcagtcccaactcagatgggcagcggaggattgagggcttgtggtgtcgatctgcgtgggcttggtgtaggagctgataggatcatggagaaatggaagctcgatctcttgtatttaagaaactgaacccaatcttgtataactattgtcttctctcttcacatatgtgtgttttacaattgttcaaattgttgagaaccatttcatgatgcacagcataccatgagtgaaaatgtgccaacatacataggaaactcaagttt

SEQ ID NO: 644 - DNA, 1011 bp, Triticum aestivum
accctccaacgatcacgaatcaaacccctccacacgcccgcccgcccgcgcgcgcgccaaggacacgccggacgcagaagcaatggccgtcctcaccgcctccatcgccacctccacggccttcgccgtcaagccgcgcctggcccgtccgccggcgcgcctctccgtctcctgctccgcgtccagcggcgacaacaccaccccctccctctccgtctccatcaagaccttctcggaggacctggtgctctcctccgacctcctctcctccggcgacagctccccgccgccggctgccgacgacattgggggcctgaccccgtgcaaggagtcacaaggcgtacggcaagcgggagaagcactcgtgtgaagaagctcagttcgtcgctcaggaagtacgcgcccgactcggcccctgcgctcgccatccaggccaccatcgaaaataccaagcgccggtttgagaactacggcaagttcggtctgctctgcggctccgacggcctgccccagctcatcgtcagcggctaccagaggcactggggcgagttcatcacccccggcgtgatcttcctctacatcgccggctggatcgcgtgggtctggcgcaactacctcatcgtcgtcagcggctggaacaagcccgtcatgagggagatcatcatcgatgtcgagctcgccgccaggatcatccccaggagcttcatctggcccgtctgcgcctaccggaagctcatacacgggaaactcgtcggtcaccacgcagagatcggatactagtcaacgggcatgcgttcgtgtttggctagtcggtccgactcaaatgacagcgggggatgcatgagggcttgtggtgtcgatcttggtggcatggctgtagagttgataggatcctggagaatgggacctttcttgtttttacaaagtgaaccctcctggtaaaagaagggtgtccccttttaaagtttgggtttttaaccattgtgaagttgttgaaaacaaaaaaaaaaa

SEQ ID NO: 645 - DNA, 986 bp, Triticum aestivum
gcgctagtagaaaattctccaacgatcacgaatcaaacccctccacacgcccggccgcccgagcgcgcgccaaggacacgccggaggctgcagcaatggccgtcctcaccgactccatcgccacctccacggccttcgccgccaagccgagcctggcccgcccgccggcgcgcctctccgtctcctgctccgcgtccagcggcgataacaccaccccctccctctccgcctccatgaagaccttctcggaggccctggcgctctcctccgtcctcctctcctccgccgacacctccccggcggcggctgacgccgacatcgagggcctgaccccgtgcaaggagtccaaggcgtacgtcaagcgggatcaagccttcggtgaagaatctcaactcgtctctcaagaagtacgcgcccgagtcggaccccgcgctcgccatccaggacatcatcgagaagaccaagcgccggtttgagaactacggcaagttcggtctgctctgcggatcacgaggtctggcccacctcatcgtcagcggagaccagcggaactggggcgagtctatcacccccggtgtgctcttcctctacatcgccggatggatagggtgggtcggccgtagctacctcatcgccgtaagcggcgagaagaaccccgccatgagggagatcatcatcgaggtcaagctcggcgacaggatgatccgcagggggtcatcaggtccgtcgccgcctaccgcgagctcatcaacggcgacctcgatcgtgacgacgccgacttccgggtctactcagagggcattcatgcgtggttggatgtccgggcccaatttagatggacaggggacgatggatgaggcctatagggtccatctggtgggcctggggtaggatgtaatagatcctggaaaaatggacctcccttgttttaagaaactaacccaatctggtaaaaaattgcgttccccctccagtgggggattaac

SEQ ID NO: 646 - DNA, 1047 bp, Leymus cinereus x Leymus triticoides
  misc_feature (998)..(1001): n is a, c, g, or t
ccattgataggctggtgatcacagctgtcgagaggaattacgcatccatctcttcaacctccagctatctgcagcacacatcttcgaaggagagaaagatgacgagtgtctggaagaccaaggttctccccgggctcaacaagatcttcgacaaggatggcaagaaggccgccgcsgtcgagttcttgaaatccttcaacaaggaggagattgacaaggagattgaagacaagaagacagaactagagcccaaggttgtggagactattgaagcatctcctccagaaattaagggcttgataaaggataagaaaacatccaagatcaagaagaattcagttgccgtcaccaagttccttgacgatttggccaagattgatttccccggagccaagctggtgagcgacgcggtggccaagtccggcaccacgcccctctccccggccatcgtcttcatcttggacaaggttgcgcctttcgtccccgcgcccaaggaggagcccaaggccgagcccgaggccgccgccgccgccccggcagaggagaccaccacccgcgaggtcgccgtggaggaggagaagaaggaggaggccgagccctccgccgcaccggcggaggcagccgcgcccgctgctgaggtagyggaggagaagaaagaggaggagaaacyygcsgaagccgccgcacctgccgccgctgagccrgagaagaagtgatcggtcgccgccggactccaggagcaacccaaccacctggcttgctagctgctggtaatggaagaaatcattttaagttattgtgaatttgtggtcgctctccgtgtcaaggtagctgcacaaaagcacgtacgtacgtacgacgacacactgcacttgccatgcataccacgcatgcaaacgtacacgcatggaacatttgttattctttcaaaggatcggtctcctcaccgtatgtgtacattttacgtggggctttcttgctttttgtgttggttaaannnntgtgtaattatgattatgttggtgtgttaatttgttggtcatggta

SEQ ID NO: 647 - DNA, 665 bp, Brassica oleracea
gacaccaaaacaaaaacttaacaaaaatattaaatcacaaattcttaagatctcttcttcaatggcgacggggaaaagctactacgcacggccaagctaccgtttcctcggcaccratcagtcgtactacrccgccaacgattcgggattcgagttcgacgaatccgatctctactcatccgattcccccgatttccgccggaaaatctctaaaccggtcagatcggtgaagaaatcgtctaaccgaccgtccacgtgcggcgcttcctccgccgcagcggcgtcgtctctcccggtgaacgtgccggactggtctaagattctccgrgaggagcatcgcgataaccgtcggagaagcatcgtggatgacgacggagattggttggacgctagcggcgggaggttgccgccgcatgagtttctggcgaagacgaggatggcgtcgttctcggtgcacgaaggacttgggaggacattgaaaggaagggatctgagtagggttagaaatgcaatttttgagaaaattgggttccaggattaatattttgaaaaaaaataatattcgaggtccttttataagtaactgtcagagagagagagagagagagagagcatttaatatttcttgaaatgccctcgacttatcgtctattccgaaattttac

SEQ ID NO: 648 - DNA, 735 bp, Brassica napus
acaccaaaacaaaaacttaacaaaaatattaaatcacaaattcttaagatctcttcttcaatggcgacggggaaaagctactacgcacggccaagctaccgtttcctcggcaccgatcagtcgtactacgccgccaacgattcgggattcgagttcgacgaatccgatctctactcatccgattcccccgatttccgccggaaaatctctaaaccggtcagatcggtgaagaaatcgtctaaccgaccgtccacgtgcggcgcttcctccgccgcagcggcgtcgtctctcccggtgaacgtgccggactggtctaagattctccgggaggagcatcgcgataaccgtcggagaagcatcgtggatgacgacggagattggttggacgctagcggcgggaggttgccgccgcatgagtttctggcgaagacgaggatggcgtcgttctcggtgcacgaaggacttgggaggacattgaaaggaagggatctgagtagggttagaaatgcaatttttgagaaaattgggttccaggattaatattttgaaaaaaaataatattcgaggtccttttataagtaactgtcagagagagagagagagcatttaatatttcttgaaatgccctcgacttatcgtctattccgaaaattttacccatgtaattttgtttaactttgagatattattaaattttgcgtattgagatgagtaccgtaatgtataatgtttccg

SEQ ID NO: 649 - DNA, 1382 bp, Phaseolus coccineus
tggtccgctcacgtaccctctcttcaggttgccatctagactgcaatcatggctgatggactggagcatccatcagttgttcagaagctagctggacagtcttacctggtctccaggcttagccccaactttcactccaggaattattctgcaactggttcttgcttcaatggaggactgcactcttctgggttggctgccttgtcatctgtatctccaattactgcgcatgctccagcagagaaaggaccaggtgctttcatggtggattttctgatgggcggagtatctgctgctgtatcaaagacagctgctgctccaattgagagagtcaaattgcttattcaaaatcaggatgaaatgatcaaaagtggtcggttatctgaaccatacaagggaattggtgattgttttgctcgaaccatgaaggatgagggtgtgattgctctttggagaggcaatactgctaatgttatcagatacttccctactcaggctctaaactttgcttttaaggactacttcaagaggctttttaacttcaaaaaggacaaagatggctactggaagtggtttgctggaaatttggcatctggtggggctgctggggcttcttctctcttatttgtctattctttggattatgcccgtacccgtttggctaacgatgcaaaggctgcaaagaagggtggtgagaggcagtttaatggcatgattgatgtgtacaggaaaaccatcaagtctgatggcattgctggcctttaccgtggtttcaacatttcatgcgttggaattatagtgtaccgtggtctttacttcggaatgtatgattctttgaaaccagttgttttggttggtggaatgcaggatagtttctttgctagtttccttttgggatggggaataacaattggtgctggtttggcttcctatcctattgacactgtgcggagaaggatgatgatgacttctggagaagctgtgaagtataatagctctttgcatgcattccaaacaatcgtggcaaaagaaggtaccaaatcactcttcaaaggtgctggtgcaaacatattgcgtgctgttgcaggtgctggtgtgcttgctggttatgataagttgcagcttgttctgttcggaaagaaatacggctctggcggcggttaaaatgatgacgacaatttcctcggacaattatgtttccccatatgatatggaataattttgaatgaaaatattggtatttgatattttccaaatttaggaccgtgaaacttagaaatcacagttttgtgaacaaaaaatcttcattttggttgagaaaataagactagtgtcttgattgctagtgtgatgacatgtgactgtgtcccttgaaagttgtt

SEQ ID NO: 650 - DNA, 1624 bp, Theobroma cacao
gcagtaaggaagtagaattagagctttctcggcgaccgcccaggtcaccatctgaagttgtaaacatggcagatggatcacagcgtccatcagtatttcaaaagatacatgggcagtcctacttcatctccaggctatctcctaacttgcatgccaagaattataatgtgactggagcatatgccaatggaggaattcatgttgctttacagccatcgtgccaagacactgggttcgcacatgtgtcccctgtttctccaatttttgtacaagctccagcagagaagggtttttctggttttatggtggatttcctcatgggaggagtttctgcagctgtctccaagacagctgctgctccaatcgagcgggttaaacttctaatccaaaatcaggatgaaatgatcaaagctgggcgattgtctgaaccatacaagggaattactgactgttttgccaggactattaaggatgaaggtgtccttgctctttggagaggcaacactgctaatgttatcagatacttccccacccaggcgctgaactttgccttcaaggattacttcaagaggatgttcaatttcaagaaggacagagatggctactggaaatggtttgcagggaacttggcatctggtggtgctgctggtgcttcatctcttctgtttgtttactctctggattatgcccgtacgcgtttggctaatgatgctaaggctgctaaaaagggtggtgagaggcagtttaatggtttagtagatgtctacaagaagaccatcaaatctgatggccttgctgggctttatcgtggattcaacatctcatgtgttggaattattgtttatcgtggactctattttggaatgtatgattctctgaagccagttgttttggttggtgggttgcaggatagtttcttggcaagtttcttgctgggttggggtatcacgataggtgctggactggcatcttatccaattgatacagtgcgtagaagaatgatgatgacatctggagaagcagtcaaatacaagagctctctggatgctttctctcagatcatcaagaatgaaggtactaaatcactgttcaagggtgctggtgcaaacattctgcgtgctgttgcaggtgctggtgtgcttgctggttatgacaagctgcaagtcattgttctcggcaagaaatatggatccggtggcggtggctaatgttattacatcacagtgggaggtgatactggcatcttgaagttcgatttacgatttcaagttggaataattgcggatggacatagtgcttttgaaagttcccagtatttagggatttaatatgaaaaaattgttagtgacgaaaaaaatcctacttgaattttgagtgttacatgtttttacttttggttgttctttttggtgagaataattaaacaatgctctgtttggtctgtagtatgttactagatttttcttgtccgtgtatgtgttttgcatttgatctggtaggtatgtgtcacctgaatgaattgtaggagcagtgtatcacaaacagctcctaatttccatggtgttacacttgcctataaacttgcaagatcgtagaagataaagctgctttcgattcttgatca

SEQ ID NO: 651 - DNA, 1627 bp, Manihot esculenta
ggggacagttaggaggtcgcttgtgtgctggcgctctcttactcctcggcgacctctcaggtcaccatcttgagttgcaaacatggcggatggatcatggcatccatcagtgcatcagaagataagtgggcagtcttcactcatttctaagctttcacccagcttgcacacccaaaattatgccttaactggtgcatatagaaatggtctccaaaaccatttacatcctgcacttcaaggcaccggcctggcacttttatcatccccctctcctgtatttatccaagcaccatctgagaaaggtgctagtggctttctaattgattttcttatgggaggtgtctcagctgctgtctccaagactgcagctgctccaattgaacgagttaaactgttgattcaaaatcaggatgagatgatcaaggctggtcgattgtctgaaccatacaagggaatctctgattgctttgccagaaccatcaaagatgaaggtgtacttgctctttggagaggcaatactgctaatgttatcagatacttccccacccaggccctgaactttgcattcaaagattacttcaagaggttgtttaacttcaagaaggacagagatggctactggaagtggtttgctgggaatttggcatctggaggagcagctggtgcttcatccctgttatttgtttattccttggattatgctcgaacacggttggccaatgatgcaaaggcagctaaaaagggtggtgagaggcagtttaatggtttggttgatgtttacaggaaaaccattaaatcagatggtgttgctggcctatatcgtggattcaacatatcttgtgttggaattattgtgtaccgtgggctctattttggaatgtatgattctcttaaacctgtggttctggttggtggtttacaggatagcttcttggctagcttcttgcttggatggggaatcacaataggtgctggattggcctcataccctattgatacagttcgaagaaggatgatgatgacctcaggagaagctgttaagtacaagagctctttggacgcatattcacagattatccagaaggaaggtgcaaaatccctcttcaagggagctggtgcaaacatcctgcgtgctgtggcaggtgctggtgtgcttgctggttatgacaaacttcagctcattgtcttcggcaagaaatatggatctggtggtggtggctaataagatttctggttgaaatgatgacgataatgatgatgatgaagaagaggggatgcttgtctaggctaaattctcaagtttgaatatttttttttttggaggaacgctagtggtcccagtatttaggggacttcttatataaagcgcatagttgtctgaacactttcaattttgagtgatgttatcaaagatttggggtagatggtgtttattttgttcttattgttctttgaatcagaataattagacaacgttcctttagaagtgtgtgttttggaatagtgttgtgttctcaaaaattaaatacatgtctttcagtattgtgccaaatatgatgtttctgtttctgcaggattgtcgcggcatttttgtttaataaattatatgcaaagaaatgcttgtagt

SEQ ID NO: 652 - DNA, 1665 bp, Ricinus communis
gtctccctgactgctgatcaacgtcaacgacaaaggagggaagcattatttacagtggtttgagaaggagaaaaagggcaaaatggtctatttggggataaagtctaaaaccctaaaactagagccctcgtataagtagagagattgtctccgtcatttatccacacagttaggaggaggtcgcgattgtgttactggcactctctcttacacttcggcgacctctcaggtcaccttcgcaaagttgcaaacatggcagatggatcctggaatccatccgtatttcagaagataaatgggcagtcctcactcatttctaggatttcgccaaacacgcacactgcaaattatagcatgactggtctatatggcaatggtctccaaaaccatttgcatcccgcacttcgcggcaccagtctcgcagttgcgtcacccctctcacctgtatttgtacaagcgccatctgagaaaggtgttagtggttttctgattgatttcctcatgggaggagtctcagctgctgtctccaagactgcagctgctccaattgagcgagttaaactcttgattcaaaatcaagatgagatgatcaaggctggtcgactaagtgaaccatataagggaatcactgattgctttggcagaaccatgaaagatgagggtgtactttctctttggagaggaaatactgctaacgttatcagatatttccccacacaggcattaaactttgcattcaaagattatttcaagaggttatttaacttcaagaaggacaaagatggctattggaagtggtttgctggaaacctggcttctggtggagctgctggtgcttcatctcttctatttgtttactcattggattatgcccgaacacgtttggccaatgatgcaaaggctgctaaaaagggtggtgagaggcagttcaatggtttagttgatgtatacaggaaaaccatcaaatctgatggtatagctggactctatcgtggtttcaacatctcttgtgttggaatcattgtctatcgtgggctgtattttggaatgtacgactctctcaagcctgtggttctggttggtgatttacaggatagtttcttggctagtttcttgcttggatggggaatcacaataggtgctggtttggcctcttacccaattgatacagtccgtagaaggatgatgatgacctcaggagaagctgttaaatacaagagctctttggatgcattttctcagatcatgaagaatgaaggggctaaatctctcttcaagggagctggtgcaaacatcctgcgtgctgtggcaggtgctggtgtgctcgctggttatgacaaacttcagcttattgtctttggcaagaaatacggatctggtggtggaggctaatgtgtttacagatgtagaaatgatgatgatgatgatgatgatgaaagaatgatgcttgtctaggtattctcaaaagtttgaataattcttaaagaaacaacagttgtcccaagtatttagggagttaattataggaagtatagtttgtccaaacgcctttcaattttgagtgctgtttacagagcttttggcttagatggtgtttcttttgttatcagtgttctctgttggtgagaataattaaacaacgttcccttgcaaactcttcttatt

SEQ ID NO: 653 - DNA, 1629 bp, Vigna unguiculata
gtgcggtctccttgcattcgctgacgatcagaggaagacacgaagcctctttccaaacccttctttgggtaaccgtttaaagtgcagagatggcggatggattgcattcacggcatccatctgtagttcagaagttatctggacagtcttactttatgtccaggcttgctcctaatcattccagaaactattctaccagtggtagttacttcaatggaggcgtgcagtctctgggcttggttccagtcacagcacatgcaccagctgagaaaggggtgtctgggtttttggtggatttcctcatgggaggagtgtcagctgctgtgtccaagacggctgcagctccgatcgagcgagtcaagttactcatccaaaaccaggatgaaatgatcaagagtggtcggttgtctgagccatacaagggaattggcgattgtttctcccgaaccatgaaggatgaaggggtgattgctctttggagaggaaacacggctaatgttatcagatatttccctactcaggctctgaactttgcttttaaggattatttcaagaggcttttcaacttcaaaaaagataaagatggctactggaagtggtttgctgggaatctagcgtctggtggggctgctggtgcttcatccctcttgtttgtctattcactggattatgctcgaactcgtctagcaaatgatgcaaaggctgcaaagaagggtggtgagaggcagttcaatggcttggttgatgtttacaggaaaaccatcaagtctgatggtgttgctggtctttaccgtggtttcaacatctcgtgtgttggaatcatagtgtaccgtggtctttactttggaatgtatgattctttgaaaccagttgtcttggttggtggactgcaggatagcttctttgcaagttttcttctgggatggggaatcacaataggtgctggcttggcctcttaccccattgataccgtgcgtagaagaatgatgatgacatctggagaagctgtaaaatacaagagttctttggaagcattcaagataattatcgcaaaagagggtacgaagtcactctttaaaggtgccggtgcaaacatattacgtgctgttgctggtgccggagtgcttgctggttatgataagcttcagctcatcgtgttcggaaagaaatatggctctggtggtggaggctaagatacagataatgacgacaataacggtctggagcagtgttgttgtttccctttttgcatttgaataatttcgatgaaaaacggttttgaattttccccgaatgtaggggctttaaattagtcctgcaaacttgaattttagttggatattttacctgttaagcttataatccgtgaatttttttagaccttttggttgatgcagtttgaagtctactgctttatttgttccatgtttgtttggaaggttttaagagtctaattgaagttgcatgtctttgctacgttcaaatttattttcgtttttatcttacagcggctttggttctacaaatttaacaaaatttgttggcccccgtactatacaaatcctgcagcattttctcatttgttgagatattgggaaatattacggtcagtgaaccattgtgttgaga

SEQ ID NO: 654 - DNA, 1492 bp, Vigna unguiculata
ctcacgtatcctctcttcaggctgctatctagactgcaatcatggctgatggactggagcatccatcagttgttcagaagctagctggacagtcttaccttgtctccaggcttagccccaactttcactccaggaattattctgcaactggtattaaccttaatggaggactgcatacgtctggattggctgccttgtcatctgtatctccaattactgcacatgctccagcagagaaaggaccaggtgcttttatggtggattttctgatgggcggagtatctgctgctgtatcaaagacagctgctgctccaattgagagagtcaaattgctcattcaaaatcaggatgagatgatcaaaagtggtcggttatctgaaccatacaagggaattggtgattgttttgctcgaaccatgaaggatgagggtgtgattgctctttggagaggcaatactgccaatgttatcagatacttccccactcaggctctgaactttgcttttaaggattacttcaagaggctttttaactttaagaaggacaaagatggctactggaagtggtttgctggaaatctggcatctggtggggctgctggggcttcttctctcttatttgtctattctttggattatgcccgtacacgtttggctaacgattcaaaggctgcaaagaagggtggtgagaggcagtttaatggtctgattgatgtatacaggaaaaccattaagtctgatggcattgctggcctttaccgtggtttcaacatttcatgtgttggaattatagtgtaccgtggtctttactttggaatgtatgattctctgaaaccagttgtattggttggtgggttgcaggatagtttctttgctagtttccttttggggtggggaatcacaattggtgctggtttggcttcctatcccattgacactgtgcgtagaaggatgatgatgacttctggagaagctgtgaagtataagagttctttgcatgcatttcaaacaatcgtggcaaaagaaggtaccaagtcactcttcaaaggcgctggtgcaaatatattgcgtgctgttgcaggtgctggtgtgcttgctggttatgataagttgcagcttattatgttcggaaagaaatacgggtctggcgggggctaaaatgatgacgacaatttcctaggataatcatgtttcccttctgatatggaataattttgaatggaaattttggtattttgatattttccaaaatttaggaccgtgaaacaaagaaatcacaattttgtgaacaaaattcttcattttggttgagaaaatgagactcttttcttgattgctagtgtgatgacatgtgattgtgtcgcatgaaggttgttatatccgagtttgcgtgatgtttatggacatgatcaataagaaacaattaatatacaaattgcttctatattgacatggtacataatatatatacgaattgcttctttaggtttgta

SEQ ID NO: 655 - DNA, 1545 bp, Zea mays
cttccagcaatccaaaccctgggtcttctataccgtgcctcatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggtggagtttctgctgctgtctccaagacagctgcagctccgattgagcgtgtcaagcttttgattcagaaccaggatgaaatgctcaagactggcaggctttctgaaccgtacaagggtattggggactgctttggccggacaatcagagatgagggttttgtctcactgtggagaggaaacacagctaatgtcatccgttacttccccacacaggcattgaactttgcgttcaaggatcacttcaagcgcatgttcaactttaagaaggacaaggatgggtactggaagtggtttgctggaaatctggcttctggtggagctgctggtgcttgctctctattctttgtctattctctggactacgcccgtacgcgtttggccaatgatgccaaggctgcaaagaagggtggtgagaggcagttcaatggactcgttgatgtttaccgcaagacccttgccagtgatggtattcgtggcctctaccgtggattcaatatctcttgtgtggggatcattgtgtaccgaggtctttactttggtatgtatgattccctgaagccagtgcttcttgttggtaccctgcaggataacttcttggccagcttcttgctcgggtggggtataaccattggtgctggccttgcctcctaccccattgacactgttcgccgtcgcatgatgatgacatctggtgaggccgtcaagtacaacagctccttggacgctttcaagcagattgtcgcaaaggagggtaccaagtccctcttcaagggtgctggcgcaaacatcctccgcgctgtagctggtgctggtgtccttgctgggtacgacaagctccaggtggttgtcttcggcaagaagtacgggtctggtggtggctaaggatgtataatgatgatgacgacgaacaacaaacatgatgttttaggtgcctcctttaagtaaacatacgtacggaccctcgacaccattttaagttcgctctcgcagaggctggtgagtttgtagcgtggctgtgaccgcacctctttttatgtcagagattggaaataagtgacgttagaaattgctgtcttgctgcatc

SEQ ID NO: 656 - DNA, 1510 bp, Elaeis guineensis
aaagagatagagagggggaggctgcgcccctcctcggccttctccagctcattggtgttccaaaatggcggacgaactacgtcctccatctatagtacagaagataaatgggcaatcatacttgttctctagactgtctccctattcgcaggccaggagtttcaacatccacaaccttcctggcacctacatcaatgggggcctgaagagccccttgctgaaattgtaccacagcaacaatggatcacttggtttctcatctctctcacatccatcgcccatctctgcttgtgccccccaggagaagggtatttcaggatttcttatagattttcttatgggaggagtttctgctgctgtctcgaaaacagcagctgctccaattgagcgggtgaagctcttaattcagaaccaggatgagatgattaaagctggcaggctctctgaaccctacaaggggatcggagactgttttggccgaaccataaaaaatgagggcatgctctcattgtggcgaggaaatactgcaaatgttattcgttattttccwacacaggccctgaactttgctttcaaggattactttaagcgtatgtttaactttaagaaagataaagatgggtattggaaatggttcgctggtaacttggcatccggaggtgcagctggtgcttcatctctygtctttgtgtattcgctggattatgccaggacacgtctggccaatgatgccaaggcagcaaagaagggaggtgaaaggcagttcaatggtctgattgatgtttacaggaaaactataaaaactgatggtgttgcrgggctctatcggggcttcaacatctcatgtgttggtatcattgtttatcgcgggctttacttcggaatgtatgattccttaaaaccagtggtgctggttggtgccttgcaggataatttccttgccagtttcttgcttggatggggaatcactattggtgcaggtcttgcctcctaccccattgacactgttcgcagaaggatgatgatgacgtctggcgaggctgtcaagtaccgtagttcattagatgcattctcacagatcctgaaaaatgagggagctaaatccctgttcaagggtgctggtgcaaatatcctccgtgctgtggctggtgctggtgttctggcaggttatgacaagctgcaggtgcttgtctttggaaagaaatatgggtctggtggtggtggctaatgccatttcttgagttgcagatggctagagaatttgatgatgatgaacaagagtattagttgtttgtgcttccttcttgattccagttcaaaataatgttgacagatgaacacccttttattattaccttaggtcttctgagtgatgactgggtgttgtttttatgtctttttttggttaaatagagaactaaaatgtgtgttattgctttcatattatctggttgaacttctatgatggatttccaggatcatgatgcatccttggtatccattttgttct

SEQ ID NO: 657 - DNA, 1463 bp, Carica papaya
aggaggtactgtgagctgtcccggcgactcactaaggttaccatcttgagtttcaaaaatggcagatggattgcagcatccatcactattggggaagatacatgggcaatcttacttcatttctagactttcccctaacctgcaaacgtgcaattatagcttgggtagtgcgtatttaaatggtggtttgcagaattctttgcagccaactcaacatggtattggccttccgctcgtgtctcctgtttctcccatatttgtacaagcaccatcagagaaaggtgtctctggatttttggtggatttcctcatgggaggagtttctgcggctgtttccaagacagcagctgctccaattgagcgggttaaactcttgattcaaaatcaagatgaaatgatcaaggctggtcgtctatctgagccatacaaaggtatcacggactgctttgcaagaacaattaaggatgaaggtgtcctttctctttggagaggaaacactgctaatgtcattagatatttccctacacaggcattgaactttgcattcaaggattacttcaagagattgttcaatttcaagaaagacagagatggctactggaaatggtttgctgggaacttggcatctggtggtgctgctggtgcttcatcccttctatttgtttactccctggattatgctcgaacacgtttagctaatgatgctaaggcagccaaaaagggtggtgagaggcagttcaatgggttggttgatgtttacaggaagaccataaaatctgatggcctggtagggttgtatcgtggtttcaacatttcatgtgttggaattattgtataccgtgggctttactttggaatgtatgattccctgaagcctgtggttcttgtagggaatttgcaggatagcttcctggctagtttcttgttgggatggggtatcacaataggtgctggattggcttcttacccaattgatacagtgcgtagaaggatgatgatgacctctggcgaagcagtcaaatacaagagttcagtggatgcttttcaacagatcattaagaaagaaggtactaaatcactcttcaagggtgctggggctaacatcctccgtgctgttgctggtgctggtgtgcttgctggttatgacaagctgcaggtcattgttttgggcaagaaatatggatctggtggtggttaattggcacagtgggatgtgggatgatgatgaagaatattctagttatcttgagtttgaataattttgtatggacattagtgggcttggtgtttacttgcatatgtggatttggtgtaagaaattatagtgaaaacaggaccatttggaatttgagtgtttccagtgccttgtcctgtagaagtagtggctttcagttgtccttcttgttgagaataattgaacagcttttcaccagcaacctaatagatatggcaatgttgtgttt

SEQ ID NO: 658 - DNA, 1696 bp, Ananas comosus
acacggagagagagagagagagagagataagttcggagggtggcggctctcgtccctcacctcctcggcctcccccacgaggtcagcttggtgacttgctaaaatggcggaagaactgcgccctccttccgtcgtacagaagattcacggccaatcaaccttgttcactaaactctctccctgttcagtagcccacacaaatcctggcatccacagagccacttacttgaacgggagcctgcagggccctgtgctgaggtcatgccatggcattaatgggcctattgggctctcatctatctccacgctttcacctgtctttgctaatgctccttcggagaagggcccctatgggtttctgatcgactttctcatgggaggtgtctctgccgccgtctccaaaacagctgcagctcccattgagcgtgtgaagctcctaattcagaaccaggatgagatgattaagagcggtaggctctctgagccctacaagggaattggggactgctttgcccgaaccatgaaggatgaaggcattcttgcattgtggagaggaaacactgcaaacgtcattcgctacttccccactcaggccctgaacttcgcttttaaagactacttcaagagccttttcaacttcaagaaggatagagacggttactggaaatggtttgccggtaacttggcatctggaggtgcagctggtgcttcgtctctcctctttgtgtactctttggactacgcccgtacccgtttggccaatgatgccaaggccgccaagaagggcggcgagagacagttcaacggcctcatcgatgtctataagaagaccctcaagtccgatggccttgccggtctttaccgtggattcaacatctcgtgtgttggtattattgtttaccgagggctttacttcgggatgtacgattctctcaagcccgtggttctagttggtcccttgcaggacaatttcttcgcgagtttccttctcggatggggcatcaccatcggcgccggccttgcctcctatcccatcgacactgttcgtaggaggatgatgatgacatccggtgaggcggtcaaataccgcagctcgctggatgccttccaacagatcatcaagaacgagggcgcgaaatccctcttcaagggcgctggcgccaacattctccgtgcagtcgcgggtgctggtgttctcgccgggtacgataagctccaggtgatcgttttcggcaagaagtatggatctggcggcggcggctaagggtaattaacacagatgatgacgatgaagaacatggatttagatgcttgcatttgcttttttaagttcatgcttttgaataattgacgacaatgaacgccttttttgttgctgtagcgcgcttgcggaggtttattactattgagtatgatttagttgcgttttcatccttctcggaggagggggattataaactttgtctaaagcactgggttatttaaatttactttgaaataccttttagacattttgcttcctttctaaggggaagcagaattttgtctttcttatgtcaattatttagtctcgatctgcatcatttaaattgtgattgtcgtttgctttttggacggcagttgttttcaaatctaaattgtgcttcttgttttatttcccttagttgaataaaatagcttgtgctttcgttgtttc

SEQ ID NO: 659 - DNA, 1554 bp, Sorghum bicolor
aaaaccccagggtcttttataccgtgcctcatctcgttcgtctcgtctcaggtctcagcgaccctacgagagcccccgtcccaactccaccacctcgcctctccgcggcgcgagcgagggcgacgccggccgcgacggggttccgcccgaccgcggcgtcggcgggaacccgggcttcgctccatctcctcactctcttcatctcttcgatcgcttttgacctgtgaaaatggcggatgaactacgctctacgtctgtggtccagaaggtccatgggcagtctgtgttgttgagcagaatctcttcctactctgccatgaacaaccccgtattcaacaatgcctattctgcttacaatgtgccccagaggtcatattatgggatgaatgcaactgttggactctcatctgtcatggcaccatctcctgtcttcgcgtctgccccaaaagagaaaggcttttctggatttatgattgactttatgatgggtggggtttccgctgctgtctccaagacagctgctgctccgattgagcgtgtcaagcttttgattcagaaccaggatgaaatgctcaagactggcaggctttctgaaccctacaagggtattggggactgctttggtcggacaatcagagatgagggttttgtctcactgtggagaggaaacacagctaatgtaatccgttacttccccacacaggcattgaactttgcgttcaaggatcacttcaagcgcatgttcaactttaagaaggacaaggatgggtactggaagtggtttgctggaaatctggcttctggaggagctgctggtgcttgctctctattctttgtctattctctggactacgctcgtacacgtttggccaatgatgccaaggctgcaaagaagggtggtgagaggcagttcaatggacttgttgatgtttaccgcaagacccttgccagtgatggtattcgcggcctctaccgtggattcaatatctcttgtgtgggaatcattgtgtaccgaggtctttactttggtatgtatgactccctgaagccagtgcttcttgttggtaccctgcaggacaacttcttagccagcttcttgctcggctggggtataaccattggtgctggccttgcctcttaccccattgatactgttcgccgtcgcatgatgatgacatctggtgaggccgtcaagtacaacagctccttggatgctttcaagcagattgttgcaaaggagggtaccaagtccctcttcaagggtgctggggcaaacatcctccgtgctgttgctggtgctggtgtccttgctgggtacgacaagctccaggtgatcgtcttcggcaagaagtatgggtctggtggcggctaaggatatattatgatgacgatgacgaacaacaaacatgatgttttaggtgcctttaataacatacgtatggaccctggacaccaattttaagtttagctctcgcagaggttggtgagttgtttgtagtgtggctgtgaccgcatccctttttgcgtcggagattggaaataagtgacgttaga

SEQ ID NO: 660 - DNA, 1174 bp, Glycine max
tctcacgatctcaacggagccctctcttcaggtcaccatctagactgcaatcatggctgatggaccacagcatccatcagttgttcagaagctagctggacagtcttacctggtgtccaggcttagccccaactttaactctaggaattattctgcaactggttcttacgtcaatggcggaatgcactcgcctgggttggctgttgtgtcacctgtatctccagttactgtgcatgctccagcagagaaaggagtgagtggatttctagtggattttctgatgggtggagtatccgctgctgtatcgaagacagctgctgctccaattgaacgagtcaaattgcttatccaaaatcaggatgaaatgataaaaagtggtcggctatctgagccatacaagggaattggtgattgttttgctcgaacaatgaaggatgagggtgtgattgctctttggagaggaaatactgctaatgttatcagatatttccctactcaggctctgaactttgcctttaaggattactttaagaggcttttcaactttaaaaaggataaagatggctactggaagtggtttgctgggaatttggcatctggtggggctgctggggcttcttccctcttatttgtctattctttggattatgcccgtactcgtttagcaaacgatgcaaaggctgcaaagaagggtggcgagaggcagtttaatggcttggttgatgtttacaggaaaaccatcaagtctgatggtgttgctggcctttatcgtgggttcaacatctcatgtgttggaattatagtgtatcgtggtctttactttggaatgtatgattccctgaaaccagtagttttggttggtgggttgcaggatagtttctttgctagtttccttttgggatggggaatcacaattggtgctggtttggcttcttatcccattgacactgttcgaagaagaatgatgatgacttctggagaagctgtgaagtacaagagctctttgcatgcattccaaacaatcgtcgcaaatgagggtgccaagtcactcttcaaaggtgctggtgcgaacatattgcgtgctgttgcaggtgctggtgtgcttgctggttatgacaagctgcagctcattttgtttggaaagaaatatggatctggcggcggctaaaaatga

SEQ ID NO: 661 - DNA, 1572 bp, Glycine max
accgaagggatggaagggtaaaataatgattaaataaaaccctagtatttcagtgttgctcccatttattcggcgagtgtcgtttccttcccttccctaacgatctgaggaagacaccaagcttctctccacgcccttcttgggtaatctgaagtgcagcgatggcggatggattgcactcgcggcatccatcagtagttcagaagttatctggacagtcttatttgttgtctaggcttgcccctactcactcaagaaactattccacaactggtagttacttcaatggaggcttgcagtcttcgggtttggttccagtcatggcacatgcaccggctgagaaaggagtgtctggatttttgttggatttcatgatgggaggagtgtcggctgctgtgtccaagacggctgcggctccaatcgagcgagttaagttgctcatccaaaaccaggatgaaatgatcaagagtggtcggttgtctgaaccatacaagggaatcggcgattgtttcagtcgaaccatgaaggatgaaggggtgattgctctttggagaggaaacactgctaatgttatcagatacttccctactcaggctctcaactttgcttttaaggattatttcaagaggcttttcaatttcaaaaaggataaagatgggtactggaaatggtttgctgggaatttagcatctggtggggctgctggggcttcctctctgttgtttgtctattctttggactatgcccgaacacgtttagcaaatgatgcaaaggctgcaaagaagggtggtgagaggcagttcaatggcttggttgatgtttacaggaaaactatcaagtctgatggtattgctggcctttatcgtggtttcaacatctcatgtgttggaatcatagtgtaccgtggtctttactttggaatgtatgattctctgaaaccagtggtcttggttggtggattgcaggatagtttctttgctagttttcttttgggatgggggatcacaataggtgccggcttggcctcttaccccattgatactgtgcgtagaagaatgatgatgacatctggagaagctgtaaaatacaagagctctttggaagcattcaagataatcgtcgcaaaagagggtactaagtcactctttaaaggtgctggtgcaaacatattacgtgctgttgcaggtgctggagtgcttgctggttatgataagctacagctcatcttgttcggaaagaaatacggttctggcggtggaggttaatatacagataatgatgacgacaactatctgaggcaatgatgttgcttcccctttgctttgaataatttggatgaaaaatagtggttttgaagtttccccgaatgtaagggctctatattaacaaaacatagttttgcaaaacttgaattttagttggttattacatgtcttaagcttataatcgtgtagtttgatagacctttggttgaagtaatcgaaactgttttatttgttcatgtttgtctgtaaggtgttaattgtccaatgattaatgaaagttgtgtacctcgctcaaatttatttgctt

SEQ ID NO: 662 - DNA, 1606 bp, Glycine max
gtcttcttctcttcttctcttcttctcttcttctcttctcttgtctcacgatctcaacggagcacctctcttcaggtcgccatctagactgcaatcatggctgatggaccacagcatccatcagttgttcagaagctagctggacagtcttacctggtgtccaggctaagccccaactttaactctgggaattattcctcgactggttcttacttcaatggaggactgcactcttctgggttggctgttgtgtcgcctggatctccagttactgtgcatgctccagcagagaaaggagtgagtggatttctagtggattttctgatgggtggagtgtctgctgctgtgtcaaagacagctgctgctccaattgaacgagtcaaattgcttatccaaaatcaggatgaaatgatcaaaagtggtcggttatctgagccatacaagggaattggtgattgttttgctcgaaccatgaaggatgagggtgtgattgctctttggaggggcaatactgctaatgttatcagatatttccctactcaggctctgaactttgcctttaaggattacttcaagagacttttcaactttaaaaaggacaaagatggctactggaagtggtttgctgggaatttggcatctggtggggctgctggggcttcttccctcttatttgtctattctttggattatgcccggactcgtttagcaaacgatgcaaaggctgcaaagaagggtggtgagaggcagtttaatggcttggttgatgtttacaggaaaaccatcaagtctgatggtgttgctggcctttatcgtgggttcaacatatcatgtgttggaattatagtgtatcgcggtctttactttggaatgtatgattccctgaagccagtagttttggttggtgggttgcaggatagtttctttgctagtttccttttgggatggggaatcacaattggtgctggtttggcttcttaccccattgacactgttcgtagaaggatgatgatgacttctggagaggctgtgaagtacaagagctctttgcatgcattccaaacaatcgtcgcaaatgagggtgccaagtcactcttcaaaggtgctggtgcaaacatattgcgtgctgttgcaggtgctggtgtgcttgctggttatgacaagctgcagcttgtcttgttcggaaagaaatacggatctggtggaggtggctaaaatgatgacgacaatttcctgggataatcatgccgattcccttgtgatttgaataattttgaatgagaaatattggtattgatattttcccaaatttaggaccgtgaaacgtagaaatcacagttttgtgaacaagaattcttcattttggttgtttcatttcatgccatcagcttataatcctgaagtttgagaaccccccccggttgaaataattaagactcggtttgattgctcatgtgtggttgaaatgcgattatttctggtgaaagtttcgttaaattcaagctcgtttaatggttatggttatgtaaatcttaattatatggtggttgaatatttgattcagtgcaggatttaaatagttgcaatgttcttaagcttggtttta

SEQ ID NO: 663 - DNA, 1672 bp, Saccharum officinarum
  misc_feature (1666)..(1666): n is a, c, g, or t
  misc_feature (1671)..(1671): n is a, c, g, or t
cgaccctacgagagcccccgtcccaactccaccacctcgcctctccgcggcgcgagcaagggcgacgccggccgcgacgggttccgcccgaccgcggcgtcggcgggaacccgggcttcgctccatctcctcgctctctccatctcttcgatcgcttctgtcttgtgaaaatggcggatgaactacgctctacgtctgtggtccagaaggtccatgggcagtccgtgctattgagcagaatctcttcctattctgccatgaacaaccctgtattcaacaatgcctattctgcttacaatgcgccccggaggtcatatcatgggatgaatgcaactgttggactctcatctgtcatggcaccatcccctgtcttcgcttctgccccaaaagagaaaggcttttctggatttatgatcgacttcatgatgggtggagtttctgctgctgtctccaagacagctgctgctccgattgagcgtgtcaagcttttgattcagaaccaagatgaaatgcttaagactggcaggctttctgaaccctacaagggtattggggactgctttgcccggacaatcagagatgaggggtttgtctcactgtggagaggaaacacagctaatgtcatccgttacttccccacacaggcattgaactttgcgttcaaggatcacttcaagcgcatgttcaactttaagaaggacaaggatgggtactggaagtggtttgctggaaatctggcttctggaggagctgctggtgcttgctctctattctttgtgtattctctggattacgctcgtacgcgtttggccaatgatgccaaggctgcaaagaagggtggtgagaggcagttcaatggacttgttgatgtttaccgcaagacccttgccagtgatggtattcgtggcctctaccgtggattcaatatctcttgtgtggggatcattgtgtaccgaggtctttacttcggtatgtatgactccctgaagccagtgctccttgttggtaccctgcaggacaacttcttagccagcttcttgctcggctggggtataaccattggtgctggccttgcctcgtaccccattgatactgttcgccgtcgcatgatgatgacatctggtgaggccgtcaagtacaacagctccttggatgctttcaagcagattgtcgcaaaggagggtaccaagtcccttttcaagggtgctggcgcaaacattctccgtgctgttgctggtgctggtgtccttgctgggtacgacaagctccaggtgatcgtcttcggcaagaagtacgggtctggtgggggctaaggatagatgatgatgacgacgacgaacaacaaacaggatgtttttaggtgccttcaaataacatacacatggaccccggacaccatttttaagtttagctcttgaagttggtgagttggtttgtagcgtggctgtaaccgcatctctttttgcgtcggagattggaaataaatgatgttagaaattgctgtcttgcagacctcttaaatcctgtcagatgttttggggtagacgatttagctgcatcagttttttatttggttttgcacttgcaaatggttgcccgaatggtatctatgtcggttgaagaatcacagtttcctatgtttgatgaaagcgtatgttttgtgganaacanc

SEQ ID NO: 664 - DNA, 1762 bp, Panicum virgatum
cgtctctttaccgtgccacctcatctcgctcaccccaagtcccggagcccatccaatcccaactccatctctcttccccgcggcgcgagcaagggcgacgccggccgcgacggggctccgcctcgacggcggcgtcggcgggaacccggcttccgctccatctcctcactcccccctctgatcgcttctgactcgtgaaaatggcggatgaactacgttctatgtctgtggtccagaaggtccatgggcagtccgtgttgttgagcagaatctcttcttgttctgccatgaataaccctgtattcaacaatgcgtattctgcctacaacatgccccgtaggtcataccaggggatgaatgcaactgttggacttccctccgtcatggcaccatctcctttctttgcttctgccccaaaagagaaaggtttttctggatttatgattgactttctaatgggtggagtttctgctgctgtttccaagacagctgctgctcccattgagcgtgtcaagctgttgattcagaaccaggatgagatgatcaaaagtggtaggctatctgaaccctacaagggtattggggactgctttgcccggacgatgaaagatgagggttttgtctcactgtggaggggcaacacggctaatgtcatccgttacttccccacacaggcattgaactttgccttcaaggaccacttcaagcgcatgttcaactttaagaaggacaaggatggatactggaagtggtttgctggcaacctggcttctggaggagctgctggtgcttgctctctcttctttgtttattctctggactacgctcgtacacgtttggccaatgatgccaaagctgcaaagaagggtggtgagaggcagttcaatggactcgttgatgtttacaaaaagacccttgccagtgatggtatccgcggcctctaccgtggattcaatatctcctgtgtgggaatcattgtctaccgtggtctttactttggaatgtacgactccctcaagccagtgcttcttgttggttccctgcaggataacttcttggccagcttcttgcttggctggggcataaccattggtgctggtctggcctcgtaccctattgatactgttcgccgccgcatgatgatgacctctggtgaggctgtcaaatacaacagttccttggatgctttcaagcaaattgtcgcaaaggagggtaccaagtccctcttcaagggtgctggcgcgaacatcctccgtgctgttgctggtgctggtgtccttgctgggtacgacaagctccaggtgatcgtcttcggcaagaagtatggttctggaggcggctaagagtagatgatgacgatgaacaacaaacaggatgtcttaggtgcctttaaataacatacacatggacggcggacaccatttttaaattcagcactttgaagaggtcgtttacttggtttgcaatgcggttgataccgcttctctttttgcgtgggagattgaaataagtgaagttagaaattgcagtcctgcagaccttaaatcatggtagtcctgcagtggatcaatgtttgcttgtattggttccatttggttttgcgcgtgcaaatggttgctggaacgggacatacgtgggttccagaatcccagtcctcttccataaaagcttattttgttcctggaattgtttatttttgtttgtgtatacaatctccccatgatcatgtgttaaaatttgtgaatttcgcaggggcggatct

SEQ ID NO: 665 - DNA, 1677 bp, Panicum virgatum
tgccacctcatctcactgacccccccaagtcccggagcccatccaatcccaactccatctctcttccccgcggcgcgagcaagggcgacgccggccgcgacggggctccgccacgacggcggcgtcggcgggaacccggcttccgctccatctcctcactccccccctctgatcacttctgactcgtgaaaatggtggatgaactgcgttctacgtctgtggtccagaaggttcatgggcagtccgtgttgttgagcagaatctcttcttgttctgccatgaataaccctgtattcaacaatgcgtattctgcctacaatgtgccccggaggtcataccacaggatgaatgcaactgttggactttcctctgtcatggcaccatctcctttctttgcttctgccccaaaagagaaaggtttttcaggatttatgattgactttctaatgggtggagtttctgctgctgtttccaagacagctgctgctccaattgagcgtgtcaagcttttgattcagaaccaggatgaaatgctcaagagcggcaggctttctgaaccgtacaagggtattggggagtgctttacccggacaatcaaagatgagggttttgtctcactgtggaggggcaacacagctaatgtcatccgttacttccccacacaggcattgaactttgccttcaaggaccacttcaagcgtatgttcaactttaagaaggacaaggatggatactggaagtggtttgctggcaacctggcttctggaggagctgctggtgcttgctctctcttctttgtttattctctggactacgctcgtacgcgtttggccaatgatgccaaagctgcaaagaagggtggtgagaggcagttcaatggactcgttgatgtttacaaaaagacccttgccagtgatggtatccgcggcctctaccgtggattcaatatctcttgtgtgggaatcattgtctaccgtggtctttactttggaatgtacgactccctcaagccagtgcttcttgttggttccctgcaggataacttcttggccagcttcttgctcggctggggcataaccattggtgctggtcttgcctcgtaccctattgatactgttcgccgccgcatgatgatgacatctggtgaggctgtcaagtacaacagttccttggatgccttcaagcaaattgtcgcaaaggagggtaccaagtccctcttcaagggcgctggcgcgaacatcctccgtgctgttgctggggctggtgtccttgctgggtacgacaagctccaggtgattgtcttcggcaagaagtacgggtctgggggcggctaagagtagatgatgatgatgatgaacaacaaataggatgttttaggtgcctttaaataacatacacatggacggcggacaccatttttaaattcagcacttggaagaggttgttgacttggtttgtaatgcggttgtcaccgcttctctttttgcgtgggagattgaaataagttaagttagaaattacagccctgcagaccttaaatcatggtagtcccgcagtggatcgatgtttgcttgtattggttacatttggttttgcgcgtgcaaatggttgctcgaacgggacctatgtaggttccagaatccagtcctcttccacagaagtttattttgttcatgg

SEQ ID NO: 666 - DNA, 1693 bp, Panicum virgatum
gggccccggcctcaacgctcgcctccgccgcatttcctctcgactctctccactcctctgggctctggctgcccccttcaccggcggagagctgctgtcggcgagtcccatcaccgtttggggccggctggcggcgacctcctccgttggtgccttgggtcagcaagttgcttttagcttgtgaaaaatggagcatgaactacgttctccatctgggatccagagggttcatgggcagcccgtgttgttgagcagaatctcttcttattctgccatgaataaccctgtattcaacaatgtgcccctctggtcgcatcatgggatgaatgcaactgttgggctcccatcagtcatgatgccgtcccccgtctttgcttctgcccccaaagagaaaggtttttctggatttatggttgactttctgatgggtggagtctctgctgctgtttccaagactgctgctgctcccattgagcgtgtcaagctgttgattcagaaccaggatgagatgatcaaaagtggtaggctttctgaaccctacaagggtattggagactgctttgcccggacgatgaaagatgagggtgtcatctcactgtggagaggaaacacagctaatgtcatccgttacttccccacacaggcattgaactttgcattcaaggaccacttcaagcgcatgttcaacttcaagaaggacaaggatggatactggaaatggtttgctggaaaccttgcttctggaggagctgctggtgcttgctctctcttctttgtttactctctggactacgctcgtacgcgtttggccaatgatgccaaggctgcaaagaagggtggtgggaggcagttcaatgggctcgttgatgtttacaaaaagacccttgccagtgatggtatccgtggcctctaccgtggattcaatatctcttgtgtaggaatcattgtgtaccgaggtctttactttggaatgtacgactccctcaagccagttcttcttgttggtaccctacaggacaacttctttgccagcttcttgctcggctggggtataacaattggtgctggccttgcctcgtaccccatcgatactgtccgccgtcgtatgatgatgacgtctggtgaggctgtcaagtacaacagctccttggatgccttcaagcaaattgttgcaaaggagggcaccaagtccctcttcaagggtgctggtgcgaacatcctccgtgctgttgctggcgctggtgtccttgctgggtatgacaagctccaggtgatcgtctttggcaagaagtacgggtctggcggcgcctaagagtagatgatggtgaacaaaagaaaggatgtttagttggtgcctttgcatagcttatgtggaccatggacaccatttctaaatctagcacttgcacagactgtgactggttttgttatgcggtttggattctgtggctcgtcgttttctggagatctgaaataagctactgagttagaaattgcggaccttaatgcttggagacatgttcatccccattgtgactttacatgttctacatcattttgctggatggttgattgcatggtctaatttgacactgttgttaaactttgttgaatcttcccacaagatgttaccgtacccaatgttgcaaaaatgttggccgtgagggataaatcaaccttctgttttcatttc

SEQ ID NO: 667 - DNA, 2455 bp, Zea mays
gtggcccaccccacctccttccgagctccgaggagcgatcggcagggcgcgcctctggccgctttgtcgcgacgcgcgttcgctccaatcctgtcgcggccattaaaagccttcccggctttcccgctcagctcgtctcttccagaaacgtacctcgtcatctcttcgccttcgctacgcaattccgatccacgctgcgggccacttgtgacgactggcggaacccgcgagaaacagaggcgggcgagcggcgatcggagatggcgccggagaagccccggaaggaacaggaggaggagttgatgctggaggatggaggcatcgaggagagcccgcgccgcagcttcgaggactgcggcgactccgaggaggaccgcggggagggcgatgacgaggaggagcgggacagcgaccgcgacggcgtcggttcgacgcgctccttcctgccccaaaagtggccgcagagctacagggaaacaactgacacctacacaatcgctgcatcaccgagctttggttacttaggttcttctacaagcaaatactcgctcctcgaccttggtcgcagtattctgggctctgacctgaagtcacctctaatatcggccaaggctgattctgtcagaaacttgccgaaaacccttggttcaatgagagatgggagagtctcgtttcaattgcaacacacgggagaaatctacattagtcaagggtgcaatgtgacgcaaacagtcttcaacgggattaatgtgcttgctggtgttggccttctttccactccgtttacaattcatgaagctggatggactggccttgcagttctagcatgctttgcgattgtttgctgttatactggaattcttctaaaacattgttttgagagcaaagatggtatctcaagttatccagacattggagaggctgcatttggaagaattggccgtgtgttgatatctattattttgtataccgagctatattcatactgtgtggaattcatcattttggagggtgataacctcacatcaatttttcctaaagctggttttgattggcttgggattcatgttgatggaaaacattttttcggagtgttaactgctattttagtcttgccaacagtatggctgcgagatcttcgagtactctcgtacctttcagcgggtggtgtgattgcaactcttctcgtattcctgtccgttggtttagtcggtgttaccgatggtataggcttccattcaactgggaaggcagtaaactggagtggcatgccttttgccattggtatttatggattttgctactccgggcattcggtatttccaaatatctaccagtcaatgtccgatagatctaagttccctaaggcactgttcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatttagttgtactgtagcaagttcctgtgctgccgattgttcctaggataagcttctgccttttacagttgaggcatctatatatacggcgacgactactgtacaatcagagtacaccttatgtacagtcaggatcagctagcactatattcttagaacttggtcgagtgcagcgaggatgcatgttcgttggccttttatggtgcccccatggtcgaagccatagcctgagcatgataatggcgccatgcactgttgtcttgtatcatatgcgctgttctatctcaagttctttttgaaggaagcaggcttgatttgtttgtagtgtgacgttttgtgtgtcaatgcaaaagaataatttggtga

SEQ ID NO: 668 - DNA, 2129 bp, Zea mays
cgagtagcagagtctggccgccttgtcccgacgcgcgatcccatcccttcccatccagcgcggctccaatcctgtcgcggccattaaaagcttccctcccctgcctctctgctccgctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggatgagttgatgctggaggatggaggcatcgaggagagcccgcgccgcagcttcgaggactgcggtgattccgacgaggaggacgatgacaacgatgaggagcgggacggcgacggcgtcggttcgccgcgctccttccagtcccacaagtggccgcagagctacagggaaacaactgatacttacacaatcgctgcatcaccgagctttggttacttgggcccttctacaagcaaatactcactcctcgatcttggtcgtagcggtctgggttctgacctgaagttgcctctattgtcggacaaggctgacggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgcaggcgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttatataccgagctatatacatattgtgtggaattcattattttggagggtgataacctcacaacaatttttcctaaagctggaattgattggtttggcattcatgttgatgggaagcattttttcggagtgttaactgctattttagtcttgccaacagtatggctgcgagatcttcgagtgctctcttacctttcagcgggtggtgtgattgcaactcttctagtattcctgtccgtcggtttagtcggtgctaccgatggtataggcttccattcaactgggaaggtagtaaactggagtggcatgccctttgccattggtatttatggattttgctactctgggcattcagtatttccaaatatctaccagtcaatgtccgatcgctctaagttccctaaggcactgttcatatgttttgcaatttgtacagctatgtatggatcttttgctgtcattggctttctcatgtttggagagaacacattatcccaaatcactttaaaccttccaaagcattcgattgcctcaaaagttgcactatggaccacggtgatcaaccctttcaccaaatatgccttgctgttaaacccactagctcgaagtttagaagagttgcgtcctgaaggttttttgaacgaaacatcatgctctattatactgaggactgcccttgttgcgtcaactgtatgcattgcctttcttctgccgttctttggtcttgtgatggctctcattggatctcttcttagtatacttgtggcggtcataatgccagccctgtgcttcctgaagatcgcacaaaacaaagcaacctgtccacaggtgatcgcgagcgtcggtatcgtaatactgggcgtcgtcagcgccgcgctggggacctactcgtccgtgaaaaagatcgcagaaaactactaggctcttgggacagtttctctccgcagaggctactaccacacggttgcacgtacgtccggccggagctggggaatggtcagggtttacgtacacgatctcaaagttttgctagaactaccgaaattccctgtagattattactgttatgattcggaccacaatagtctacttatacaaacaaaaaaaaagaactgcatcatcacatcacttggaataatgtaatcatgccctccttttttt

SEQ ID NO: 669 - DNA, 2182 bp, Oryza sativa
cactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccggaaggaggaggaggaggacgaggaggagatgacgctggaggacggcgacatcgaggagagcccgcgccgcagcttcgacgacgactacgaggacggcgggagcggcgacgacgaccgggatgacgacggcgaaggtttgggatcgcctcgctcgttccagtcccgccagtggccgcagagctaccgagaaacaactgacacctatacaattgctgcatctccgagctttggttacttgggtccctctacaagcaaatactcgatccttgatggtggtcgtagtagtctgggatccgacctgaagttgcccttgttgtctgataagctagatgggaagcaagactctgtcaagagcttgagaaagactcttggttcagcaatagataggaaaagctcgttacttacgcaacatactggagaagtctacatcgctcaaggatgcagtgtgacacagacggtgttcaatggggttaatgtacttgctggtgttggacttctttccactccatttacaattcatgaagctggatgggtaggccttgcggtcctagctatgtttgctattgtttgctgttatactggagttctgatgaaacactgttttgagagcaaagatggtatttctacatatccagacattggcgaggctgcttttggaaggattggtcgtctgctgatctctattatactctatactgagctatattcatattgtgtggaattcattattttggaaggagataatatgacatcaattttctctcatattggttttgattggcttggcgtccatattgatgggaaacatttctttggagtgttgactgctctaatagtcttgcctacagtatggttgagagatcttcgggttctctcctacctttctgcgggtggtgttattgcaactcttcttgttttcctctctgtcgttttagttggcgctactgatggcgtagggtttcatttgactgggaaagcagtaaacttaggtggtataccgtttgctattggcatttatggtttctgctactctgggcactcagtgtttccaaatatttaccaatcaatgtcagaccgcacgaaattcactaaggcactgtttatatgctttgcaatttgcacagcaatatatggctcgtttgctatcattggctatctcatgttcggagataaaactctctcgcaaataactctgaatcttcctaaacattcatttgcctccaaggtcgcactgtggaccacggttatcaaccctttcaccaaatatgccctgttgttaaacccattggctcggagtttagaggagttgcgccctgaaggatttttgaacgaaacaatctgctctattatactgaggactgcccttgttgcatcaaccgtgtgcattgcgtttcttatgccatttttcggtctcgtgatggctcttattggatctctgttgagtatacttgtggccgtcataatgcctgcactgtgcttcttgaagattaggcaaaataaagcaacgactgcccaggtcgttgcaagtattggtataataatattgggcaccataagcgctgctcttggaacatattcgtcggtactcagaattgtggagaactactaattacgaaacctagctcgcgtgcagtgcagttcccagcaggtgaggccacaggcatgtcatatctattactcaccccgcttacggttacggcgctcaaaaatggtcaaatatcgtgtgtttatcagaattttgctagaattaccgagttcactgtaattattcgacccaaccatgtaatgcatgtacctgcatagctgcttgcttctcagttccttgaagtggaatatcttcatcacttgcttataccgtgtttctgtcaatcactgttgttaggtctatccagcatgttacttaaaccgcctttagcaattatatgtactcaattaattatagatcgagattgctggatattgagtgttgcaacttgcaa

SEQ ID NO: 670 - DNA, 2167 bp, Sorghum bicolor
cgagcagcgagcagtgagcaggacgcgcctctcctctggctggccgccttgtcgcgacgcgcgatcccatccccatccggcgcggctccaatcctgtctgtcgcgtggccattaaaagccttccccctgctccgctcgtctcttccggaaccgtccctcgctcgccttcgccacgcaattccgatccacgctgcgcgcgggccagttgtgacgactgcgaaactcgtcaaagagagagagaggcgggcggcgatcggagatggcgccggagaagccccggaaggagcaggagcaggagaaggaagaggaggagatgttgctggaggatggaggcatcgaggagagcccgcgccgcagcttcgaggactgcggcgattccgaggaggaccgcggggaggacgatgacgacgatgacgaggagcggcaccgcgacggcgacggcgtcggttcgccgcgctccttccagtctcaaaagtggccgcagagctacagggaaacaactgacacctacacaatcgctgcatcaccgagctttggttacttgggcccttctacaagcaaatactcactccttgatcttggtcgtagtggtctgggctctgacctgaagttgcctctagtatcggacaaggctgatggaaagcaagattctgtcaaaaacttgccgaaaacccttagttcaataagagatgagagagtctcatttcaattgcaacacacgggagaaatctacattagtcaagggtgcagtgtgacacaaacagtcttcaacgggattaatgtacttgctggtgttggccttctttccaccccgtttacaattcatgaagctggatggactggccttgcagttctagcatgttttgccatcgtttgctgttatactggaattcttctgaaacattgttttgagagcaaagatggtatctcaagttatccagacattggggaggctgcattcggaagaattggccgactgttgatatctattattttgtacaccgagctatatacatattgtgtggaattcattattttggagggcgataacctcacatcaatttttcctaaagctggttttgattggcttgggattcatgttgatgggaagcattttttcggagtgataactgctattttagtcttgccaacagtatggctgcgagatcttcgagtgctctcatacctttcagcgggtggtgtgtttgcaactcttctcgtattcctgtccgttggtttagtcggtgctactgatggtattggcttccattcaactgggaaggtagtaaactggagtggcatgccctttgccattggtatttatggattttgctactccgggcattcagtatttccaaatatctaccagtcaatgtctgatcgctccaagttccctaaggcactgttcatatgtttcgcaatttgcacagcaatgtatggctcttttgctgtcattggctttctcatgtttggagagaacactttatcacaaatcactttaaaccttccaaagcattcagttgcctcaaaagttgcactatggaccacggtgatcaaccctttcaccaaatatgccttgttgttaaacccattagctcgaagtttagaagagttgcgtcctgaaggctttttgaatgaaacatcatgctctataatactgaggactgcccttgttgcatcaactgtatgcattgcgtttcttctgccgttctttggtcttgtgatggcgctcattggatctcttcttagtatacttgtggcagtcataatgccagccttgtgcttcctgaagatcgcacagaataaagcaacttgttcacaggtaattgcaagcattggtatcataatattgggcgtcatcagtgctgccctggggacctattcgtccgtgaaaaggattgcagaaaactactaagctcttggacagtttctgtctgcagagtctaccacccgattccaaggatggaactcgaaatggtcaggtttcactacgatcaaaattttgctagaactaccgtgtttcctgtagattattattactattattatttggaccacaatagtctactaaaaaactgcatatcacttgcaataatgtaatgtaatcatgccccccttttagctgcgtctctttcatttcggtgtactgtagcaagttcctgtgctg

SEQ ID NO: 671 - DNA, 1216 bp, Sorghum bicolor
accgccatgggcatggaggagtacaaaccgtgtgcggccatggtggtgacgcagtgcatctacgcggctctagcgctctggtccaaggcggcgttcaccggcggaatgagccccctggtcttcgtcgtctacaggcaggccgtcgccaccattgtgctcgtccccgtcgccgtcgcggccaacaggaggaagatgaaggagatgatgggccgccttggaatgacaggcttctccttggtcttcgtcgcctctcttgtcggggcgacagtgaatcagtgtttgtactaccaaggggtgaatctgggctcgtcgtcgatggcaacggccatgaccaacttgattccggccatcaccttcgtcatggcagcatcagtcggaaaatgtgaaatctgctgctactgtcgcctgatgtctccatccatctctgattccctgaatcaacgacaggctagagagggtggaggtgaggaggcctcggagcctcgccaagatcttcggcacggccgtctgcgtgagcggcgccatggccatggccttcttcaagggcccgaagctgctgctgggcgacctgcacgacgctctcctcctccccctccactcgccggcggcgggcggcggcagcagcaggtgggtggcgggcgcgctcttcctggtgggcagcagctcctgctggtcgctctggctcatcctgcaggtgcccatctgcaagtcgtacgtggacccgctggcgctgtcggcgtggatgtgcctcctctccacgctccagtccgcgctgctcgtcgccttcctcctgccggaccctgccgcctggcggatccactcgctcttcgacctctcctgctgcctcttctcgggggtgttggggtcaggcgtcacgttctacctgcagtcgtggagcatctcggtgagaggcccgctctactccgccatgttcaacccgctctgcaccgtgatcaccaccgtcttcgccgccgccgtcctccgtgaagagctgcacgtcggcagcttgctgggcgcgatcgccgtcatcgcggggctgtacgtggtgctgtggggcaaagcgggcgacgccaagaggcgggggctgcaggaccaggagccagagcagcactcggacgacgacttggagaagacgtcggcgcggtcggattcgatggtcgacgtcggcaatggcatcgccgagcccctcctggccggcggcgatccaacggcgaag

SEQ ID NO: 672 - DNA, 1328 bp, Saccharum officinarum
cgagatcgatcgatcgagccagtaagccaaaacaaccggccgtaacgaacgccaggcgccggcaggctctgcagcagctgcagacgacgccaccgccatggaggagtacaaaccgtgtgcggccatggtggtgacgcagtgcatctacgcggctctagcgctstggtccaaggcggtgttcaccggcggcatgagccccctggtcttcgtcgtctacaggcaggccgttgccaccattgtactcgtccccgtcgtcatcgcggccaacaggaggaagatgaaggagatgatgggccgccttggaatcacaggcttctccttggtcttcgtcgcctctcttgtcggggcgacagtgaaccagtgtttgtactaccaaggggtgaatctgggctcgtcttcgatggcaacggccatgaccaacttgattccggccatcaccttcgtcatggcagcatcagtcgggctagagagggtggacgtgaggaggccgaggagcctggccaagatattcggcacggccgtctgcgtcagcggcgccatggccatggccttcttcaagggcccgaagctgctgctgtgcgacctgcacgcgctcctyctcctccactcgccggcggcggccggcggcaggtgggtgacgggcgcgctcttcctggtgggcagcagctcctgctggtcgctctggctcatcctgcaggtgcccatctgcaagtcgtacgtggacccgctggcgctgtcggcgtggatgtgcctcctgtccacgctgcagtccgcgctgctcgtcgccttcctcctgccggacccgaccgcctgaaggatccactcgctcttcgacctctcctgctgcctcttctcgggggtgttcgggtcaggcgtcacgttctacctgcagtcgtggagcatctcggtgaggggcccgctttaytccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaagatggggccgcaagagccagagcagcacccggacgatttggagaagacgtcggcgcggtcggactcgatggccgacgtcggcagtggcatcgccgagcccctcctggccggcggcgatgatccaacggagaagtagaggggattttgctcctcagggttcgwtatgctagctactggcgcagcgcagtgccgtcccatttttgtcatgtactactagcagyttcaaatgcccggttggtggagtttgactt

SEQ ID NO: 673 - DNA, 1420 bp, Panicum virgatum
ccacagccagatcgagccaccgagcgaaaccaaaaccggcagcgcccggcgttgcagccgcgcgcagctagccgccatggaggagtacaagccggcggcggccatggtggtgacgcagtgcatctacgcggcgctggcgctgtggtccaaggcggcgttcaccggcggcatgagccccctggtcttcgtcgtctacaggcaggccgtggccaccatcgtcctcgtccccgtcgtcgtcgcggccaacaggaagaagatgaaggagatgacgacgggccttggagtggtaggcttcgtgttggtcttcgtcgcgtctcttgtcggggcgacggcgaatcagtgtttgtactaccaaggggtgcatctgggctcgtcgtcgatggcaacggccatgaccaacttaattccagccatcaccttcgtcatggctgcatcagtcggccttgagaaggtggaggtgaggaggccgaggagcctggccaagatattcggcacggccgtctgcgtcggcggcgccatggccatggccttcttcaagggccccaagctgctcggcgggctgctcgccctcctccactcgccggcgccgggcagccggtgggtgacgggcgcgctgttcctcgtcggcagcagctcctgctggtcgctctggctcatcctgcaggtgcccatctgcaagtcgtacgtggagcccctggcgctgtcggcgtggatgtgcctcctgtccacgctgcagtccgcgctgctcgtctccttcctccagccggacccgaacgcctggaggatccgctcgctcttcgagctctcctgctgcctcttctcgggcgtgttcgggtcgggcgtgacgttctacctgcagtcgtggtgcatctcggtgaggggcccgctctactcggccatgttcaacccgctctgcaccgtcgtcaccaccgtgttcgcggcgaccgttctccgggaagagctgcacgtcggcagcttgttgggggccatcgccgtcatcgcggggctgtacgtcgtgctgtggggcaaagcgggcgacggaggcaggagagggagggagacggagcacacggacgatttggagaagacgatgacccggtcggattcgatgctcgacgccgggaacggtatcgccgagccgctcctgccggcggatggcgatctaacggagaagtagatgcttttctttttcagccgctaccagctagcccgtttcagagctcatcacggctgtgtgagccagcagtttcggagtgtcttctccgtcattgtgtatcatctatgagtgcagtgcgctctcattttggtctctagcccgcacgaaataattagaattaatataaaaataaattttatggttaataaatatagttatatatctatattctcttgcatctattaaatattataatacatattt

SEQ ID NO: 674 - DNA, 1300 bp, Panicum virgatum
ggcggccatggtggtgacgcagtgcatctacgcggcgctggcgctgtggtccaaggcggcgttcaccggcggcatgagccccctggtcttcgtcgtctacaggcaggccgtggccaccgccgtcctcgtccccgtcgtcgtcgcggccaacaggaagaagatgaaggagatgacgacgggccttggagtggtaggcttggcgttggtcttcgtcgcgtctcttgtcggggcgacgatgaaccagtgcttctactaccaaggggttcatctgggctcctcgtcgatggcaacggccatggccaacttaattccagccatcaccttcgtcatggctgcatcagtcggcattgagaaggtggaggtgagaaggccgaggagcctggccaaaatattcggcacggccgtctgcgtcggcggcgccatgtccatggctttcttcaaaggcccgaagctgctgcacggcggcctgcacgcgctcctccactggccgccgtcgtcgggcagccggtgggtgacgggcgcgctgttcctcgtcggcagcagctcctgctggtcgctctggctcatcctgcaggtgcccatctgcaagtcgtacgtggagcccctggcgctgtcggcgtggatgtgcctcctgtccacgctgcagtccgcgctgctcgtctccttcctccagccggacccgggcgcctggaggatccgctcgctcttcgagctcgcctgctgcctcttctcgggcgtgttcgggtcaggcgtgacgttctacctgcagtcgtggtgcatctcggtgaggggcccgctctactcggccatgttcaacccgctctgcaccgtcatcaccaccgtgttcgcggcgatcgttctccgggaggagctgcacgtcggcagcttgttgggggccatcgccgtcatcgcggggctgtacgtcgtgctgtggggcaaagcgggcgacggaggcaagagagggagggagccggagcacgcggacgatttggagaagacgatgacccggtcggattcgatgctcgacgccgggaacggcatcgccgagccgctcctgccggcggaaggcgatctaacggacacgtagatggttcttttttttatgcagtcgctaccacctagcccgtttcagagctcatcacggctgtgcgagccagcgccagcggtttccgggccaattgtatcatttgtgcagtgcagtgcactctcatttttgtcactagtctatcaacccgtgctccggcatagactaattaaaaataatataaaaataaaacttataactaataattataattat

SEQ ID NO: 675 - DNA, 1481 bp, Sorghum bicolor
aagttatgcttgctttgccttcagtccttttcgttcgcgatcccccccgcgcaccaacgcagcggagctggaggcgaggcccgagggtattcttccttccttcgccgctaagcacgccaccacgaggatccaactcaggcaagcgtcgccgtctccccctacccccgaatctgatgcttcatcgattggttccaatcctcaccacctccatagtcatgcacgagattgcgcgtgattaggaacagggaccaatcagattgcattcagatttgggggagcaggaggagccattgtcggtgttcttgtcgtcgtcggaggtcgagggatggtaggggtgctgtcgaatcgcgtggatcgggacgacctcaaggccggggatcacatctacacttggcgggctgcctacatctacgcccaccacgggatatatgctggacatggcatggttatccattttacaagggcagctggacatgagattggaacaggaacattcttggattggttcctttatagctcctctccggcagcaactgagggtcctccctgccagaaatgtggccacctagttaagtctgatggggtcatcacttcttgcctcgattgcttcttagatgggggtagcctgtacctgtttgactatgccgtgtcgcctgctttcttccttgccaaagctcgtggaggaacctgcaccctggctgcctctgaccccagtgatgttgtgatccaccgtgcacgatacctcctggacaatgggtttggcatgtactccctgttcaagaacaactgcgaggactttgccatatactgcaagactgggctgcttgtggagactgctttcagtgttggccgtagcgggcagcttgcttctctgactgctgccttcagtgctgtggcctcatcgccattgcgtttcctgacaaccagtgctggtggcctggcaattgtgaccagcggcatgtattgtgtcgggcgatatgtgtcggatattggtgttcggcgtgatgttgtcaaggtccctgtcgaaaggcttgtggaacagaatgttacttcgattcctcaaagtcgggctacagagacagatatcacatctggagcaccacagcagcagatggaggttccttgtgtggttgctgaggaagcatccattataccccccacagcgccgtgatccattggtgaaatgtcatataacaggtgttggcatgagacaagacaactggaactacttgtgtggaagtatatgtaatgatgtatgtatctggtggtgttatgtaatccatggtagttgctgctaatgttccaagcaagcaatgatgatgttggatgtgattccattgccgttattattacagaatttaaaagacctgtatttgcactcaattatgcaggagcttgatgatgtctgttatacagttgcttatggatgcatctaatctaattgtgcaaagttgctatacattagcaatcttgacaatttc

SEQ ID NO: 676 - DNA, 1502 bp, Saccharum officinarum
  misc_feature (6)..(6): n is a, c, g, or t
gcaggntctgaattccttggtcgacggacgcgtgcgcgtttcttcccgatcctccgcacccacgcagcggagctggggggcgaggcccgagggtattcttccttcgccgctaagcacgccaccacgagcagccaaccaaggcaagcgtcgccgtctccccctaccccgaatctgatgcttcatcgattggttccaatcctctctacctccatagtcatgcacgagattgcgcgtgattaagaacagggaccaatcagattgaattcagatttggggcggagcaggaggggagccattgccggtgttcttatcgtcgtcggaggtcgagggatggtaggggtgctgtcgaatcgcgtggatcgggacgacctcaaggccggggatcacatctacacttggcgggccgcctacatctacgcccaccacgggatatacgctggagacggcatggttatccattttacaagggcagctggacatgagattgggacaggaacattcttggattggttcctttatagctcctctccggcagcaactgagggccctccctgccagaaatgtggccacctagtcaagtctgatggggtcatcacttcttgcctcgattgcttcttagatgggggcagcctgtacctctttgactatgctgtgtcgcctgctttcttccttgccaaagcacgcggaggaacctgcaccctggctgcctctgaccccagtgatgttgtgatccaccgtgcacgatacctcctggacaatgggtttggcatgtactccctgttcaagaacaactgcgaggactttgccatatactgcaagactgggctgcttgtggagactgctttcagtgttggccgcagcgggcagctaacatctctgactgctgccttcagtgctgtggcctcgtcgccattgcgtttcctgacaactagtgctggtggcctggcaattgtgaccagcggcatgtattgtgttgggcgatacgtgtcggatattggtgttcggcgtgatgttgtcaaggtccctgttgaaaggcttgtggagcagaatgttacttcgattcctcaaaatcgcgctacagagacagatatcgcagcaggagcaccgcagcagcagttggaggttccttgtgtggttgctgacgaagcatccattatatcccccgcagcaccgtgatccatcgatgaaatgtcgcagcctgtgttggcacgagacaagacaactggaactacatacttgtgtggaagtacatgtaatgatgtatctggtggttttatgtaatccatggtagctgctgctgatgttccaagcaagcaacgatgatgatgaatgtgattccatggccgttattattacagaattgaaaacctatatttgcactcaattatgcagaagcttgattatgtatgttacacagttgcttatgaatgcatctgattgtgcactttccaagttgctatacattagcaatcttgacgtgctcttcacttaaaaaaaaaaaa

SEQ ID NO: 677 - DNA, 1762 bp, Malus domestica
attaccactattgttgccactcctgtaccaacatttgaaaggcggcaacgccattgcttcgggacctccacccccggagagttccctttagctgcaaacccctccattgtcctccatgtccttactgcctgcaatttggatcctcaagaccttgcaaagttagaggcaacatgttccttttttaggcatcctgcgcactttgctcctgactttgaattgtccatatcggagcttgctgctctggacatgtgccgaaaaagagctatatttaagccaatgacagccgaacagcgtcaagaattgaagcaaagatgtgggggttcatggaaacttgtcctgaggtttttgttggctggagaggcatgttaccgaagggagaaatcacaggcaatagcagggcctggtcacagcattgctgtgacttcaaaaggatctgtctactcatttggctcaaacagctcaggacagcttggacatggcacaactgaagaggaatgccggcctcagccaatcagatctctgcaaggcattcgaattattcacgcagctgctggggctggcaggacaatgctgatcagtgatgcggggaaagtttatgcctttggaaaggactcttttggcgaaactgagtacggggttcaaggatcgaagctggttactactccacagttggttgagtctttgaaagacatatttgtggtacaagctgcaataggaaatttcttcacggctgtgttgtcaagagagggcagggtgtatacattttcttggggcaacgatgccaaactcggtcaccaaactgagccaactgatgttgagcctcatcctttattgggagcacttgagaatgtacctgtggtgcaaattgcagctggatactgctaccttcttgctctggcttgtcaacctaatggcatgtcagtttactctgttggctgtggcttgggagggaagcttggacatgggttaagaactgatgagaagttcccccgacttattgaacaatttcaggttttgaaccttcagccgatggtggttgctgctggtgcttggcatgccgctgtggtggggcaggatggacgcgtctgcacttggggttggggccgttatggctgcttgggtcacgggaatgaagaatgtgaatcagttcctaaggttgtggaagcattgagccaggtgaaagcggtgcacgttgctacaggggattacacaacctttgtggtctcagatgacggtgatgtgtactcatttggttgcggagaatcagctagtcttggacatagtactgccgccgatggacagggaaataggcatgcaaatgtgttggcaccagagctagtgacatcactgaagcaagtgaacgagcgggttgtacagatcagcctcaccaactccatatactggaacgcccacactttcgcactaaccgaatcagggaagctatacgcatttggggccggagacaaagggcaactaggcattgaacttgttgccaaccagaccgaaaggggaaagccagagctggtcgatattgatctcagatagagttcatcaatatctttggtattcccggccacaccataatgctctatcctctaatttatcatcataactcattgcatttgatgtttgcattcccatgtctattgtgtacatagaaacaaaaaattgtgaagtttaaaggttattaggttataggggcctaaaccagattgctaaatggttgtttatatctgaaaatttggcttgctcttaggcttcc

SEQ ID NO: 678 - DNA, 2083 bp, Castanea mollissima
taattttttggttaaaggaacaaaaaaaaagttagaaattctatgcagttgttgacagatgcagatgggttttgaggaatcctgggtttctctgatatgtttgagacttgaagtttgctgatcaatatatattataagcaaattagatctattcatcagcctaatttgggcactgcaaactgtggcagtgcccatggatgcaacgacgagtggaaccccaactattcaataccataacattactgaccagccagttactactattgttgccacacctgtaccggcatttcaaagacagcaacgccattgctttggggattccatccccggagaattccccttgtctgccaatccttccattgtccttcatgtccttacggcgtgtaatttggatcctcaggatcttgcaaaactagaggcaacatgctctttcttcaggcagcaagcaaactttgcccctgacttcgagttatccttatcggagcttgctgcccttgacatgtgccaaaagagggccatatttaggcgaatggcaacagaagaacgcctagattttaagcaaagatgtgggggctcatggaagctggtcctgaggttcttgcttgctggagaagcatgttgcaggagggagaaatcgcaggcaatagcaggaccaggtcacagcattgctgtgacatctaagggaagtgtttacacattcggctccaacagctcaggacagcttggacatggcaccactgaagaggagtggcgacctcggcctatcagatctttgcaaggcattcgaattatccaagcagctgctggtgctggcaggacaatgctgatcagtgatgccggcctggtttatgcctttggaaaagaatcatttggcgaagccgagtatggagttcaaggtggtaaattggttacaactccattgctggttgagtccttgaaaaacatatttgttgtgcaagctgcaattggaaatttcttcacagctgtcctgtcaagggaaggcagagtttatacattttcttggggtgatgatttcaagcttggtcaccagactgatccaaatgatttggagccccatcccttgttgggggcactcgaaaacataccagtggtgcaaattgcagcaggatactgctaccttcttgctctggcttgtcaacctagtggcatgtcagtatactctgttgggtgtggcttgggtgggaagcttggacatggttcaagaactgatgagaagtacccccgattgattgaacagtttcagcttttgaaccttcagccaatggtggttgcagctggggcttggcatgccgctgtggtagggcgggatggacgggtgtgcacatggggttgggggcgttatgggtgcttgggtcacggtaatgaagaatgtgaatcagttcctaaggtcgtggaatccttgagcaatgtcaaagccgttcatgtcgctacaggggattacacaacctttgtggtgtctgatgacggtgatgtttactcctttggctgtggagaatctgccagtcttggacatagtaatggtgctgatggacagggaaacaggcatgcaaatgtattaagtccagagctggtaacatcattgaagcaagttaatgagcgtgtggtacagatcagcctcaccaattctatatactggaatgcccacacttttgcccttactgaatcagggaaactatatgcattcggtgctggagataaagggcagctgggcatagagcttgttgccaaccagagtgaaaggggaaacccggaacgggttgatattgatctcagctaggatcattagtagctttacctgcccactgcttgcaccatgcttatcttctaatttatcatagcatgcattgcatttggtgtttagatttccttgtttattctgtaaatagaaacaaagaagaaaaaaaattgtgaatgttcaagctaggtaacaaacacaggcctaagcagatgctacatggttgtttatatctgaaaacttggcttgctcttaggcttcaagtagttgatagttgatacatttgtcaaagttgatttataacatgttctatcgtttaattgattt

SEQ ID NO: 679 - DNA, 2508 bp, Gossypium hirsutum
acgttggctttatccctcgttgtatgatccgactctgcactatttggttttgggataaatttgcacaagtggttttttctttttaaaaatgcccttttgtttatgatttgtgaaatgatcacatagtttgtggtataaattgttttttacccttttctcttgtgattttaaggagttcatatgaaaaccgtaggtttgagacttgaagtttgctgatccaatccattatttaaggtagatatttttggcacttgtagattgaactaataagtcaacacaggtttagtatttaggaggcagtttggatcattggagggtttcttagtgattattgtacccatgtttcctaattgtcagcaatttagataatcttatttgccaagtttgggcacttcaaaagttgggcagtgcccatggatgccacaacaagcggaacccctaccgtacaataccataacatgcctgatcagccaattacagctattgttgctgcccctgtttctgcatttctgcgacaagtacgccattgcttcggggactccactcctggagaattccccttagctgccaatccttccmttgttcktcmtkkyctsaccacgtgtaatttggatcctcaagatctcgcaaaactagaggcaacatgctccttttttaggcagccggcaaactttgcccctgattatgaattgtccatatcagagcttgctgctcttgacatgtgccaaagaagagctatatttaagccaatgactgatgaagaacgtcaaagtttgaagcatagatgtggggggtcgtggaaattggtcctgaggtttctgctggctggggaagcatgttgcaggagagagaaatcacaggcgattgcagggcctggtcatagcattgctgtgacatcctcgggtgcagtttactcttttggctctaatagctcaggacagttgggccatggcaatacygaagaagactggcggcctcagcaaataagatctttgcaaggcattcgaattatccaagcagctgctggggctggcagaacaatgctgattagtgatgctgggagagtttatgcctttggaaaggattcctttggtgaagcagaatatggggttcaaggaactaaattagttacaactccccagcctgttgagtctttgaaagacatatttgtggttcaagctgcaattggraactttttcacagctgtgttatccagagagggcagagtttacacattctcttggggcaaagatagcaagcttggtcacaaaaccgagccaaatgatgtggagccccagcccctattgggggcacttgagaacatacctgtggtgcaaattgcagctggatattgctaccttctttgcttagcttgtcaaccaagtggcatgtctgtgtactctgtcgggtgtggcttgggtggaaagcttggacatggctcaagaacagatgaaaagtaccctcgattaattgaacaatttcaacttttgaacctccagccaatggtggttgctgctggtgcttggcatgctgctgttgttggtcgggatggaagggtttgcacatggggttggggacgttatgggtgcttaggtcatggaaatgaagastgtgaatcagttccaaaggtcgtagaggcattaagagatgtcaaagcagttcatgttgctacaggggactacacaacctttgtggtatctgatgatggtgatgtatactcttttggttgtggcgaatctgccagcctcggacataatactgctggtgaaggacagggaaacaggcatgccaatgtgttgagtccagagctggtaatgtcattgaagcaagtgaatgaacgggtggtacagatcagccttacaaactcgatatactggaatgctcatacatttgcactcaccgagtccgggaagctttatgcatttggtgcgggagacaaaggtcagctaggcatagagttagctaacaatcagacagaaagaggaaaccccgagcgggttgatatcgatctcaattaggaatccaatggcttctcctcccatttgcatacaccatgggtgattcattagattctggacaatcacgcattgcatgtggtgttttaagtttccctgtttattttgtaaatagaaacaagcaaaaaatgaaattgtgaagattttaagtttaggagtagcaaagggccttaagttggtctgatttcctaaraaaaaatggttascacatagccyttaakttgttaawasctraaacwtctcygttcaggttcattgatwacttatgttaaaattgcattcttaaaaaaaaaaaaaaaaaaaaaaaaaaaaaaaacctgaaaaaggaattttcaagaaggggggccccggggggcccccctccgaatttttttcccccccccggggggggggggggaaccaagggggaaaggggggacacccccaaattctcccccccccaaataaaagggaggaggctcgtaaaaaaataaaaaaaatttttttcgcgggg

SEQ ID NO: 680 - DNA, 2328 bp, Vitis vinifera
atagatatcatatacaagagggggaggggagacaacctcttggaaaagctaggggccttaatattattcatttactcttgaaagaggaaaaaaaattctcccttttctctcatacttcttccaaacaatccacccaaaaaccccactatcatctccattttcttcagaattacgcaacacagaatcctctcatcagattctcatttcaacgcccttcaatttgatctttttcctgttgtttttggcttcaaatccagtaattctcctcgtttattgaccgatgctgatgagttttcaggaatcctggtctctgggctatgttttgagacctgaagtttgctgatcagtacgtaacccaagttagatcgtctcttctgcataatttgggcactgcaaaactttggcagtgcccatggatgccacaaggagcgggacgcccactgttcaataccataacatacctgaccaaccaattgctgctattgtcacctccccattaccaacatttcaaagacaacaacgacactgctttggggactcaagccctggagaatttccattggctgccaacccctccattgttctccatgtcctcacggcatgtaacttggaacctcaggatcttgcaaagctcgaggcaacatgttccttcttcaggcagcctgcacactttgcccctgattttgaactgtccatatcggagcttgctgctctggatatgtgcctaaagagggccatatttaggccaatgacgctagaagaacgtgaagttctaaagcaaaggtgcggaggctcatggaaactcgttctgaggtttttgctggctggagaagcatgttgcaggagggagaagtcacaggcaatagcaggaccaggtcacagcattgctgtgacagtgaaaggagctgtttactcatttggctctaacagctctggacagcttggacatggcaccacagatgaggaatggaggcctcgccaaataagatctttggaaggcattcgcattatccaagcagctgcaggggctggcaggacaatgctgatcagtgatgctggccaggtttatgcctttggaaaggactcctttggggaagccgaatatggggttcaaggaactaaactagtaacaactccacaattggttgagtctttgaaaaacatatttgtggtacaagctgcaattggtaatttcttcacagctgtgctgtcaagagaaggcagggtgtatacattttcttggggtaatgatgccaaacttgggcaccaaacggaagtaaatgatttggaacctcatcctttgttgggggcactagaaaatataccagtggtgcaaattgcagctggatactgctatcttcttgctctagcttgtcagcctaatggcatgtccgtatactctgttggctgtggcttgggtgggaagcttggacatggcacaagaactgatgagaagcaccctcgactgattgaacaatttcggattctgaaccttcagcccatggtggttgcagctggtgcttggcatgctgctgtggttgggcgggacggtcgggtctgcacatggggttgggggcgttatgggtgcttaggtcatgggaatgaagagtgtgaatcagttccaaaggtagtggaagctttgattaatgtcaaagctgttcatgttgctacaggggattacacaacctttgtggtgtctgatgatggcgatgtctactcatttgggtgtggagaatcatccagtcttgggcataataatgggcctgatggacagggaaataggcatgctaacatcttaagcccagaattagtaacatcactgaagcagattaaggagcggatggttcagatcagcctcaccaattccatatactggaatgcccacacttttgcgctcactgaaacagggaagctgtatgcatttggtgcaggagacaaagggcagttgggtgtagagctcgttgccaaccaaactgagaggggaaatccagagcgggttgatattgatctcagctagggatattgcctcaccctcgtatcatctacaccaatgccattcctaatttatcatcaccaccatccacgatcatgctttgcatttactgtttatatttccttgtctattctgtacatagaaacaaaaaaggattgtgaaggatcaagctaggtagcagggggccaagcaaatgcattattgttgacttttaaagttaaaaaaagaaaaggttagtgcttaggcctcaagcagtgaatagctgatacatttgtccaggttcattttataacttatttatgttaaatgaattcataagttatctggttagcccc

SEQ ID NO: 681 - DNA, 2186 bp, Carica papaya
aaagggagaaaaaaaaaagcttcttgcacaaaaattcccttccttttctctctaaaaatccttcaaaatatcccaatcgaaatcgattaacataacagagcagactctaattagatacccacttctttgctcttcaatttgatccaagttttgctttttttgtttttgtgttaagaaagacgttgaattctcatcaattattgacagatgcagatgggttttgaggaatcatgggtcttttcaatatgtttgagtgttgaagtttgctgatcaaatactacattatctaagcaatttagatcctctacactgccaagttttgggcactgcaaatttgggcagtgcccatggacgctacaacgagtggcaccccgagtttacaataccataacatcccagaccagccaattactgctattgtacctgcatctgtacctacatttcaacgccaaactcgtcattgcttcggggactccactcctggagaattccccttagccgctaacccttccattgtccttcatgtgctcaccacctgtaatttagatcctcaggatcttgcaaaacttgaggcaacctgctccttcttcaggcagccagcaaactttgcccctgactttgaattgtctatatctgagcttgctgctctggacatgtgccagaagagggctatatttaaacctatgaatgaagtagaacgtcaagaaatgaagcggagatgtgggggatcatggaagttggtcctgaggtttttgctggctggagaatcatgttgccgaagggagaaatcgcatgccattgctggccctggtcatagtatagctgtaactacaagtggacttgtgtactcgtttggctccaatagctctggacaacttggacacgggacctctgaagaggaatggcgacctcgcctaatcagatccttgcaaggcattcggattatccaagctgcagctggtgctggccggacaatgctaattagtgattctgggcaggttttttctttcggaaaggactcgtttggcgaaactgaatatggggttcaaggaagtaagcttgttacaactccacagctggttgagtctctgaagaacatatttgtggtgcaagctgcaattggaaatttcttcactgcagttctgtcaagagagggcagggtttatactttttcatggggtaatgatggcaaacttggtcatcaaactgagccaactgatttggagcctcatcctttgttgggtgcacttgagaatgtaccggtggtacaaattgcagctggatattgttatcttcttgctctggcttgccaacctagtggcatgtctgtgtactctgttgggtgtggattgggtggaaaactcgggcatggttcaagaacggatgagaagtacccccggttaattgagcagtttcaagttctgaaccttcagccagtggtggttgctgctggtgcttggcatgctgctgtggtagggcgagatggacgagtttgcacatggggctgggggcgttatggatgcttaggtcatggaaatgaagagtgtgaatcggtgcctaaggtggtggaagcactaaacaaggtgaaagcagttcatgttgctaccggggattacactaccttcgtggtgtctgatgatggtgatgtttactcatttgggtgtggcgaatcagctagtctcggacataatactgttgctgatgggcagggcaacagacatgcgaatgtgttaagcccagagcttgtaacatcgttgaagcaagtgaatgaacgtgttgtgcagatcagccttacgaattcaatatactggaatgctcacacatttgcactgacagagtcagggaagttgtatgcgttcggggcaggagacaaaggacagctagggatagagctagttaacaatcaaagtgaacgagggaacccagagcgggttgatattgatttgagttagcaattgaattgctatcatgggcatttgattcattgcatttggtgtctactttgtacatagaaacagacagaagaaagaattgttaagaattaattaaggtagggtagcaggggccaaaccaaacactacattaactggctaatctcaaagtggtttaccaaacagcccctcccaagctgttaatagttgatatctttctcaaccaagcttcatttataacctacctttacattg

SEQ ID NO: 682 - DNA, 2244 bp, Populus trichocarpa
atttttgcatccactgatctcccttttgagattttctcagtttgctctttgatcaattaaaggtagagctttcagtcttgaaacatttatgtttttttcttgatttggttcactggtgattggctggccagatcagggagaaacaggaggaacaacatggggtttcttggaaaatcttgtaggggctttttgtttcccatttgttgacttgttggcagagaatttaaagaaaaaataaagggtttgcagaaacagaggatattgaaccagagaagcaggggagactgagaatttgagatttgggcactgcgataatttggcaatgcccatggatgccactacgagtggaaccccaactatacaataccataacatcaatgatcaacctgtcactgtcacagccattgttgctgttcctgtttcaacatatcagcgaaatcagcgccattgttttggggacttgattcctggagaattcccgttagctaccaatccatcaattgtccttcatgttctcaccgcgtgtaacttggatcctcaagatcttgcaaaactagaggcaagcaacatgctccttctttaggcagccagcaaacttcccccccgacaatgaattatccatatcagagcttgctgctctggatatgtgtcaaaaaagagccatatttaagccaatggcacctgaagaacgccaagatttgaaacaaagatgcgggggctcgtggaaactggtcctgcgatttttgctggctggagaagcatgttgcaggagggagagatcccaggcaattgcaggacctggtcacagtattgctgtgacatcgaatggagcagtttactcctttggctctaatagctcaggacaacttgggcatggcaccactgaagaggagtggcgacctcggcaaatcagatccctccgaggcattcgaattatccaagcagctgctggacctggtaggacaatgctgattagtgatgctgggcgggtttatgcctttggaaaggattcctttggtgaagctgagtacggagctcaaggatctaaaatggttacaactccacagctggttgagtccttgaaaaacatatttgtggtgcaagctgtgataggaaattttttcactgctgtattgtccagagaaggaagggtttatacattttcttggggaaatgatggcagaattggtcatcagacagagccaaatgatgttgaaccccatcctttgttgggggcacttgagaacattccagtggtacaaattgcagctggatactgttaccttcttgctctggcctgtcatcctagtggcatgtcagtatactctgttggatgtggcttgggtgggaagcttggacatggatcaagaactgatgagaaatacccccgattgatagaacagttccagcttttgaaccttcagccaatggtggttgccgctggtgcatggcatgctgctgtggtaggaagggatgggcgggtttgcacatggggttggggtcgctatgggtgtttgggccatggaaatgaagagtgtgaatcagttcctaaggtggtggaagcattgagcaaggtcaaagctgttaatgttgctacaggggattacacaaccttcgtggtttctgatgagggtgacgtatactcatttggttgtggtgaatctgctagtctaggtcataatgctgctgctgatgaacagggaaataggcatgtcaatgtgttaagcccagagctagtaacatcattgaaggaggtgaaggagcgagtagtgcagatcagcctaaccaattccatatactggaatgcccacacctttgcactcactgaatctgggaaactgtatgcatttggtgccggagacaaagggcagcttggtatggaacttgtcaacaaccaaagcgaaagggggaatccagaacgcgtggatgtggatctaaggtagaaattaattataccgcgtccccaccgttcctcctcgaactatgctagtatcatttaccatcatcacacattgcatttgatgtttagatttccttgtttattctgtacataggaaacagaaagacaattgttaagatttaagtctaggtagtaatggccaaagctcattcatgtatatgataacatttaaaaagatgactagtgcttggctgcaagttgttaataattcatgcattggttaacgttcatcaataacctgtttatgttgatctggatttcctaactcaattcatgttcactta

SEQ ID NO: 683 - DNA, 2560 bp, Populus trichocarpa
cctgaccggtttctatttcccttattttctctctatatatatatctaatctttgatcatcatctctcatattttcttcagatttttcatccattgatctcctttttgggattttctctgttttgttctttgatcaattcaaagcagagctttcactcttgaaacaaacttgttttttcttgctgatttggttcactggtaattgtctaatcagatcagggaaaacaggagaaaagatgggatttcttggaaaattttatgggggcttttctttttctatttgttgacttgtgggctgagaaattaaagaaaaaaaaaaaggttcgcagaaacagaggatattaggtccgagaagcagggaagactgagactttgagattttgctatttaaatcctctactctgccaagtttgtgcactgcgatcatttggcaatggccatggattccactacgagtggaaccccaactatacaataccataacatcactgatcagcctgttacagccattgttgctgttcctgtctcaacatatcaacgaaatcagcgtcattgctttggggactcaattcctggagaattccccttagctgccaatccatcaattgtcctccatgttctcaccacatgtaacttggatcctcaagatcttgcaaaactcgaggcaagcaacatgttccttctttaggcagccagcaagctttgcccccgactatgaattatccatgtcagagcttgctgctcttgatatgtgtcaaaaaagagccatatttaagccaatgacacctgaagaacgccaagatttgaaacaaaggtgtgggggctcatggaaactggtcctgagatttttgctggctggagaagcatgttgcaggagggagagatcccaggcaattgcaggacctggtcacagtattgctgtgacatcgaatggagtagcttactcctttggctctaatagctcaggacaacttgggcatggcaccactgaagaggaatggcgacctcggcaaatcagatccctgcaaggcattcgaattatccaagcagctgctgggcctggcaggacaatgctgattagtgatgctggggaggtttatgcctttggaaaggactcctttggtgaagctgagtatggagttcaaggaactaaaactgtcacaactccacagctggttgagtccttgaaaaacatatttgtggtgcaagctgcaataggaaatttcttcaccgctgtattgtccagagaaggaagggtttatacgttttcttggggcaatgatggcaaacttggtcatcagaccgagccaaatgatgttgtaccccatcctttgttgggggcacttgagaacataccagtggttcaaattgctgctggatactgttaccttcttgctctggcctgtcaacccagtggcatgtcggtatactctgttggatgtggcttgggtgggaagcttggacatggatcaagaactgatgagaagtacccacgattgatagaacagtttcagcttttgaaccttcagccaatggtggttgctgctggtgcatggcatgctgccgtggtaggaagggatggacgggtttgtacatggggttggggccgctatgggtgcttgggccatggaaatgaagagtgtgaatcggttcctaaggtggttgatgctttgagcaaggtcaaagctgttcatgttgctacaggggattacacaaccttcgtggtatctgatgatggtgatgtatactcatttggttgtggtgaatctgctagcctaggtcataatggtgatggtgatggacagggaaataggcacactaatgtcttaagcccagagctagtaacatcgttgaaggaggtgaaggagcgagtggtgcagatcagcctaaccaactccgtatactggaatgctcacacctttgctctcactgaatcagggaaactttttgcatttggtgccggagacaaagggcagcttggcatggaacttgttaacaaccagactgaaagggggaatccagaacaagtggacgtggatctaaggtagaaattaacaaaatgtcgtccccactgttccttcaaccatgctagtataatttatcatcattgcacattgcatttggtgtttagatttccttgtttattgtgtacatagaaacagaaaagaattgtggagattcaaggctaggtagtaatggccaaggctcaaccatgtatatgattcgacatttaaaaagatggttagtgtttgggccacaagtgtcaatagttcatgcattgtttaaggaaggttcgttaataacatgtttgtgttgatttggatccctgattcatttcatgttcacttgactgttagtagtggtgagtaggttttacagatttgggatcatcaacaaaatgtatcccaattactccgaccacggtggtcggcgaatccctccacaattcctcccatcttgggcaggtttgttttcgcttattgtaattttctaatagagccatccaaactaattaaaagaataaatgccttctcaatgtgctcttttagtgcctttatttc

SEQ ID NO: 684 - DNA, 1284 bp, Phaseolus coccineus
  misc_feature (1246)..(1246): n is a, c, g, or t
ggaattccggcttccttaagctccctagttctgcttcttgcagctctgcttctctcctcacaagggcttgctaactatgacaagcccccagtagaaaaacctccagtttacaagcccccagttgagaaaccaccagtgtacaagcccccagtagagaagccaccagtttacaagcccccagttgaaaaaccaccagtgtacaagcccccagtagagaagccaccagtgtacaagcccccagttgaaaaaccaccagtttacaaacccccagtagagaagccaccagtgtacaagcccccagttgagaaaccaccagtttacaagcccccagttgagaagccaccagtgtacaagcccccagtagagaagccaccagtgtacaagcccccagttgagaagccaccagtgtacaagcccccagtagagaagccaccagtgtacaagcccccagttgagaaaccaccagtttacaagcccccagttgagaagccaccagtttacaagcccccagttgagaagccaccagtgtacaagcccccagttgagaaaccaccagtttacaagcccccagtagagaagccaccagtttacaagcccccagttgagaaaccaccagtttacaagccaccagtggagaagccaccagtgtacaagcccccagttgagaagcctccggtgtacaagcccccagttgagaagcctccggtgtacaagccaccagtagagaagccaccggtttaccagccaccatacgggaagccacctcacccaaagtaccctccaagcaccaactgattacacgccattctgaagtatgttaagagttgtatctgaagtatatgataaataaaagttgtagctactctaccattgtcatgctcagatatgtagtttactttacaaatcatttgtttacagtgttgtggccaagataagagtgtaatggatgcatgtaaaacggacaaacaatatgtatggtcttttcttctgaaagctatgaataatagaactttatgattttgactcgtgccgaattcggcacgaggcttaagcttcaattagatgtgtctcagaggtgtcttcacgaacaactaaatgttcagagaaaattacagttgagaattgaggaacaaggaaggcaactaaaataaatgtttgaccagcagcttatggtatcatgatgatgcagagtaacagtacttatgagtatactcccaccaacttcagatattcctgaggcatatangaagggttcaactgaggaacaagtgagtcgttgttgaa

SEQ ID NO: 685 - DNA, 662 bp, Phaseolus coccineus
tggccggggaactaaaacatgaagaacatggcttccttaagctccctagttctgcttcttgcagctctgcttctctcctcacaagggcttgctaactatgacaagcccccagtagaaaaacctccagtttacaagcccccagttgagaaaccaccagtgtacaagcccccagtagagaagccaccagtttacaagcccccagttgaaaaaccaccagtgtacaagcccccagtagagaagccaccagtgtacaagcccccagttgaaaaaccaccagtttacaaacccccagtagagaagccaccagtgtacaagcccccagttgagaaaccaccagtttacaagcccccagttgagaagccaccagtgtacaagcccccagtagagaagccaccagtgtacaagcccccagttgagaaaccaccagtttacaagcccccagttgagaagccaccagtttacaagcccccagttgagaagccaccagtgtacaagcccccagttgagaaaccaccagtttacaagccaccagtttacaagccaccagtttacaagcccccagttgagaaaccaccagtttacaagccaccagtggagaagccaccagtgtacaagcccccagttgagaagcctccggtgtacaagcccccagttgagaagcc

SEQ ID NO: 686 - DNA, 717 bp, Trifolium pratense
taacatggcttcctcaagtttcctagtgttgttcctttttgctctttttgccatccctcaagggcttgcaaattatgaaaaccctcctgtatacacgccacccattgtgaaacccccagtttataagccaccagttgagaaaccacctgtatacaagcccccagtggagaaacctccggtttacaaaccccctgtagagaagccaccagtgtacaaaccaccggtggagaaacctccagtttacaagccacctgtgtacaagcctccagttgagaaacccccagtctacaagcccccagtagagaaaccacctgtgtacaagccaccagtttacaagcccccagtttacaagccaccagtttacaagcctccggtttacaagccaccagttgaaaagcccccagtatacaagccaccagtgtacaagccaccagttgagaagcccccagtatacaagcccccagtttacaagccaccagtatacaagccaccagtgtacaagcccccagtagagaagccaccggtgtacaagccaccagttgaaaaacctccagtgtacaagccaccagtagagaaaccccctgtctacaagccaccagttgagaagccgccagtttacaagcsaccagtagagaaacccccagtttacaagccaccagttgagaagccccctgtgtacaaacccccagtttacaagccaccagtttataaacctcc

SEQ ID NO: 687 - DNA, 1157 bp, Vigna unguiculata
catggcttccttaagctccctagttctgcttcttgcagttctggttctgtcccctcaagggcttgctaactatgagaagcccccagtagaaaaacctcctgtatacaagcctcccattgaaaaaccaccggtctataagccaccagtagaaaaaccaccggtttacaagcctccagttgagaaaccaccggtttacaagcccccggtagagaaaccaccagtgtacaaacccccggtagagaaaccaccggtttacaagcctccggttgagaaaccacccgtttacaagccccctgttgagaaaccaccggtttacaagcctccggttgagaaaccaccggtgtacaagcccccagttgaaaaaccaccagtgtacaagcctccagttgagaaaccaccggtgtacaaacccccagttgagaaaccaccggtttacaagcccccagttgaaaaaccacccgtgtacaagccaccagtgtataagcccccagtagagaaaccaccggtgtacaaaccccccgttgaaaaaccaccagtgtacaagccccccgttgagaaaccaccagtttacaagcctccagttgagaaaccaccagtgtacaagccccccgttgagaaaccaccggtgtacaaacccccagttgagaaaccaccggtgtacaagccccccgttgagaaaccaccggtttacaagcccccagttgaaaaaccaccggtgtacaagcccccggttgaaaagccaccggtttacaagccaccagttgaaaaaccaccggtgtacaagcctccagtggagaagccaccggtgtacaagcccccagttgaaaaaccacccgtttacaagcccccagtgtacacgccacctcacccaaagtaccctccaagctccaactgatgacaaacgattctgaagtacgttaagagttgtgtctgaagtatgtgataaataaaagctgtaagctcagaatatgtagtttagtttacaaatcatgccaaggattactcctcctgtcttcgtttatttttaatcatttgtttacagtgttgtggtcaagataagggtgtcatggatgcacgaatgtaaaacggagaaaaaaaaaagtgtgatgttttgtagtgaaaactctgaataatagaactttgtgattttgatatta

SEQ ID NO: 688 - DNA, 673 bp, Medicago truncatula
ctaacatggcttcctcaaactttttagtgctgcttctttttgctctctttgctatccctcggggtcttgccaattatgacaagcctccggtttaccaaccaccggtctacaagccccctgttgagaagccacctgtgtataagccaccggtagaaaaacctccagtttacaaaccaccggtagagaaaccaccagtgtacaagccaccagttgagaagccccccgtctacaaacctcctgtagagaagcctcctgtttacaagccaccagtagagaaaccaccagtgtacaagccaccagttgaaaagcctccggtctacaaaccacctgtagagaagccacctgtttacaagccacctgtagagaaaccaccagtgtacaagccaccagttgagaagcctccggtctacaaaccacctgtagagaagccacctgtttataagccacctgtagagaaaccaccagtgtacaagccaccagttgagaagcccccggtctacaaaccccctgtagagaagccacctgtttacaagccaccagtagagaaaccaccagtgtacaagccaccagttgagaagcccccggtctacaaaccccctgtagagaagcctcctgtctacaagccaccagtagagaaaccgccagtgtacaagccaccagttgagaaaccccc

SEQ ID NO: 689 - DNA, 1001 bp, Medicago truncatula
actaaagctaccactgagtcaagtatattccaatgaaattacaagttcgttaatttagtaaattcgagattcaaacattaattaattattatttatttccaccgttcaagactgaactttcatgcaccttactggtatgatagggaacaagtaaagtatactctgtcaaatttagtcaacaaacacaaaataagaagtactaaatcataacgttcttattcataatttgaagtacaaatggcaccattttctttcacactcttgtcttggcaatagcatttgtaaacataagattgaattgaagatttccaagaatatatgatccttgctttggaaagtttatatatctcttatttacttaaaagcatgctttaaaaacgagtagtgccaactacgggagggtactatgggtggtgaggtggtccgtaaactggtggcttctcgactggaggcttgtaaaccggtggcttgtaaactggaggtttctcaactgggggtttgtagaccggaggcttgtacacaggtggcttctctactggtggcttgtaaactggaggtttgtacaccggtggcttgtaaactggaggcttctctacaggaggtttgtagaccgggggtttctcgactgggggcttgtacacaggtggcttctcaactggtggcttataaactggaggcttctcaacaggtggcttgtacactggtggtttctctactggtggcttgtagataggaggcttctcaacagggggtttgtagaccgggggtttctcaactggtggcttgtacactggcggtttctctactggtggcttgtagacaggaggcttctctacagggggtttgtagaccgggggcttctcaactggtggcttgtacactggtggtttctctactggtggcttgtaaacaggtggcttctctacagggggtttgtagaccgggggcttctcaactggtggcttgtacactggtggtttctctacaggtggcttataaac

SEQ ID NO: 690 - DNA, 875 bp, Medicago truncatula
cgggggcaccaaactcataagtcactaacatggcttcctcaaactttttagtgctgcttctttttgctctctttgctatccctcggggtcttgccaattatgacaagcctccggtttaccaaccaccggtctacaagccccctgttgagaagccacctgtgtataagccaccggtagaaaaacctccagtttacaaaccaccggtagagaaaccaccagtgtacaagccaccagttgagaagccccccgtctacaaacctcctgtagagaagcctcctgtttacaagccaccagtagagaaaccaccagtgtacaagccaccagttgaaaagcctccggtctacaaaccacctgtagagaagccacctgtttacaagccacctgtagagaaaccaccagtgtacaagccaccagttgagaagcccccggtctacaaaccccctgtagagaagccacctgtttacaagccaccagtagagaaaccaccagtgtacaagccaccagttgagaagcccccggtctacaaaccccctgtagagaagcctcctgtctacaagccaccagtagagaaaccaccagtgtacaagccaccwgttgagaagcctccagtttataagccaccagttgagaagccacctgtgtacaagcccccagtcgagaaacccccggtctacaaacctcctgtagagaagcctccagtttacaagccaccggtgtacaaacctccagtttacaagccaccagtagagaagccacctgtgtacaagcctccggtctacaaacccccagttgagaaacctccagtttacaagccaccggkttacaagcctccagtcgagaagccaccagtttacggaccacctcaccacccatag

SEQ ID NO: 691 - DNA, 924 bp, Medicago truncatula
agtgctgcttctttttgctctctttgctatccctcggggtcttgccaattatgacaagcctccggtttaccaaccaccggtctacaagccccctgttgagaagccacctgtgtataagccaccggtagaaaaacctccagtttacaaaccaccggtagagaaaccaccagtgtacaagccaccagttgagaagccccccgtctacaaacctcctgtagagaagcctcctgtttacaagccaccagtagagaaaccaccagtgtacaagccaccagttgaaaagcctccggtctacaaaccacctgtagagaagccacctgtttacaagccacctgtagagaaaccaccagtgtacaagccaccagttgagaagcctccggtctacaaaccacctgtagagaagccacctgtttataagccacctgtagagaaaccaccagtgtacaagccaccagttgagaagcccccggtctacaaaccccctgtagagaagccacctgtttacaagccaccagtagagaaaccaccagtgtacaagccaccagttgagaagcccccggtctacaaaccccctgtagagaagcctcctgtctacaagccaccagtagagaaaccgccagtgtacaagccaccagttgagaaacccccggtctacaaaccccctgttgagaagcctcctatctacaagccaccagtagagaaaccaccagtgtacaagccacctgttgagaagcctccagtttataagccaccagttgagaagccacctgtgtacaagcccccagtcgagaaacccccggtctacaaacctcctgtagagaagcctccagtttacaagccaccggtgtacaaacctccagtttacaagccaccagtagagaagccacctgtgtacaagcctccggtctacaaacccccagttga

SEQ ID NO: 692 - DNA, 1195 bp, Glycine max
aggagacaaagacgtcggtgcattgagaaatgtgaaaaaaaaatattatcacttgtgtggacttgtcaatgttcccgttaaatttccaactttgcaactacaagaagacagcattcacctacacagcaattgaaaatccacaccgaagattgacctttgtacaacggtgctagaaaccgcgtcactagtaataactattggattgagacatgcacttaacagtaaggcccccaactaatataaaaaccagttattgggtgtgttactcatcagcaactacaacgtgagaaacatggcttccttaagctccttagtgctgctccttgcagctctaattctatcccctcaagttcttgcaaactatgagaatcccccagtgtacaagcctcccactgagaaaccaccagtttataagcccccagttgagaagcctcctgtttacaaacctccagttgaaaaccccccaatttataagcctccagtagagaagccaccagtgtacaagcccccagttgagaaacccccagtgtacaagcccccagttgaaaaaccaccagtgtacaagcccccagttgagaaaccaccagtgtacaagcccccagttgaaaaacccccagtttacaagcccccagttgaaaaaccaccagtgtacaagcccccagttgagaaaccaccagtttacaagcccccagttgagaagccaccagtttacaagcccccagttgagaagccaccagtatacaagcccccagttgagaagcctccagtgtacaagccaccagtagagaagcctccagtttacaagccaccagtagagaaacctccagtttacaagcccccagtggagaaacctcctatttacaagccacctgttgagaagcctccggtctacaagccaccatatggaaagccaccatacccaaagtaccctccaactgatgacacccatttctgaaggatgtcaagaggtgtattgagtatatgctaaataagaggtgctcaaaatgtagttatagattacaaattattgcaagggttgctcttagcttcttcatttcaagcttttgtttacactttgcagtgctatggcaaagataagagtatcatggatggaaaaagggggggaaaaaatgttgctttgtactccaaattatgaataatagaactttatattatttatcagattattaatcct

SEQ ID NO: 693 - DNA, 1052 bp, Brassica rapa
ggagatgagactcgggaatacggataagtggcggacaaggaggttttaggcagagagaaggagaatgctggttcttcgcgctcccacaggacctgtctccgccgccagattcatcaccaaacccaaccctcgtattccttcttcggatccatggctcggactcgttccctccgctaacactcgccgtcggcgacgcgtcgtcctcactctctctaactctgactcaaacggaagcgtcaaatccgccacgccttctactccacctacaggagacgacacagtcttcgtcggtcaagagaatgttccgctcgaaggcgttattcaattcgataaaccaaaatcagatgcttcaatcaagaaatggggccgtgtggctttacttgctggtggggatgttttggctttgcttatcttctctgcaattgggagattcagccatggattccctgtgcttagcttcgatactcttcacacagctgaccctttcattgctggatggtttctgagtgcttatttcttgggaggatatgcggaggaagggagaggaatgaagggtcagtcaaaagctgtgctagcagccgctaaatcttgggctctcggtgttccgcttggggtgatcataaggtcaacctcgtcaggccacatcccatcttatagctttatcttggtgacaatgggaaagtactgctgttttacttattgggtggagagcactattattcagtgtgcttccttcagagtcaaagaagaaagatgatacatatcgaaaaggcagcgcattcgaactatttgagttgcttacttcattaataagacggtggtaatggagcttcgcatccatgaacatacgggcgaatggaagtttatattctatatgcatatatctcatcctgtcagcagaggatatatttgaaaagttccaggacaactgtaatatttatatatagttgcagggagggatgccattacttgtgccaagcaattcttammkgktgtcccaaacaatttctataatgtatgaaactcgaaaagagtcacttaagcaaaaaaaa

SEQ ID NO: 694 - DNA, 1127 bp, Raphanus sativus
ggagactagtatacggataagtggcggacaaggagggggctttaggcaaacagaaggagaatgttggttcttcgcgctcccacaggacccgtgtccgccgtcagattcatcaccaaacccaaccctcgtactcctccttcttcggatccatggctcggactagttccctccgcgaacactcgcagtcggcgacgcgtcgtcctcactctctctagctctgactcaaacggaagcgtcaaatccgccgcaccttctcctccaccttcccaacaagtcccagacgacacagtcttcgtcggtcaagagaatgttcccctcgaaggcgttattcaattcgataaaccaaaatcaaatgcatcaatcaagaaatggggccgtgtgggtttacttgctggtggggatgttttggctttgcttatcttctctgcaattgggagattcagccatggattccctgtgtttagcttggatactcttcacacagccgaccctttcattgctggatggtttctgagtgcttatttcttgggaggatatgcggaggaagggagaggaatgaagggtcagtccaaagctgtgctagcagccgctaagtcttgggctctcggtgttccgcttggggtgatcataaggtcaacctcgtcaggccacatcccagcttatagctttgtcttggtgacaatgggaagtaccgctgttttacttattgggtggagagcactattattcagtgtgcttccttcagagtcaaagaagaaagatgatacatatagaaaaggcagcgcattcgaactatttgagttgcttacttcattaataagacggtggtgatggagcttcgcatccattaatgtacgcgcggatggaactttctattccatatgcatatatctaatcctgtcagcagaggaaatatttggaaagttgacaagaaagttacagggagggatgattacttgtcccaaacaattcatataatgtatgaatactctgaaaaccagtcagcttaagcaaaaccaaaatgacaaacaatagtgagttgccaagtgatggaatcaaattggcaagtacacaactattgagataatgtgagataaatgaagcattgaaaatgtaaaatttactcc

SEQ ID NO: 695 - DNA, 1078 bp, Thellungiella halophila
gagatgagacaaagaaaaaaaagatgagactgagtagtagtatatgagtggcggacgagattagcttcttaggactgagaatgttgattcttcgtactcccaccggacctgtctccgccgtcagattcatcaccaaaccaaaccctcgtgttccttcttccgatccatggctcgggctcctccccgccgccaatactcgccgccggcgacgcgtcgtcctcactctctctaactccgactcaaacggaagcgtcaaatcgtcaacaccttcccaaatcccatctacaggagacgacaccgttttcgtgggtcaagagagtgttcctctcgaaggcgttattcaattcgataaacccaattcaaatgcttcaatcaagaaatggggtcgtgtcgcgttacttgctggtggggatgttttggctttgcttcttttctctgcgattgggagattcagccatggattccctgtgtttagcatcgatactcttcacacagctgaccctttcattgctggctggttcttgagtgcgtatttcttgggaggatatgcggaggaagggagaggaatgaagggtcagtcgaaagccgtgttagcagccgcgaagtcttgggctctcggagttccgcttggaatgatcattaggtcaacctcatcaggtcacatcccggcctatacctttatcttggtgacaatgggaagtactgctgtcttacttattggatggagatcactattgttcagtgtgcttccttcagagtctaagaagaaagatgatacgtatcgaaaaggcagtgcattcgaactatttgagttgcttacttcattaataagacggtggtgaaggatgagattcaatatgaacatgtcatccactttgtcaccaactgtaatgtggatatagttgcagcaatgtagaggaagaattaccgagagatgattacttgggattagttatacgatctgttttagttgatgttgtgggttaacccagtgtttcaaaaactcatgtaagccaacttttttttggttaaatttgttataagagcctcttaagcaaatctgtcatgagcagatgat

SEQ ID NO: 696 - DNA, 1484 bp, Arabidopsis thaliana
gaagaaaagtctgcgtttcttcaccaaccctacacgaaccaagatagatagaaaccttctccttcttctgcttcttttatcatcggagaattcgaatcttcttttcctctttttgagattctctaattatccttttggaagagtttcgtgtgagagagaagcgtaatgggctgctttggttgttgtggtggtggtgaggatttccgtagagtttctgaaactggaccaaagccagtgcataacactggaggttacaatggaggtcaccatcaaagggcagatccacccaaaaaccttccagtcattcagatgcagcctatctctgttgcggccattccagctgatgaattgagggatataacggataactatggttcaaagtccttgattggtgagggttcatatggaagagtcttttatggtattcttaaaagtggtaaagcagctgccattaagaaactggattctagtaagcaaccagatcaagaatttctcgcccaggtatcaatggtttcgagattgcgacaagaaaatgttgttgcgcttctgggctattgtgttgatggcccactccgtgttcttgcttatgaatatgctcctaatggatctcttcatgatattcttcatggtcgaaaaggtgttaaaggggcacagccaggtcctgttctgtcgtggcaccagagagtcaaaattgctgttggtgcggctagaggactcgagtacttgcatgagaaggcaaaccctcatgttatccacagagacatcaaatccagcaatgtacttctgttcgatgatgatgttgccaagattgctgattttgatttgtccaaccaagcccctgacatggctgctcgccttcactcaacccgtgtgctcggaacctttggctatcacgctccagagtatgcaatgacggggacgttgagcacaaagagtgatgtctatagttttggcgttgttctgctggagctcctcacaggtcgtaaaccagttgatcataccttaccacgtggacagcagagtgtcgtgacatgggcaacccctaaattgagtgaagacaaggtgaagcagtgtgttgacgcaagactaaacggagaatatcctcccaaagctgttgctaagctggctgcggtagctgcactgtgtgtgcaatatgaggcagacttcaggcctaacatgagcatagtggtgaaggctcttcagccgttgctcaatcctcctcgttctgctccccagactccacacaggaacccgtattgatatgctctagtctgatatcaccctttatgatcatcactatttcatttgtttttgtttgaatccgatttgtgtaaatttgtgaaataggcgtttattctctcataaaccccctgccacttcactgaaaatcttacttggaaagacctgaatgttactgtatttctatattatttcatgcatgtgaatgtgatgcaagtctctactaatgctacgatatgcgaggt

SEQ ID NO: 697 - DNA, 1337 bp, Brassica oleracea
gacgcgtgggaaacccaaacagtttagttaacttgtcgtgtagtagaagagttgtatcatgagctgctttggttggtgtgggaatgatgatggtttccgtaatggtgatgatactagaccaatgccaagccacatccctgcaggtgacagtggaagccactatctaagatctgatccacccatgaatcagcccgttgttcagatggagcctattgctgtaccagccatcccagctgatgaactgagtgatgtaaccgagaactatggttccaaggccttggtgggtgagggctcttatggaagggtgtttcacggtgttcttaaaagcggtatcacatctgccatcaagaaacttgattctagcaagcagcctgaccaagaatttctttcccagatatcaatggtttcgagattgcgacacgaaaatgttattgcgcttgtgggttattgtgttgatggccctctccgtgttcttgcttatgagtatgctcctaacggatctcttcatgatgttcttcatggccgaaaaggcgtgaaaggagcgctgcgaggtcctgttatgacgtggcatcagagagtcaagatcgctgttggtgcagccagagggcttgagtacttgcacgagaaggtcaaccctcaggttatccaccgagacatcaaatccagcaacgtgcttctctttgatgacgatgttgccaagattggtgacttcgatctctctaatcaagcgcctgacatggctgctcgacttcactctactcgtgtactaggaacctttggctatcacgctcctgagtatgcaatgacgggaacattgagcacaaagagcgacgtgtacagttttggcgttgttctgctagagctccttactggtcgtaaaccagtcgaccataccttacctcgtggacaacaaagtctagtgacttgggcaacccctaaactgagcgaagacaaggtgaagctatgtgttgatgcaagactacttggagagtacccctccaaagctgttgccaagctagctgcggtggctgcactgtgcgtgcaatatgaggcaaattttagaccaaacatgagcattgtggtgaaggcacttcaacctcttttgaaccctcctcgttctactccacataggaacccttattgatcatcagatatccaaaccacatctcagctgctgcttcataatgattaatcaactgtgtatttgtttttgcattcaacccccacttttgaagagcagtgtatgtatttctctatattatctgttttctgttatgtaattgaggtggagagaaaataccaaattatattttgtttattgttaacctaataatgat

SEQ ID NO: 698 - DNA, 1307 bp, Brassica rapa
ttcttcttcttccatcatctgaagattcgactcgyctytgctcttctgtggttttcttgcaagagttttgcaagtttgtgtaagagagaagcataatgagctgctttggttgttgtggcgatgatgatttccatagagttaatgaaacaggaccaaagacagcgtacaacacagcaggttacgatggtcaccatcaaagggttgaaccattcaagaacccaccagccattcagatgcagcctatctctgtaccagccattccagcagatgaactaaaggatataaccgataactatggttcaaagtctttgattggtgagggctcatatggtagagttttttatggtgttctaaaaaacggcaaggcagctgccattaagaaacttgattccagtaagcaaccggatcaagaatttctctcccaggtttcaatggtttcgagattgcgacaagacaatgttgttgcgcttcttggctattgcgttgatggaccactccgtgttcttgcttatgaatatgcccctaaaggatctcttcatgatatccttcatggtaaaaaaggtatgaaaggagcacaaccaggtccggttctgtcgtggcaccagagagtaaaaattgcggttggtgcggctaaaggactagagtacttgcatgagaaggcaaaccctcatgtgtccaccgagacatcaaatccagcagtgtacttttgtttgaagatgatgttgctaagattgctgattttgatctgtctaatcaagcccctgacatggctgcacgccttcactcaactcgtgtgcttggaacctttggttatcacgctccagagtatgcaatgacaggaacgttgagcacaaagagtgacgtgtatagttttggagttgttctgctagagctcctcacaggtcgtaaaccagttgatcataccttaccacgaggacagcagagtctcgtgacatgggcaacccctaaactgagtgaaaacaacgtgaaccagtgcgttgatgcaagactaaagggagagtatcctctcaaagctgctgccaagatggctgctgtagcggcgctttgtgtgcaatatgaggcagagttcaggccaaacatgagcatagtagtgaaggcacttcagcctcttctcaatcctcctcgctctgctcctcagactccgcagaggaacatcccttattgattgtcacacttcatcatatcactacttcatttgtttttgcttcaatatgatttgtgtaaattcgtgaaatagcctctcttaattctctcataaaagaatatttatatatatacgaaaatgt

SEQ ID NO: 699 - DNA, 1132 bp, Brassica rapa
ggtttccgtaatggtgatgatactcgaccaatgccaagccacatccctgcaggtgacagtggaagccactatctaagatctgatccacccatgaatcagcccgttgttcagatggagcctattgctgtaccagccatcccagctgatgaactgagtgatgtaaccgataactatggttccaaggccttggtgggtgagggctcttatggaagggtgtttcacggtgttcttaaaagcggtatcacatctgccatcaagaaacttgattctagcaagcagcctgaccaagaatttctttcccagatatcaatggtttcgagattgcgacacgaaaatgttattgcgcttgtgggttattgtgttgatggacctctccgtgttcttgcttatgagtatgctcctaacggatctcttcatgatgtccttcatggccgaaaaggcgtgaaaggagcgctgcgaggtcctgttatgacgtggcatcagagagtcaagatcgctgttggtgcagccagagggcttgagtacttgcacgagaaggtcaaccctcaggttatccaccgagacatcaaatccagcaacgtgcttctctttgatgacgatgttgccaagattggtgacttcgatctctctaatcaagcgcctgacatggctgctcgacttcactctactcgtgtactaggaacctttggctatcacgctcctgagtatgcaatgacgggaacattgagcacaaagagcgacgtctacagttttggcgttgttctgctagagctccttactggtcgtaaaccagtcgaccataccttacctcgtggacaacaaagtctagtgacttgggcaacccctaaactgagcgaagacaaggtgaagctatgtgttgatgcaagactacttggagagtacccctctaaagctgttgccaagctagctgcggtggctgcactgtgcgtgcaatatgaggcaaattttagaccaaacatgagcattgtggtgaaggcacttcaacctcttctgaaccctcctcgttctactccacataggaacccttattgatcatcagatatccaaaccacatctcagctgctgcttcataatgattaatcaactgtgtatttgtttttgcattcaagcc

SEQ ID NO: 700 - DNA, 1515 bp, Brassica rapa
  misc_feature (1419)..(1419): n is a, c, g, or t
ctcttctttagcctacagcttccgccaaccatacgtacagacaagatagacacaatcctccctacctccttcttctatcttcatcgaaagattcaaccacactcgagtcttctctctctctcttttggaaagaaaaaaagtttgtgtgtgtgagaaacagcgcaatgagctgctttggttgttgtggtggtgacgattttcgtcgagttgctgaaactggtccaaagccagtctacggcgcaggaggtcacggtggaggtcaccatgtaaggacagacccgcccaagaacacaccagtcattcagatgcagcctatctccgtgccggctattccagctgatgagttgaaggatataaccgataactacggttcaaagtccttgattggtgagggctcttatggaagagtgttttacggtgttcttagaagcggcaaggcagctgccattaagaaacttgattccagtaagcagcctgatcaagagtttctcgcacaggtatcaatggtttcgagattgagacaagacaatgttgttgcacttctgggatattgcgttgatggcccactccgtgttcttgcttatgagtttgctcctaatggatctcttcatgatattcttcatggtagaaaaggagtgaaaggagcacagccaggtcctgtttctgtcgtggaaccagcagagttaaaattgctgttggtgcggctaggggactcgagtacttgcatgagaaggcgaaccctcatgttgttcaccgagacatcaaatccagcaatgtgcttttgtttgacgatgatgttgccaagattgctgacttcgatctctctaaccaagcccctgacatggctgctcgccttcactcaactcgtgtgctgggaacgtttggttatcacgctccagagtatgcaatgacagggacattgagcacaaagagtgatgtctatagttttggagttgttctgctagagctcctcacaggtcgtaagccagttgatcataccttaccacgaggacagcagagtctcgttacatgggcaactcctaaactgagtgaagacaaggtgaagcagtgcgttgatgcaagactaaacggagaatatcctcccaaagctgttgccaagctggctgctgtagctgcgctatgtgtgcaatacgaagcagacttcaggccaaacatgagcatagtggtgaaggctcttcagcctctcctcaatcctcctcgctctgctcctcaaactcctcacaggaacaatccttattgatgtcctccaatctgatgccacgcttcttcatcatatcacttatttcatttgtttttgtttgaatccggtttgtgtaaattcgtgaaaataggctttttatttctcacaatagacatgaaagtctcacttccaaacctgaatggtgttgctctatttgntttatgttatttcatgcctgcgattgtaagttttctaccaattatacaatatgcgaggaatggatatattcataatatactcattgtgtttgtgcc

SEQ ID NO: 701 - DNA, 1973 bp, Brassica napus
ggtgcgcatctgctccaagtccaacaccttataagaaatttccgccgggaagaaagaaaagtctctgccctctcttctcaagcctacagcttccgccaaccatacgtacaaacaagatagacacaatcctccgtacttcctttttctatcttcatcgaaagattcaaccacactcaagtcttctctctctcttttggaaagaaaaagaagttcgtgtgtgagagagaaatagcgtaatgagctgctttggttgttgtggtggtgacgattttcgtcgagttgctgaaactggtcctaagccagtctacggcgyaggaggtcacggtggaggtcaccatccaagggcagacccacccaagaacacgccagtcattcagatgcagcctatctccgtgccggctattccagctgatgagttgaaggatataactgataactacggttcaaagtccttgattggtgagggctcttatggaagagtgttttacggtgttcttagaagcggtaaggcagctgctattaagaaacttgattccagtaagcagcctgatcaagagtttctcgcacaggtatcaatggtttcgagattgagacaagacaatgttgttgcacttctgggatattgcgttgatggcccactccgtgttcttgcttatgagtttgctcctaatggatctcttcatgatattcttcatggtagaaaaggagtgaaaggagcgcagccaggacctgttctgtcgtggaaccagagagttaaaattgctgttggtgcggctaggggactcgagtacttgcatgagaaggcgaacccgcatgttgtccaccgagacatcaaatccagcaatgtgcttctgtttgacgatgacgttgccaagattgctgatttcgatctctccaaccaagcccctgacatggctgctcgccttcactcaactcgtgtgctgggaacctttggttatcacgctccagagtatgcaatgacagggacattgagcacaaagagtgatgtctatagttttggagttgttctgctagagctcctcacaggtcgtaaaccagttgatcataccttaccacgaggacagcagagtctcgttacatgggcaactcctaaactgagtgaagacaaggtgaagcaatgcgttgatgcaagactaaacggagaatatcctcccaaagctgttgccaagctggctgctgtagctgcgttatgtgtgcaatacgaagcagacttcaggccaaacatgagcatagtggtgaaggctcttcagcctctcctcaatcctcctcgctctgcccctcaaactcctcacaggaacaatccttattgatgtcctccaatctgatgccacgcttcttcatcatatcacttatttcatttgtttttgtttgaatccggtttgtgtaaattcgtgaaaataggctttttatttctcacaatagacatgaaagtctcacttccaaacctgaatggtgttgctctatttgtytatgttatttcatgcctgcgattgtaagtttctactaattaacaaatgcgaggaatrgatattyataagawamwmawaaraaaaaaaaaaaaaaaaaagagaaaaaaaaaaaaagaaaaaagaaaaaaaaaaaaaaaaaaaaaaaaagggggggccccccttttttttgtttttttttttttttataaaaaaaatacggggccccctttgaaagttttttttttgtttttaaggcggaaaaaaaaaaaaaaaaaagggcgccccctcttggagaaccaagtttaagaacgcggggttgcgaaggcaaagtcttttaaaaggcggcccaaaataaaattccgggggcgggcgtttaaaaaggcggaggggggaaaacccgggggttcccaaaataaatgcgcttgggagaaaacccccttttcccaggtgggtaaaaaggaaaagggcccgccacgatggccctcccaaaaaggggggcgccgg

SEQ ID NO: 702 - DNA, 1435 bp, Brassica napus
tttcgaaccattatccaaagcttagacactaagcagagtatataatttcaaaactctctctccactttcccaacttcctctttctcgtcgctaaacccaaacagtttagttaactkgkcgtgtartaraagagttgtatcatgagctgctttggttggtgtgggaatgatgatggtttccgtaatggtgatgatactcgaccaatgccaagccacatccctgcaggtgacagtggaagccactatctaagatctgatccacccatgaatcagcccgttgttcagatggagcctattgctgtaccagccatcccagctgatgaactgagtgatgtaaccgataactatggttccaaggccttggtgggtgagggctcttatggaagggtgtttcacggtgttcttaaaagcggtatcacatctgccatcaagaaacttgattctagcaagcagcctgaccaagaatttctttcccagatatcaatggtttcgagattgcgacacgaaaatgttattgcgcttgtgggttattgtgttgatggacctctccgtgttcttgcttatgagtatgctcctaacggatctcttcatgatgttcttcatggccgaaaaggcgtgaaaggagcgctgcgaggtcctgttatgacgtggcatcagagagtcaagatcgctgttggtgcagccagagggcttgagtacttgcacgagaaggtcaaccctcaggttatccaccgagacatcaaatccagcaacgtgcttctctttgatgacgatgttgccaagattggtgatttcgatctctctaatcaagcgcctgacatggctgctcgacttcactctactcgtgtactaggaacctttggctatcacgctyctgagtatgcaatgacgggaacattgarcmcaaagagcgacgtctacagttttggcgttgttctgytagagctccttactggysgwaammcakwcgaccatwccttamcyygtggrcaacaaartctwrtgrcytgggcaacccctaaactgagcgaagacaaggtgaagctatgtgttgatgcaagactacttggagagtacccctctaaagctgttgccaagctgcggtggctgcactgtgcgtgcaatatgaggcaaattttagaccaaacatgagcattgtggtgaaggcacttcaacctcttctgaaccctcctcgttctactccacataggaacccttattgatcatcagatatccaaaccacatctcagctgctgcttcataatgattaatcaactgtgtatttgtttttgcattcaagccccacttttgaatagcagtgtatgtatttctctatattatctgttttctgttatgtaatttgaggtggagagaaaataccaaattatattttgtttattgttaacctaataatgatttcagaaacctcactatta

SEQ ID NO: 703 - DNA, 1457 bp, Raphanus sativus
gggtcgaaccatttaccaaagcttaaacactaagcagagatatagcaatttcaaaaatatatctctctctctctctctactttcccaacttcgtcgccaaacagttaacttgtcgtgtaatagaagagttagttgttgtaatcatgagctgtttcggttggtgtgggaacgatgatggtttccgtaatgctgatgatactagaccaatgccaaccctcatccctgcaggtgacagtggaagccactatctaagatctgatccacccatgaatcagcctgttcttcagatggagcctattgctgtaccagccattcctgctgatgagctgagtgatgtaaccgataactacggttccaaggccttggtcggtgagggttcttatggaagggtgtttcacggtgttcttaaaagcggtgtaacatctgctattaagaaacttgactctagcaagcagcctgaccaagaatttctttcccagatatcaatggtttcgagattgcgacacgaaaatgttattgcacttgtgggttattgtgttgatggccctctccgtgttcttgcttatgagtatgctcctaacggatctcttcatgatgttcttcatggccgaaaaggtgtgaaaggagcgctgcggggtcctgttatgacgtggcaacagagagtcaaaatcgctgttggtgcagccagaggactcgagtacttgcacgagaaggtcaaccctcaggttatccaccgagacatcaaatccagcaacgtccttctgtttgatgatgatgttgccaagattggtgatttcgatctctctaatcaagcgcctgacatggctgctcggcttcactcaactcgtgtcctaggaacctttggctatcacgctcctgagtatgcaatgactggaacattgagcacaaagagcgacgtgtacagttttggcgttgttctgttggagctccttactggtcgtaaaccagtcgaccataccttacctcgtggacaacaaagtctagtgacatgggcaacccctaaactgagcgaagacaaggtgaagctatgtgttgatgcaagattactcggagagtacccttccaaagctgttgccaagctagctgcggtggctgccctgtgcgtgcagtatgaggcaaactttagaccaaacatgagcattgtggtgaaggcacttcaacctcttttaaaccatcctcgttctactccacatagaaacccttactgatcatcaggtctccaaaccacatttcagctgctgcttcacaatgattaatcaaatgtgtattcattttggttttgtatttaagtcccacttttgaagagttgtgtatgtatttctcaaaattatctgtattctgttatgtaatttccgaggtgggaagacaaaaccaaattatattttgtttattgttaacttaataatgatttcacaaatctcactattaaatttcta

SEQ ID NO: 704 - DNA, 1668 bp, Raphanus sativus
ggagagacgataaagtaaaataatcagaagttgcaaggaggcaaaggaggactactgaskamtacaacttggaacttggaagaagaagtaagctatcgtgcgcatctgctccaaacacctttaataagaaatttccgccgggaagaaaagtctgccctctgccttcttaagcctaaagcttcgccaccaaccatacgtataagaagatatagtcaaaatcctccctacccttcttcttctcctttcatcggaagaagattcaaccacactcagtcttctctctctctcttttgttttggaaaaagtgtggtttgtgttgtgagagaagagcgtaatgagctgctttggttgttgtggtggtgacgattttcgtagagttgctgaaactggtcctaagcctgtctacggcgcagcaggtcacggtggagttcaccatgcaaggacagacccgccaaagaacacgccagtcattcagatgcagcccatctctgtgccggccattccagctgatgagctgaaggacataaccgataactatggttcaaagtccttgattggtgagggctcttatggaagagtgttctacggtgttcttagaagcggcaaggctgctgccattaagaaacttgattccagtaagcaacctgatcaagagtttctcgcccaggtatcaatggtttcgagattgcgacaagacaatgttgttgcacttttgggatattgcgttgatggcccactccgtgtgctcgcttatgagtttgctcctaatggctctcttcatgatattcttcatggtaggaaaggagtgaaaggagcacagcctggacctgttctgtcgtggaaccagagagttaaaatagcggttggtgcggctaggggactggagtacttgcatgagaaggcgaaccctcatgttgtccaccgagacatcaaatccagcaatgttcttctgtttgacgatgatgttgctaagattgctgatttcgatctctccaaccaagcccctgacatggctgctcgccttcactcaactcgtgtgttgggaaccttcggttatcatgctccagagtatgcaatgacaggaacattgagcacaaagagtgatgtgtatagttttggggttgttctgctagagctcctcacaggtcgtaaaccagttgatcataccttaccccgaggacaacagagtctcgttacatgggcaactcctaaactgagtgaagacaaggtgaagcagtgcgttgatgcaagactaaacggagaatatcctcccaaggctgttgccaagctggctgctgtagctgcgctatgtgtacaatatgaggcagacttcaggccaaacatgagcatagtggtgaaggcttttcagcctctgctcaatcctcctcgctytgctcctcaaactcctcacaggaacaacccctattgatttgatatcctccaaatctgatcccacgcttcatcatatcactcactatttcatttgtttttgttttgtttgaatacaatttgtgtaaattcgtgaaaataggcttttaatttctctctcaaaaaaaaaaaccggcaagtctcacttggaaacctgaatgtttttgttatttcatgcctgcgrtgtaagtttctactaattattatacgatatgtgaggaatgaatatctatttatact

SEQ ID NO: 705 - DNA, 1415 bp, Raphanus sativus
ggggaagaaaagtctttgtcctcttcttaagcgtacaagaagatagcgaacatcctccaagagcttcttcttcttattcgactcatctcgtctctttgtcttctgtgatattgttttygaaaaaaaggttcttgtaagtttgtgtaagaggagaaaagggtaatgagctgctttggctgttttggtggtggtgaggattttcgtagagtttctgaaaccggaccaaagccagtgtttaacagagatggtctcaatggtcaccatcaaaagacagatccacccaagaactcaccgttcattcagatgcagcctatctctgtgcctgccattccagctgatgaactgaaagatctaaccgataactatggttcaaagtccttgattggtgaaggctcttatggaagagtgttttacggtgttcttaaaaacggaaaggcagctgccattaagaaacttgattccagtaaacaacctgatcaagagtttctcgcccaggtatcaatggtttcgagattgagacaagacaatgttgtcgcgcttctgggatattgcgttgatggcccgctccgtgttcttgcttatgaatttgcctctaatggatctcttcatgatattcttcacggtagaaaaggtgttaaaggagcacagccaggtcctgttctgtcgtggaaccagagagttaagatcgctgttggtgcggctagagggctggagtacttgcacgagaaggcaaaccctcatgttattcacagagacatcaaatccagcaatgtgcttctgtttgaggatgatgtcgccaagattgctgattttgatctgtctaaccaagcccctgacatggctgcgcgtcttcactcaactcgtgtgcttggaacttttggctatcacgctccagagtatgcaatgacaggaacactgagcacaaagagtgatgtctacagttttggtgttgttctgctagagctcctcacaggtcgtaaaccagttgatcataccttaccacgaggacagcagagtctcgtcacatgggcaacccctaaactgagtgaagacaaggtggagcagtgcgttgatgcaagactaaacggagaatatcctcccaaagctgttgccaagctggctgcagtagctgctctatgtgtgcaattcgaggcagactttaggccaaacatgagcatagtggtgaaggctcttcagcctctgctcaatcctcctcgctctgctcctcaaactcctcacaggaacaacccctattgatgattgatatcctccaatcacagttccatcatccactatttcatttgtttttgcttgaatccaatttgtgtaaattcatgaaagtatggctttttaactcctatatcatcatttatcaaaaaatttctatataaatatttatttttagcaaactatta

SEQ ID NO: 706 - DNA, 1437 bp, Thellungiella halophila
gragaaaagtctgccttccttaagcgtaagcttcaccaaccctacgacgaacacgatagaaaaaaacatccggcttcagcgattcgtctcatcttttctcttttgcgatttttggaacagttttgtaagttggtctgagagaaaaaaagcgtaatgagctgctttggttgttgtggtggtgaggatttccgtagagtcgctgaaacaggaccaaagccagtgcacaacgcagcaggttacaatggaggtcaccatcaaagggcagatccgccaaagtacccgccagtcattcagatgcagcctatcgctgttccggccatcccagcagatgagttgaaggatataaccgataactatggttcaaagtcgttgattggtgagggctcatatggcagagtgttttacggtgttctcaaaagcggtaaggcagctgccattaagaaactggattccagtaagcaaccggatcaagaatttcttgcacaggtatcaatggtttcaagattgcgacaagacaatgttgttgcgcttctgggatattgcgttgatggcccactccgtgttcttgcttatgaatatgctcctaatggatctcttcatgatattcttcatggtcgaaaaggtgtcaaaggagcacagccaggtcctgttctgtcgtggcaccagagagtcaaaattgctgttggtgcggctagaggactcgagtacttgcatgagaaggcaaaccctcatgttatccaccgagacatcaaatccatttttgtacttctgtttgacgatgatgtggccaagattgctgatttcgatctgtccaatcaagcccctgacatggctgcacgccttcactcaactcgtgtgctgggaacctttggctaccacgctccagagtatgcaatgacaggaacattgagcacaaagagtgatgtctacagttttggcgttgttctgctagagctcctcacaggtcgtaaaccagttgatcataccttaccaagaggacagcagagtcttgtgacatgggcaacccctaaactgagtgaagacaaggtgaagcagtgcgttgatgcaagactaaatggagaatatcctcccaaagctgttgctaagctggctgcggtagctgcgctgtgtgtgcaatatgaggcagacttcaggccaaacatgagcatagtggtgaaggctcttcagcctctgctcaatcctcctcgctctgctcctcagactccacacaggaacaacccttattgatatatgctccgatctgtttccacgcttcatcttcactatttcatttgtttttgtttgaacccgatttgtgtaaattcgtgaaataggctattatctctctcataaaaccctactcacttcactgaaactctcacttggaaagctcaacgttgctctattttgtttatgttatatcaygcctgtggtgta

SEQ ID NO: 707 - DNA, 1192 bp, Triticum aestivum
ttaagatggccaaggttaacgccggcgccgccctgttgtctctgtgcctgttgctggcgtattctgccgggcaatcggcggccgcctacgtggacgtggagggcaccgtaaggaaagaagtagagaatgccatcaagggcaaccccggcatcggcgcggccctcgtccggctggtgttccacgactgctgggttaatggttgcgatggatcggtgctcttggacaagacgccatccggtggcaacaccgagaagaaggcgatcaacaacatcggcctggacggcttcaacctgatcgacaccatcaagtacaaactgggcaacagcgtctcgtgcgctgacattgtcgtcttcgccgcgcgtgacgcggccagatacctgagcggcggcaaaatcgcctactccgttccctcagggcgcaaggacggcattgtctcatcggatgctaccgcagacgccatcctcccrcaatccacctttgagttccagcagctcaaggacaacttcgccaacaagggcttcacccaggaggagctcgtcatcctctccggcgcgcactccatcggcgtctcccacctctcgtctttccaggaccgcctcaacgattcaaccgcgaccccgatcgacgacagctacaagcaggcgctcgttaaggacgtcgaggatcagaagaagagccaaaatacgtcggatccgatcgagaagaacaacatccgcgacatgagcttgaagttccagaacgactccggctacgacaccacgggggtgaacaccgcggcgaagggcgccctggacaacagctactaccacgccaacctacagaacagggtgctcttcaagtccgactgggttatgcgcaccgacagcaaagctggggacgatatggccgagtacatgaacaatgccaccaagtggaacaacgacttcgccgccgccatggtcaagctcagcaagctcccggccgagggtagtacccgttacgagataaggaagaactgcagagtcaccaaccagaactactattactagaagcagcggcatcacacctacacaggtgccatggatgtaatgatttgtatttaatttgaaggctctgttccatgcctaatttgtattaccacaatactcactgcaaaataaaacgacaataaaataatacacatgcttacatamattttcttctaaaaaaaaaa

SEQ ID NO: 708 - DNA, 1130 bp, Triticum aestivum
agatggccaaggttaacgccggcgccgccctgctgtctctgtgcctgctgctggcctgttctgcgggaggcacaaaggccgcctacgtggacgtggagggcaccgtgaggacagaagtagagaaggccatcaagagcaaccccggcatcggcgccgccctcgtccggctggtgttccacgactgctgggtcaatggttgcgatggatcggtgctcttggacaagacgccatacggtaccaacaccgagaagaaggcgatcaacaacatcggcctggacggcttcaacctcatcgacaccatcaagtacaagctgggcgacggcgtctcctgcgccgacatcgtcgtcttcgccgcgcgagatgcggccaggtacctgagtaatggcaagatcgcctactccgtcccctcggggcgcaaggacggcatcaactcgtcggccgccgccgcagacgccgtcctcccgcaatccaccttcgagttccagcagctcgtggacaacttcgacaagaagaagttcaccccgagggagctcgtcatcctctccggcgcgcactccatcggcgtctcgcacctctcgtccttccaagaccgcctcaacaaatcaaccgcgaccccgatcgacgacarctacaaacaggctcttgtcgcagacgtcgaggcccagaagaagagccaaaatacaccagatccgattgagaagaacaacatccgcgacatgagctcgagcttycagaccaccgccgggtacgaccccacaggggtgaacaccrcggccaagggcgccctggacaacagctactaccacgccaacctgcagaacagggtgctcttcaagtccgactgggttatgcgcaccgacaccgacgccgggaacgctatggccgagtacatggataacgccaccaagtggaayaacgacttcgccgccgccatggtcaagctcagcaagctcccggccgagagtagtacccrttacgagataaggaagaactgtagagtcaccaaccagaactactattactagaagcaacggcatcacctacaggtgccatggatgcaatgatttgtattttgaaggctctgttccatgcctaatttgtaataccacaatactcactgcaaaataaaa

SEQ ID NO: 709 - DNA, 1249 bp, Musa acuminata
gaggttaagcttcggtgtcgcgcttgggcgtcgagatcggtcgagggaggcgccggggggggaagacatggcggacgagaaggaatccacgtcggttcctctaagccaggcagccgatcccgaagaccccgccaaagctccacccacttccccaagctcctctacccggaaggcttgttgtgctgttcttcagagctgggtctcaaagaaatttatgactggatgcgtagttcttttccctgtggcaatcacattttatattacatggtggtttattcagtttgttgatggtttcttcagtccactatatgacaagcttggagttgacatattcggccttggattcttgacatctttggtatttgtttttctcattggaatatttgtttcatcatggctgggtgcaactgttatctgggtgggagagtggtttataaaacgaatgccttttgtgaggcacatttattcagcatcgaagcagatcagcactgccatttctcctgaccaaaataccacagcttttaaagaggttgcaattatccgtcatccacgtgttggcgagtatgcatttggctttattacatcatcagtggtccttcagactgacaaaggtgaygaagaattatgtagtgtatatgttccaaccaatcatttatatattggtgatatattcttggtcaattctgaagaaatcatcagacccaacttgtctgttcgggaaggcatagagattattgtttctgggggtatgacaatgccacagttgattacacctctagaaaggattccacggaagaaccagagcattcggttaaacagaataacataacaaaggtgatgtgtcycggaggtcatattctgctgctgctgctgctatatgtttgctttgctgcttggaaggcaattctcttaaagttacgtccatgtttcaggttagcgggatatgtagaactggctcgagtatcttcagtgttttgcccatgttgttgaccttgcttacctcttattgaatggtttattagttgttgtacattgatgagccagactgagtgcaccaggaatacaaaggagggtagcagcttcactgtgctttttaggggattaaatgggatgctatgtgcaagttggttgaaatctaagggtgtttgtgcagttatagaaaatatagtttacatacatatgtttagggtgccgtgagagaacatattgacaaacaagtccctatattgtgtactctgggcaacgctgc

SEQ ID NO: 710 - DNA, 954 bp, Hordeum vulgare
cggcacgaggctcctctttccgctgctgccgtcacactagctaacgaaaccatcgcggccgccccccgtcctcacccagcctgcctcgactccggcccctccgccgcaacctcccgccgcaatgccggaggagaaggagtacgtcgccgtgcccatgggccaggcgccggagcccgcggaccccgaggaccccgtcaagtcgccgccgcgccccacctcgccggccacctccacccgcaaggcatgcttcgccgtccttcaaagctgggtgtcaagaaagtttatgactggatgtgtrgttattttcccaatggctgtgacattcttcatcactttgtggtttattcgattcttcgacggttttttcagtccactctatgcaaagcttggattcgacgtatttggccttgggtttgtgacatctcttgtattcatatttattgttggaatattcgtgtcatcatgggtgggctcaactgtcttctgggttggagaatggtttataaagaaaatgccatttgtaaggcacatatattctgcatcaaagcaagttagcactgctgtttcaccagatcaaaatacaacagcatttaaagaagtggcaataattagccatccccgtgctggtgaatacgcatttggatttataacatcgagcatgattcttcagactgacaaaggtgatgaagaactgtgtagtgtctatgtgccaaccaatcatctatrtattggtgatatctttttggtgaactctgcagarattataaggcccaacctgtccattcgagaagggatagarataattgtttctggaggaatgaccatgccgsaggtgataacagctctaggacccgcgccagatragaaccagggkrcccgtttaracagartgrtgaccgtgtgaggcttaratatcgtcgraaaacttccccttyggggatgakgatgcaacat

SEQ ID NO: 711 - DNA, 1262 bp, Hordeum vulgare
gcgacgcctcacccgaacccctcctcccccgccgcagcgcccgccggaaggttctagagaaggagggggacgacgccatggcggaggagaaggagtcgacatcggtcccgctcagccaggcggcggaggccgtcgaccccgaggacccggccaagtcgccgccgcgccccagctcgcccaccacctccacccgcaaggcatgctgcgctgttcttcagagttgggtatcgagaaaatttatgactggatgtgtggttctttttcctgttgctttcacgttcttcatcacatggtggttcgttcaatttgttgatggatttttcagcccactatatgcaaaaatcggagtcgacatatttggtcttggttttytgacatctctggcattcatatttctggttggaatatttgtttcttcatgggtgggttcaactgtcttctgggttggagaatggtttataaagaaaatgccattcgtaaagcacatatattcggcatcaaagcaagtcagcactgccatttcaccagatcaaaatacgacagcatttaaagaggttgcgataattcgacatccacgtgttggtgaatacgcattcggatttataacatcaactgttgttctccagacagacaaaggtgatgaggaattgtgtagtgtttatgtgccgacaaatcatctatatattggtgatatatttctgctgaactctgaagagatcatcagaccaaacttatccattcgagaaggaattgaaattatcgtttctggaggaatgaccatgccacaggtaattgcatcgctagaccccatcccaaggaagagccagagcatccgcctaaatagaataatgacatgaggatggatcgcgaatgagtggatgggactccactgctgttcgtttgttacgtgtaaaatgtcaaggttggatacgggaacatgatgaacaagctggacggaagcatcgtatcgatgccctggaatactgttatatggcacatgttgcttttctctgtgtttgctgactggtccaaagtgttaacttctatgtactgctggtgtacaactagtgtgcctgattacattcatttgtaagaatgagatgtgtaataccatgtcgattttgttactataatataccccctccatctcaaaatataagtgttttttaacactagtgtagtgtcaaaaacgctcttatattatgggacggagggagtacataccatgctgactggtttcatagtgagcatctctttctttc

SEQ ID NO: 712 - DNA, 1353 bp, Citrus sinensis
cacgcgtccgcgcaagtcataggactcgtcgcgactcgagtcgcttccttccctcttgcttgcagtctccgcccatttttgtagcacagaaaaaaaattaattttcatttttcagttcaaattcagtcaatattttcttttattttctcagtaaccaagcagacataacaataatggcggaagaaaaagaatcaacgtcgattccactgagtcaagctgagaatggcggcgaagatcccgaagatccagtcaaatctccacccacttcctctgcttcttccactcgtcaggcttgctgttatgttcttcagagttggatttcaaagaagtttatgactggatgtgtggttcttttccctgtggcggttacatttttcattacatggtggtttgttcagtttgttgatggtttcttcagtccattgtatgagcacctcggctttgacatttttgggctcggatttatcacatctctggtatttgtattccttgttggtgtttttgtttcatcttggttgggctctacagttttctgggttggagaatggtttattaagcgcatgccctttgttaggcatctatactcagcctccaagcaaattagtgctgcaatatctccagatcaaaatacaacagcttttaaagaggtggcgatcatccgtcatccacgtgttggtgaatacgcatttggttttattacatcaacagtcacacttcagaaagataatggagatgaagagttatgtagtgtttttgtcccaacaaaccatctatatattggtgatatattcctggtgagctctaaggaaatcataaggccaaatctgtctatccgagaaggcatagagatcattgtttcgggaggaatgacaatgccacaagtgatttctcctattgaaagggttgctcgtcagggcgaaagaatccctctgaacagaataatgtgatggcatcagagaacaggtgttttgattaactctgcaattacgtaaaaattcctaccattgcatgtgttggaagccgccgaaagggtcagcatgcttgagactaggtcgttgtctcaccttataagagtatgaaactaatgtgcctgcttcgatttttgtaattacagctatacgttctgtcagcgttgcttccttgatgcaaccctgtacctgttcctactgtaagagagaaaatgctagtaattctcattagatatgttgtctgtagtgtgttctcctgtcatttattctttcatcctctctaatatttgagaaatactgtgttgattaatatgatctcccaatttgttgatctcaacaagaagcctccatttatcaaagcagacactgtgacatttgtatgatt

SEQ ID NO: 713 - DNA, 1073 bp, Gossypium hirsutum
aatggcggaagagaaagaatcaacgtcgattccactgagccaagccgaaaatgttggtgtcgatcccgaagatccggctaagtctcctcctaggcctagctcccccaattcctccactcgcaaggcttgttgttttgttctccaaagttgggtctcaaagaagttcatgactggatgtgtggtcctttttcctgtggcagttacatttttcattacttggtggtttattcagtttgttgacggtttcttcagtccattatatgaacgacttggcattgacatatttgggctgggatttatcacatctctgctctttgtcttctttgttggtgtttttgtttcatcatggatgggagctgctgttttctcagtgggagaatgggttataaagcgaatgccgtttgttaggcatttatactcagcctcaaaacaaattagtgctgcgatatccccagatcaaaatactacagcatttaaggaggtggctatcattcgccatccacgtgttggtgaatatgcatttggatttatcacatcgtctgtcgtccttcagagagaaaatgaagatgaagagctatgcagtgtttttgtcccgacaaaccatctatacattggtgatatcttcctggtgaactccaaagagatcataaggccaaatctttctattcgagaaggcatagagataattgtttccggaggtatgacgatgccacaagtgatctctccgcaagaaaggtttgcacggcaaaaggaaagaatccctttgaacagaatgatgtaaaaagtatttagagaagacagaatgtcagataagctcgataattacttttattcacttgttgaagcgtgataatattctttggtgacagcaaaatcttagtatagggatgggtgcttatacccgcactctctggtaatttcataaagtcgtagcgttgagtctcacaaactgcttgttagtgtatttgctaatgcattggtgttctatacagatcatttgtcaaaaggcagcactcataacaaacaattgatattttgaaatatatgttacttgtcacgtgtgagtgttgcat

SEQ ID NO: 714 - DNA, 974 bp, Festuca arundinacea
  misc_feature (895)..(895): n is a, c, g, or t
cacacgccgcagccagcgctagccagcacgcggcccgccggaaggttggggagaaacgccatggcagatgagaaggagtcgacgtcggtcccgctcagccaggccgccgacgccgtcgacccggaggacccggccaagtcgccgccgcgccccagctcgcccaccacctccacccgcaaggcatgctgcgctgttcttcaaagttgggtgtcaagaaaatttatgactggatgtgtagttctttttcctgtggccttcactttcttcatcacatggtggttcgttcaatttgttgatgggtttttcagtccactatatgcgaaagttggaatcaacatattcggtcttggttttctgacttctctggcattcatatttctggctggaatatttgtttcttcatggttgggttcaactgtcttctgggttggtgaatggttcatcaagaaaatgccatttgtaaagcacatatattcggcatcaaagcaagtcagcactgccatttcaccagatcaaaatacaacagcatttaaagaagttgcgataattcggcatccacgtgttggtgaatatgcatttggatttataacatcaaatgttgtccttcagacagacaaaggcgatgaggaactgtgtagtgtttatgtgccaacaaatcatctatatatcggtgatatatttctgctgaacactgacgagatcatcagaccaaacttatccattcgagaaggaattgaaattatcgtttccgggggaatgaccatgccacaggtgatcacatccctcgaacccatcccaaagaagagccagagcatccgcctaaatagaataatgacatgamgaaatatgagtcgttaatactacgaactcgtggatgcgtggatgggcgactcangtgctggcctgtttgtgctgttcgtatcatcgtatgtaatgtgttacatgtcgaggttggatatgggaatgtggtgaac

SEQ ID NO: 715 - DNA, 1562 bp, Zea mays
cttggtcactccgtcactgccagggttaacgtcgtcgtctctttctcggcggccgtccgtctggccccgtctgtcccttgcggccttgcgtactcggccaccaaccgcttttgcttgctgctactcgccgccagccaaaagcagccgccccccagcccgaagcgacgccacacccgcatctgcttcattccacccgccccgcgaggagcttctagaagagggagaccccggaggagccatggcggaggaaaaggagtcgacgtcgatcccgctcagccaggcggcagaggctgtcgaccccgaggacccggccaagtcgccgccgcggcccagctcgcccaccacctccacacgcaaggcatgctgtgctgttcttcaaagttgggtctcaagaaagtttatgactggatgtgtagtcctttttcctgttgcagtcacgttcttcatcacatggtggtttattcaatttgttgatgggtttttcagtcccctatatgcaaaaattggaatcgacatatttggtcttggttttttgacttctatggtattcatatttctggttggaatatttgtttcttcatgggttggttcaaccatcttctgggtgggcgagtggtttataaagaaaatgccatttgtaagacatatatattcagcatcaaagcaagtcagcactgcaatttcaccagatcaaaatacgactgctttcaaagaagttgcaataattcgtcatccacgaattggtgaatatgcatttggattcataacatcaactgtggtccttcagactgacaaaggcgatgaagaactgtgtagtgtgtatgtgccaacaaatcatctatacatcggtgacatatttctggtgaactctgaggagatcataagacctaatttatccattcgagaaggaattgaaataattgtgtcaggaggaatgaccatgcctcaggtgattgcatcactggagcccatgccacggaaaagccagaacattcgtctaaatagaatgacgtgatgtaaaacatgtcacatatgcaacaaggtcgtgcatcaagcagatagcatgacctgtggggcacgattagggtgccttggctatatgcgtagccatgtgatttggatagaggagcaactttgtgctgagccattgtggcatttccatactgcagggaagcatcgtgttgatgccctgggataatttattgtcttaggctagtttggcaaccccatttttacaggggattcctattttttcaagaaaatatagtttattttcccttaaaaaatagaaatctctttaaaaaatggagttgccaaactaatcagtaaattgaaggggatcatgggcttcaattcactggtcaccaaaccagccctcaaacttgtgctactctttgtgcacttactagtactggttcaaaatgttagcgtctacgcgtgaggtgtataattgattaaattcgtttgtaactacgtgctgtataacatcttacgttacaaagagatcacacaacgctctgaccagatttcttctttcagatttacagacttgtttcttgttt

SEQ ID NO: 716 - DNA, 1168 bp, Zea mays
acgagggcagttcggtcactactgccggcggcgtctcgctttccaactccgccaccacacggcccacaccacgccaactgcttccgcaaggccgcgagagctttgcgtaaggtaaacttcagcgagcagcatccgtcccaccgaccgcaatgccggaggacaaggagtacgcgcccgtgccgctcggccaggcggcggccgaggcggcagcgcctgactccgaggaccctgccaagtcgccgccgcgacccagctcgcccggcacgtccactcgcaaggcattctttgctgttcttcaaagctgggtgtcaagaaaatttatgactggatgtgtagttcttttgccaattgctgtcacattcttcatcacttggtggtttatccaatttgttgatggttttttcagcccactctatgcaaaactggggtttgacatattcggccttgggttcttgacctccctggtgtttatacttcttgttggaatctttgtgtcttcttgggtgggttcaacggtcttctgggttggagaatggtttataaagaaaatgccctttgtaaggcacatatactctgcatcaaagcaagttagcactgctgtttcaccagatcaaaatacaacagcattcaaagaagtagcaatcattagtcatccccgtgttggtgaatatgcatttggattcataacatcaaccatggttcttcagacagacaaaggtgatgaagaattgtgtagtgtttatgtgccaaccaatcatttatatattggtgacatctttttggtaaactccgccgaaattataaggcccaatttgtctattcgtgaaggcatagaaataattgtttcaggaggaatgactatgccgcaggtgatcatgtcactggaaccaacacctcggaagagccagaacgtccgtttggacagagtgaggacagtatgactgtatgaggcatgcatgaaagtgatgggtgtttcaggatggcttgttggttatggattcaaagctggggcatggagcttgagacaatcaatttgtagattgcattcagaacttgcgcattattggcagatacatgacaacctcacactaacttgcgttgctatcagttggtgacacgaaaattgcagctccacttacaattacaagcacgacatgcacttttaact

SEQ ID NO: 717 - DNA, 1379 bp, Zea mays
ctctcggcggcccgtccggccgtccccgtcccgtctcttgcgtactccgccaccaaccgcttttgcttgccgctactcgccgcctgccaaaagcagccgtcctccctagctcgcccgcccgaagcgacgcctgacttcgcatctgtttcgttccacccgccccgcgagaagcttctagaagggggagacccgccggagccatgccggaggaggagtcgacgtcgatcccgctcagccaggcggcggaggccgtcgaccccgaggacccagccaagtcgccgccgcgacccagctcgcccaccacctccacacgcaaggcatgctgtgctgttcttcaaagttgggtctcaagaaaatttatgactggatgtgtagtccttttccctgttgcagtcacgttcttcatcacatggtggtttattcaatttgttgatgggtttttcagtcccctatatgcaaaacttggaatcaacatatttggtcttggttttttgacttctctggtattcatatttctggttggaatatttgtttcttcatgggttggttcaaccatcttctgggtgggagagtggtttataaagaaaatgccatttgtaaggcatatatattcagcgtcaaagcaagtcagcactgcaatttcaccagatcaaaatacgacagctttcaaagaagttgcaataattcgtcatccacgaattggtgaatatgcatttggattcataacatcaacggtggtccttcagactgacaaaggcgacgaagaactgtgtagtgtgtatgtgccaacaaatcatttgtacatcggtgatatatttctggtgaactctgaggaggtcataagacctaatttatctattcgagaaggaatcgaaataattgtttcaggagggatgaccatgcctcaggtgattgcatcactggagcccatgccacggaaaagccagaacattcgtctaaatagaatgacgtgatgtaaaacaagccacatgcatcaagatagcatgacctgtgtgcttagccatgtgatttggatagaggagcagctttgtgctgagctattgtggcattctgtagtgcaggggaagcatcgtgttgatgcccagggatattattcccacacaagttgtgctactcattgtgcggggtgtttggtttctaggtactaatttttagtctcttcattttattttataaattatcaaatacgaaaactaaaatagagttttagtttccgtatttgtcaatttagagactgaaataaaataaaatagatggattaaaaattaatcctcagaaaccaaacacccctaacactggtccaaaatgctaacgtctatgcttgaggtgcattattgattaaattcgtttataactgt

SEQ ID NO: 718 - DNA, 1263 bp, Zea mays
agttctgcaagtgctgtttggtttagctgcctcttgccgctggcagccagcggaagccaaccaccttgtccccgtcgagcaccgagaccgcgactcctcaccgcactgcgccgctcgcgagaacctcgcgtaagcttcggcaagcagcatccgtcccgccgatcgcaatgccggaggacaaggagtacgcgcccctgccactcggccaggcggcggcgcctgaccccgaggaccccgtcaagtcgccgccgcgacccagctcgcctgccacgtccactcgcaaggcatgctttgctgttcttcaaagctgggtgtcaagaaaatttatgaccggatgtgtagttcttttcccaattgctgtcacattcttcctcacgtggtggtttattcaatttgttgatggttttttcagcccactctatgcaaaactggggtttgacatgttcggccttggattttttacctccctggtgttcatacttcttgttggaatctttgtgtcttcttgggtgggttcaactgtcttctgggttggagaatggtttataaaaaaaatgccatttgtaaggcacatatactctgcatcaaagcaagttagtactgctgtttcaccagatcaaaatacaacagcattcaaagaagtagcaattattagtcatccccgtgttggtgaatatgcgtttggattcataacatcaaccatggttcttcagacagacaaaggtgatgaagaattgtgtagtgtttatgtgccaaccaatcatttatatatcggtgacatctttttggtaaactccaccgacattataaggcccaatttgtccattcgtgaaggcattgaaataattgtttcaggaggaatgactatgccacaggtgatcacgtcactggaaccaacacctcggaagagccacgtccgtttagacagagtgaggactgtatgaggcatgaatgaaagcgatgggtgtttcaggatggattgtttaattaatggattcaaagctggggcatggagcatgaagcagtatcagtttgtagattgcattcagaactcgggtgcgcgttggtagacgtagatacatgacaacctgcattgactttcgttgcaatcggttggtgacacgaattttgcagctccacttacaagcacgagatgcacttttaactgttctccagcagtgtgctagatcgtgtttacctgaacgcgattcaatgctgcatctaccagtgttacttgtgtatataaagttccttatgctactg

SEQ ID NO: 719 - DNA, 763 bp, Allium cepa
gcctttctgttttccaacttattcggcaaattatggcggaagagaaggatcaatcgacatctattcctttaagccaagcggcagatcctgaagatcctgctaaagctctgcctctttcacccagttcatctactcgaaaggcatgctgtgctgttcttcagagttgggtatcaaaaaagtttatgactggatgtgtagtgctatttccagtagctgtcacattcttcatcacctggtggtttatccaatttgttgatggattttttagtccaatttatgaaagactaggtgttaacatagtcggtttagggtttttaacgtcactgctatttgtatttctcattggcatatttgtttcatcctggctgggtgccactgttatccggcttggtgaatggtttataaaaaaattacctttcgtaaagcacatctactcagcatccaagcaaatcagtactgccatttctcctgatcaaaacacaacagcatttaaagaggttgcaattattcggcatcctcgaattggggaatatgcattcggtttcattacatcaacggttgtccttcagaatgagaagggtgatgaagagctgtgtagtgtttatgtccccacaaaccatctatatattggtgatatctttttagtcaattcagaagaaattattagaccaaatctgtctattcgtgaaggcatagagataattgtttctggggggatgacaatgccgcaactaattactccacttgaaaggatacctcataa

SEQ ID NO: 720 - DNA, 1184 bp, Pseudoroegneria spicata
cggaaggttctagagatggcggaggagaaggagtcgacgtcggtcccgctcagccaggcggcggaggcggtcgaccccgaggacccggccaagtcgccgccgcgccccagctcgcccaccacctccacacgcaaggcatgctgcgctgttcttcagagttgggtgtcgagaaagtttatgaccggatgtgtagttctttttcctgtggctttcacgttcttcatcacatggtggttcgttcaatttgttgacgggtttttcagcccactatatgcaaaaattggagtcgacatatttggtcttggttttctgacttctctggcattcatatttctggttggaatatttgtttcttcatgggtcggttcaaccgtcttctgggttggagaatggtttataaagaaaatgccatttgtaaagcacatatattcggcatcaaagcaagtcagcactgccatttcaccagatcaaaatacgacagcatttaaagaagtagcaataattcggcatccacgtgttggtgaatacgcatttggatttataacatcaaccgttgtccttcagacagacaaaggtgacgaggaactgtgtagtgtttatgtgccaacaaatcatctatatattggtgatatctttctgctgaactccgaagagatcatcagaccaaatttatccattcgggaaggaattgaaattatcgtttctggaggaatgaccatgccacaggtaattgcatcgctagaccccatcccaaggaagagccagagcatccgcctaaatagaataatgacatgacaatatatgagtcatcaaaacaatggatcacggatgagtggattgggccccagtgctggtccgtttgtgttgttcgtttgttacgtgtaaaatgtcgaggtcggataygggaacgtgatgaacaagctggacggaaggatcatatcgatgccctgggatactgttatgtgacatgttgcttttctctgtgtttgctgactggtccaaagtgttaacttcgatgcaccggtggtgtacaactagtgtgcctgattacattcatttgtaagagtgtaataccatgtcgacttcgttactatagtatacataccatgctgactggtttctttgcgagcatccctttgtttcatggtctgctgtgatataaagtccatgaaggctgctaaaca

SEQ ID NO: 721 - DNA, 1578 bp, Oryza sativa
gtcctcgtcttccagctcagctgcagccggcgcccgcgcgggcggagcaaaccacgggcggggcgaccacgccgacgacccgcgcacacgccggcttcttcgtcctcttcttcttcttcttcttcttccacccccgcgacccgccgccgcccccgcgccgaagctcgtggcctcctccgccgtccacgtgaggcaggcagggctaactccgccgcggggcccacggagcagtgggtgggtggggcccgcggcccgcaccgtccctcggatcgcgcggggcccacctggggggcaattccgtctccttcctccctctcgcttacgaactccgctaccaaccgcttccttttccttctgctgctgctgctgctgctgctggtggtggtagacagcgaagccggcgaaccacctcggtttcgttggcatcgtcatcctccaggtccacggccactagctaccatctagaagcttccggaagcttcgggaaggaagccgccccccgcgccgccttgccgggcctcgcaatgccggaggagaaggagtacgcgcccgtgcccctcggccaggcgccggaggcggtggaccccgaggacccggtcaagtcgccgccgcggcccacctcgccggcgaactccacccgcaaggcatgttttgctgttcttcaaagctgggtgtcaagaaaatttatgacaggatgcgtagttcttttccctgttgctgttacattcttcatcacctggtggtttgttaagtttgttgatggatttttcagtccactgtatgcaaagcttggatttgatatatttggccttgggtttttgacttccttgctattcatattcctagttggaatatttgtttcttcatgggtgggttcaactgtcttttggattggagaatggtttattaagaaaatgccttttgtaaggcacatatattctgcatcgaagcaagttagcactgctgtttcaccagatcaaaatacaacggcatttaaagaagttgcaataattagtcatccccgtattggtgaatatgcatttggattcataacatcgacgatgatccttcagactgacaaaggtgatgaagaactgtgcagtgtatatgtgccaaccaatcatctatatatcggtgacatcttcttggttaggtctgaggagattataaggccgaatttgtccattcgagaagggatagaaatcattgtttctggaggaatgaccatgccgcaggtgattgcagcaccaggacaaacaccccataagggtcagagcacccgtttaaacagaatgatgagtgcgtgagtacatcaggtctgcccagagttgctgagagagggcaaatcggtggatgacaaagctggaacaaggtgattgagaagcagcattgctggtagattaggcagatcaaaatacgaaagtcagtgttgactagtccgcatcgcttaggtttgctcgctgagtgaaaagttgtgtaatctttcaatcacgctccaaatgtatatcagtactgtgaccaatagtatttatactcctttcaaaagaaaaaaaaacgatagcatttgtaccttgttta

SEQ ID NO: 722 - DNA, 1424 bp, Sorghum bicolor
ggtcactctgtgcccgccaaggttgacgtcgtcgtctctctcttggcggcccgcccgtccgtccccatcccgtcccttgcgtaccccgccaccaaccgctttttgcttgttgctacccgccgccagccaaaagccgcccgtccccccagctcgcccgcccgaagcgacgcctcacccgcatcccgctcccccgcgagaagcttctagaaggggggagaccccggcggagccatggcggaggagaaggagtcgacgtcgatcccgctcagccaggcggcggaggccgtcgaccccgaggacccggccaagtcgccgccgcgacccagctcgcccaccacctccacacgcaaggcatgctgtgctgttcttcaaagttgggtctcaagaaaatttatgactggatgcgtagtccttttccctgttgcagtcacattcttcatcacatggtggtttattcaatttgttgatggttttttcagtcccttatatgcaaaatttggagtcgacatatttggtcttggttttttgacttctctggtattcatatttctggttggactatttgtttcttcatgggttggttcaaccatcttctgggtaggagagtggtttataaagaaaatgccatttgtaaggcatctatattcagcgtcaaagcaagtcagcactgcaatttcaccagatcaaaatacaacagctttcaaagaagttgcaataattcgtcatccacgaattggtgaatatgcatttggattcataacatcaacggtggtccttcagactgacaaaggcgatgaagaactgtgtagtgtgtatgtgccaacaaatcatctatacatcggtgacatatttctggtgaactctgaggagattataagacctaatttatccattcgggaaggaattgaaataattgtttcaggaggaatgaccatgcctcaggtgattgcatcactggagcctatgccgcggaaaagccagagcattcgtctaaatagaatgacgtgatgtaacacaaagtcacatgcaacaagatagcatgacctgtggggcacgattcaggtgccttggctgtatgcttaccatgtgatttggatagaggagcaactctgtgccgagccatcgtggcattccaagtgcaggggaagcatcgtgttgatgctctgggatactattgtctcactcttgttgcgctactctttgtgcactgactagtgcttgtccaaaatgttaacgtcaacgcgtgaggtgtgtgagtgattaaattcgtttacaactgtgcgctgtataacatcttacgttataaagggagcacacaactttgaccagatttcttctttcagattaacattcctgtttgttgattttttttatcgtatgtgtctaactgactatgaatcagctttatgcagaaatacattgct

SEQ ID NO: 723 - DNA, 976 bp, Sorghum bicolor
ctgcccctctgccgctggcagccagcggaagccagccaaccacgccttctcctcgtccccgtcgagccccgacgagggacgcgactcctcaccgcaccgcaccgccccgcgagaagcttcggcgagtaccatccgtcccgccgatcgcaatgccggaggacaaggagtacgcgcccgtgccgctcggccaggcggcggcggaggcgtcggcggtggcgcctgaccccgaggaccccgtcaagtcgccgccgcgacccagctcgcccggcacgtccactcgcaaggcatgctttgctgttcttcaaagctgggtgtcaagaaaatttatgactggatgtgtagttcttttcccaattgctgtcacattcttcatcacttggtggtttattcaatttgtcgatggttttttcagcccactctatgcaaaactggggtttgacatattcggacttgggttcttaacctccctgttgtttatacttcttgtcggaatctttgtatcttcttgggtgggttcaaccgtcttctgggttggagaatggtttataaagaaaatgccatttgtaaggcacatatactctgcatcaaagcaagttagcactgctgtttcaccagatcaaaatacaacggcattcaaagaagtagcaattattagtcatccccgtgttggtgaatatgcatttggattcataacatcaaccatggttcttcagacagacaaaggtgatgaagaattgtgtagtgtttatgtcccaaccaatcatttatatattggcgacatctttttggtaaactccgccgaaattattaggcccaatttgtccattcgtgaaggcatagaaataattgtttcaggaggaatgactatgccacaggtgatcacgtcactggaaccaacacctcggaagagccagaacatccgtttagacagagtgaggactgtatgaggcatgaatgaaagcgttgggtgtttcag

SEQ ID NO: 724 - DNA, 1314 bp, Saccharum officinarum
tccggccgtccccgtcccttcccttgcgtrctccgccaccaaccgcttttgcttgctgctactcgccgccagccaaaagcagccgtcccccctagctcgcccgcccgaagcgacgcctcacccgcatcccgccccgcgagaagcttctagaagggggagaccccggcggagccatggcggaggagaaggagtcgacgtcgatcccgctcagccaggcggcggaggccgtcgaccccgaggacccggccaagtcgccgccgcgacccagctcgcccaccacctccacacgcaaggcatgctgtgctgttcttcaaagttgggtctcaagaaaatttatgactggatgtgtagtgcttttccctgttgcagtcacgttcttcatcacatggtggtttattcaatttgttgatggttttttcagtcccctatatgcaaaacttggagtcgacatatttggtcttggttttttgacttctctggtattcatatttctggttggaatatttgtttcttcatgggttggttcaaccatcttctgggtgggagagtggtttataaagaaaatgccatttgtaaggcatatatattcagcgtcaaagcaagtgagcactgcaatttcaccagatcaaaatacaacagctttcaaagaagttgcaataattcgtcatccgcgaattggtgaatatgcatttggattcataacatcaacggtggtccttcagactgacaaaggcgatgaagaactgtgtagtgtgtatgtgccaacaaatcatctatacatcggtgacatatttctggtgaactctgaggagatcataagacctaatttatccattcgagaaggaattgaaataattgtttcaggaggaatgaccatgcctcaggtgattgcatcactggagcctatgccgcggaaaagccagaacattcgtctaaatagaatgacgtgatgtaacacaagtcacatatgcaacaagatagcatgacctgtggggcacgattcgggtgccttggccgtatgcttaccatgtgatttggatagaggagcaactctgtgctgagccatcgtggcattccaagtgcaggggaagcatcgtgttgatgctctgggatacaattgtctcactcttgttgtgctactctttgtgcactgactagtacttgtccaaaatgttaacgtctatgcttgaggtgtatgagtgattgaattcgtttacaactgtgagctgtataacattctacgtcacaaagagagcacacaactctgaccagatttcttctttcagattaacattcttgtttgttgatttgttt

SEQ ID NO: 725 - DNA, 1350 bp, Panicum virgatum
ggtgcttgctgctactcgccgccagccaaaaggagccgccccagcccgcccgcccgccccccaagagacgcctcacctcgcacctgcttcgttccacccgctccccgcgggaagcttctagaagggggattcaccggcggagccatggcggaggagaaggagtcgacgtcgatcccgctcagccaggcggcggaggccgtggaccccgaggacccggccaagtcgccgccgcggcccagctcacccaccaactccacgcgcaaggcatgctgtgctgttcttcaaagttgggtgtcaagaaaatttatgactggatgtgtagtacttttccctgttgctgtcacattcttcatcacatggtggtttattcaatttgtcgatgggtttttcagtcccttatatgcaaaacttggaatcgacatatttggtcttggttttttgacttctctggtattcatatttatggttggaatatttgtttcatcatgggttggttcaaccatcttttgggtgggagagtggtttataaagaaaatgccatttgtaaggcatatatattcagcgtcgaagcaagtcagcactgcgatttcaccagatcaaaatacgacagctttcaaagaagttgcaataattcgtcatccacgaattggtgaatatgcatttggattcataacatcaacagtagtccttcagactgacaaaggcgatgaggaactgtgtagtgtttatgtgccaacaaatcatctatacattggtgacatatttttggtgaactctgaggagatcataagacctaatttatccattcgagaaggaattgaaataattgtttcaggaggaatgaccatgcctcaggtgattgcatcaatggagcccatgccacggataagccagaacattcgtcttaatagaatgacgtgatttaacaagtcacagatgcagcaaagtaaacattcccaaccttattagccccagctggtgtctttggcgtgtttaactgatggttgcacatcaagcagataatgagacctgtgggtttgtgattctgtgtctgggctgtgtgtttaccctgtgatgtgttacatgtttggataggggaacaactatgttctgagcccatcatggcattgcaaatgcagggtaagcgtcgtgttgatgctttgagatactactgtatcactcatgttgtggtacaactaactagtgaccggttcaaaatgttaatttctacacgtgagagatgtataagtagcttgcctgatttaattcgtttgtaacagtattgatgtataacatcttaaattacaaaaaagaaaagagcatcgatgccctgacctggttttttctgtc

SEQ ID NO: 726 - DNA, 1305 bp, Panicum virgatum
gtttggttagctgccccctcctgcccgctgctgctgccggtgccggtgcctggtggtagtatccagcggagcccaaccaccttgctgccgtcgaggccgccctcggctcctccccgccccgccccgccccgcgagaagcttccggaagtcccggcgaggagtatccggcccctcgatcgcaatgccggaggacaaggagtacgcgcccgtgccgctcggccaggcggcggcggaggcggcggcagcgcccgaccccgaggaccctgtcaagtcgccgccgcggcccagctcgcccgccacgtccacgcgcaaggcatgctttgctgttcttcaaagctgggtgtctagaaaatttatgaccggatgtgtagttctattcccaattgctgtcacgttcttcatcacttggtggtttattcaattttttgatggttttttcagcccactctatgcaaaacttgggtttgacatatttggccttgggttcttgacctccctggtgtttatacttcttgttggaatatttgtgtcttcttgggtgggttcaactgtcttctggattggagaatggtttataaagaaaatgccatttgtgaggcacatatactctgcgtcaaagcaagttagcactgctgtttcaccagatcaaaatacaacagcatttaaagaagtagcgattattagccatccccgtgttggcgaatatgcatttggattcataacatcaaccatggttcttcagacagacaaaggtgatgaagaactgtgcagtgtttatgtgcctaccaatcatttatatattggtgacatttttttggtaaactctgctgaaattataaggcccaatttgtccattcgagaaggcatagaaataattgtttcgggaggaatgactatgccacaggtgatcacgtcacttgacccaactcctcgcaagaaccagaacatccgtttggacagagtgatgaccgtatgaggcatgaaactagggttgattgtgcagaggcgagtgccaatacatatgatcggttttggattagaagctggagcacggggcattcagaacgctaaagtgtggcaccagatacatggcagccagaaatgtgatcgtcctgcactgccttgtgttttgtgtagttgtgttgcgcagttgattggccagtgacatgaacattgcagctccagccacgtggcctttgcctgattcaagttgtatcaaccagcttttgtatatacaaaaattccttactaagagctgctgaaatcaccaattcttgcacgttatattttgagtgtggtgaagaa

SEQ ID NO: 727 - DNA, 1222 bp, Triticum aestivum
tttccgccagccggggaaaaggcagccgcagccagcgacgcctcaccccacccgacctccctcctcacccccgcccccagccgcagcgcccgccggaaggttctagagatggcggaggagaaggagtcgacgtcggtcccgctcagccaggcggcggaggccgtcgaccccgaggacccggccaagtcgccgccgcgccccagctcgcccaccacctccacccgcaaggcatgctgcgctgttcttcagagttgggtgtcaagaaaatttatgactggatgtgtggttctttttcctgtggctttcacgttcttcatcacatggtggttcgttcartttgttgatgggtttttcagcccactatatgcaaaactcggagtcaacatatttggtcttggttttctgacttctctggcattcatatttctggctggaatatttgtttcttcgtggttgggttcaactgtcttctgggttggagaatggtttataaagaaaatgccatttgtaaagcacatatattcggcatcaaagcaagtcagcactgccatttcaccagatcaaaatacgacagcatttaaagaagttgcaataattcggcatccacgtgtcggtgaatacgccttcggatttataacatcaactgttgtccttcagacagacaaaggtgatgaggaattgtgtagtgtttatgtgccgacaaatcatctatatattggtgatatattcctgctgaactctgaagagatcatcagaccaaacttatccattcgagaaggaattgaaattatcgtttctggaggaatgaccatgccacaagtaattgcatcgctagatcccatcccaaggaagagccagagcatccgcctaaatagaataatgacatgaggatgtgtgagtcatcaaagcaacgggtcgcgaagggtggatggaactccagtgctggtctgtttgtgctgtaagtttcttacgtgtaaaatgtcaaggttggatacgggaacgtgatgaccaagctggacggaagtatcgtaccgatgccctggaatactgttatgtgacacatgttgtttttctctgcgtttgctgactgatccaaagtgttaacttcgatgcaccggtgttgtacaactagtgtgcctgattacattcatttgtaagtgtgtcgtgtaataccatgtcgacttcgttactatagtatacataccatactgactggtttctt

SEQ ID NO: 728 - DNA, 1115 bp, Triticum aestivum
atgccggaggagaaggagtacgtcgccgttcccatgggccaggcgccggagcccgcggaccccgaggaccccgwcaagtcgccgccgcgccccacctcgccggccacctccacccgccaggcatgctttgcggwccttcaaagctgggtgtcaagaaaatttatgactggatgtgtagttattttcccaatggctgtgacattcttcatcacttggtggtttattcgattttttgatggattcttcagtccactctatgcaaagcttggagtcgatgtatttggccttgggtttgtgacatctctggtattcatatttattgttggaatatttgtgtcatcatgggtgggctcaactgtcttctgggttggagaatggtttataaagaaaatgccatttgtaaggcacatatattctgcatcaaagcaagttagtactgctgtttcaccagatcaaaatacagcagcatttaaagaagtggcaataattagccatccccgtgctggtgaatacgcatttggrttcataacatcgagcatgattcttcagactgacaaaggtgatgaagaaytgtgtagtgtctatgtgccaaccaatcatctatatattggtgatatctttttggtgaactctgcggaaattataaggcccaatctgtccattcgagaagggatagaaataattgtctctggaggaatgaccatgccgcaggtgattacagcgctaggacctgcccctgataagaacgagggcacccgtttaagcagaatgatgactgtctgaagcttaaaatatcgccagcatatctcagctactaaaggaacgccaaagtcgtggatgatgctgcatctgatgtacaatttgtagattagaagctggaacacaaggactgcgatggagtaaacaccggttgtatattaggcgggttagaaattaaagtggggtgctgatgatggtcacgcagcacaccgcacttaggcggcttactgaggctactgacaatggtttgtggttcttatgtgctcacagaatgagtgcttagttactcgtgttaggtcattacaatgtaacttcaactgagacaggttatttattttttaattttgattgatgct

SEQ ID NO: 729 - DNA, 1297 bp, Triticum aestivum
  misc_feature (1283)..(1283): n is a, c, g, or t
gcagccgcagccagcgacgcctcacctcacctgaccccccctcctcgccccgccccccgccgcaccgcccgccggaaggttctagagaaggagggacacgccatggcggaggagaaggagtcgacgtcggtcccgctcagccaggcggcggaggccgtcgaccccgaggacccggccaagtcgccgccgcgccccagctcgcccaccacctccacccgcaaggcatgctgtgctgttcttcagagttgggtgtcgagaaaatttatgaccggatgcgtagttctttttcctgtggctttcacgttcttcatcacatggtggttcgttcaatttgttgatggatttttcagcccactatatgcaaaactcggagtcaacatatttggtcttggttttctgacttctctggcattcatatttctggttggaatatttgtttcttcatgggtgggttcaactgtcttctgggttggagaatggtttataaagaaaatgccatttgtraagcacatatattckgcatcraagcaagtcagcactgccatttcaccagatcaaaatacgacagcatttaaagaagttgcaataattcggcatccacgtgttggtgaatacgcattcggatttataacatcaactgttgtccttcagacagacaaaggtgatgaggaattgtgtagtgtttatgtgccaacaaatcatctatatattggtgatatatttctgctgaactctgaagagatcatcagaccaaacttatccattcgagaaggaattgaaattatcgtttctggaggaatgaccatgccacaagtaattgcatcgctagatcccatcccaagaaagagccagagcatccgcctaaatagaataatgacatgaggatgtgtgagtcatcaaagcaagggtcgcaaatgggtggatgggactccagtgctggtctgtttgtgctgttcgtttcttacgtgtaaaatgtcaaggttggatacgggaacgtgatgaccaagctggacggaagcatcgtaccgatggcctggaatgctgttatgtgacgcatgttgtttttctctgtttgctgactggtccaaagtgttaacttcgatgcaccggtggtgtacaactagtgtgcctgattacattcatttgtaagagtgtgtcgtgtaataccatgtcgacttcgttactatagtatacataccatgctgactggtttctttgtgaacatctctttgtttcatggtctgctgtgatatactccctcctgtccataataagtgtcgggnaactaaagccagga

SEQ ID NO: 730 - DNA, 1407 bp, Cenchrus ciliaris
tcaaatcaatcctccccagggcaggcaaaggcgggggccaagatccaatctcgctgctgccactcgacgatcccatcgatctccagcamsstcggcgaccatggctcgctgccaccatctcctcctcctcctcctctcgctctttcttgccttggctgctgctgatccggggaagggtcaccagggagaagcctccgcggtcttcatggatgcggcgtcgcaccgctacctgcggggtcagccagccgacgaccaggcttcaatgtcgttaaatgaagtttccgcagccgtttccgtcttgcttggttttgcwyykycaacctccctaccggcgctttcttcttcgcagttaaacaaagtgcttcttcccaatccattcgatmssccscsygctgttttcctcgtgcaaattgctgggwccagtgcctcagctgatagcttcgtatctgaagccggcagcattttcaagacaaggatcgaaggcgcaaacaatgctgctacagggcttacagataaggatgaacttattatcattcattcagatgaatctctagatcatactggatcagatcttactgatagtgaactttccagcttggcaaactggttggagggatcgtatcagaagtctactggtaaactagtcattcccttggagagtggaagtagtcttactttgctacttcataaggaagcagacttggagtttgtgtccagcttggcttcccttcttaaaactatagaaagggctattcaggtccatgaagacttctctggtgtactcagccccgcagagttattagtatgccatttcactgggataaaggctctggaggatgaatacacttccacggaaattgttaagcagggaaccgaaatagttcggagagctgtcaccaaagcgtttcagtccctacatggagcatataaagggaaaattgttgggctggtggtatccacacaggaggcttcatcattcctagggtccataattgaggcaccgtcttcattgcacatttcgagacgactagaagaagcaagccaaactaatgctataatagcctcggttgtacttgttcgaaagagtttggcatggattacagggatcatcctgctggtttcaactctcataggggtttgcttgctgatgaacatgccacttaccagggacaccctcctgtattcaaatgtcaagattgattagtttggaatgggttggtttggatagagacaaaacgacccctattttttttttttcatttttgtgaagaaaaaaaaacatgtatcagctattttaatttgttgttgggttccggtaaataagccaggggagtggttgagaaacgatacgattgttgctcctgccttgtatgaataataaataaatctgtgaatcttatatttaga

SEQ ID NO: 731 - DNA, 1594 bp, Zea mays
aacatacttggctgggccttccccagcggcgagggcgtggcccgttgtacaagtataacaacaattggcccagcgtagcatgcccgtggtggtggcgtcatcgtgtctcctcgatcccctctcgttcctccctcgtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagttcttcttcctaatccatttgatagaccgcgtgctgttttcctcgtgcaaattgatgggttcaatgttcctagcttcgtatctgaaggcagcaacattttcaagaccaggattgaaggtgcaaacatcgctgatacagggcttacagataaggatgacttaattgtcattcattcagatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttattagaatgccacttcacagggttgaaggctctggagaatgaatatggttctggtgaaattgttaagcagggaacagaaatagttcagagagctgtcaccaaatcattccagtccctacatgaagcatacaaagggaaaattgttgggctggtaatatccacaaatgaggctccatcatccttaggatccataattgacgcaccatcttcactgcacatttcaagacggctagaagaagcaagcaagactacagacatagcctctgtcgtacttgttcgaaagagcttggcatggattacagggatcatcctgcttgtttcaactctcataggggtttgcttgcttatgaacatgccacttaccagggacaccctcctgtactcgaatgtcaagatcgattagtttgaaggggtgttcgcggcagctactcttggggttcaactttggccttgtgtatttatgggatggatttcagatggtagagacgtatgcttgtgctgttcacaaaaccagtgtacaatgtgatactaggtgctacgtgcctttctttttttaatctgtgcttccatcttgcctgtatgggctgttttgttgttgggttccggtaaataatccagaacagtggcacaaacgattagttgttgcatgctactgccttttctgaataaatctgtcattgtaatcga

SEQ ID NO: 732 - DNA, 1575 bp, Saccharum officinarum
aagcacgcttgtggtggtggcgtcgtcgtgtctcccccgatcccctctcgtttcctctcccctcgtcgtctcgtcaattcaagatccaatctttgctgctgccactcggcgatcccgatcgttctcgagcaaggtcggtggccatggctcgctgccgccaccacctcctcctccttcccctctttcttgccttggctgctgctgctccggggaaggcgcagagtcatggggaagcctccgccgtcttcatcgatgccgcgtcgcaccgctacctgcgggaccagcaagccgacggccaggacgcttcaatgtcgttaaatgaagtttctgcagctgtttctgtcttgcttggttttgcaccgtcaacctcgctaccagcgatttcttcttcgaagttgaacaaagtgcttcttcctaatccatttgatagaccgcgtgctgttttccttgtgcaaattgctgggtccgatgcctcagctcctagctttgtatctgaaggcagcaacattttcaagaccaggattgaaggtgcagacagcactgatacagggcttacagatacggatgatttaattgtcattcattcagatgaatctctagatctttctcgatcagattatcttgataatgaactttccagcttggcaaactggttggagggatcttatcagaaatctagcggcaaactagtcattcccttggagagtggaaacagtctcactttgctacttgataaggaagcagacatggaatttgtgtccagcttggcttcccttcttaagactattgaaagggcaatccaggttcacgaagatttctcaggtgtcgtgaaccgtgcagagctactagaatgccacttcacagggataaaggctctggagaatgaatatggttccactgaaattgttaagcaggcaactgaaatagttcagagagctgtcaccaaatcattccagtccctacatgaagcatacaaagggaaaattgttgggctggtaatatccacaaaggaggcttcatcatccttaggatccataattgacgcaccttcttcactgcacatttcaagacggctagaagaagcaagcaagactaaagaagcctctgtggcacttgttcgaaagagtttggcatggattacagggatcatcctgcttgtttcaactctcataggggtttgcttgcttatgaacatgccacttaccagggacaccctcctgtactcgaatgtcaagattgattagtttgaagggtgttctcggcggccactcttggggttcaactttggcttgtgtagttatgggatggatttcggacggtagagatgtattcttatgctgtttacaaaaccagtgtacaatgggatactaggtgctacgtgtttttttttttttgaatctgtgctgcactgctgcctgtatgggttgttttgttgttgggttccggtaaataatccagaggagtggaacaaacgattaattgttgcagaatgctactgccttttccgaataaatctgtgacgattgtaatcgaatttcaacttgaataacagtgtacatgctatgtttgtggcaa

SEQ ID NO: 733 - DNA, 1479 bp, Panicum virgatum
ggcctccgcatcatcaaatcaaatcattccgggcaggggccaagatccaatcttgcttgacgatcccatcgatctcgagcaaggtccgcgaccatggctcgctgcctcatcctccttcacctctttcttgccttggcttctgctgcttcggggcacggacagggtcaccatggagaagcctccgcggtcttcatcgacgccgcgccgcaccgctacctgcgggatcagcaagccgacgaccaggggacttcaatgtcgttaaatgaagtttctgctgctgtttccgtcttgcttggttttgcaccgccgaccgccctacctgtgctttcttcttcgcagttaaacaaactgcttatccccaatccattcgatagaccgcgagctgttttcctcgtgcaaattgctgggtcctatgcctcagctgatagcttcgtatcagaagccagcaacattttcaagacaaggattgaaggtgcaaacaacaatgctacagggcttacagataaggatgaactaattatcattcgttcagatgaatctctagatcatcctgagtcaggttttcttgctagtgaactttccagcttggcaaactggctggagggatcatatcagaagtctagcggcaaactagtcattcccttggaaagtggaaataatcttactttggtacttgataaggaggcagacttggaatttgtgtctagcttggcttcccttcttagaactatagaaagggctattcagatccatgaagacttctctggtgtcatcagccctgcagagttattagtatgccacttcacagggataaaggctctggagaatgaatatgcttccacggaaattgttaagcagggaaccgaaatagtgcgaagagctatcaccaaagcgtttcagtccctgcgtggagcatataaagggaaaattgttgggctggtgatatccacagaggaggcctcatcattcttaggatccataattgaggctccatcttcattgcacatttcgagacgactagaagaagcaagccagactaatgctacagcctccattgtgcttgttcgaaagagtttggcatggattacagggatcatcctgcttttttcaaccctcataggggtttgcttgctcatgaacatgccacttaccagggacaccctcctgtattcaaatgtcaagattgattagtttgaagcggccagttggactttggcttgtgtagttatgggttggttttggatagagacgtatggttatgctgttgacaaaaccagtgtgcaatacgtgcttttgccctgtacatgggctgttttgttgttgggttccggtaaataagcgagaggttcttggggaatgctgctttgttgcagaatgctacttccttgtctgaataaatctgtgatgacggttgtaatcggattattttttttgccccctcgaattcaataagaggtgctaatattcgagatgctatgt

SEQ ID NO: 734 - DNA, 1208 bp, Zea mays
tagcccctccgagccaccaggggtggcgttgatacagcccccacctggcctcatcgcccctcagagttgtggtacagttgtactgagctgagctgccggaggcagaataggagaggcaggcgatgacgatggcgacgaaggcggcgtgcgtgctggcggtgtgggtgctcgtcgcatcgggcctgtccgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctacttcaagtataacgttacggaaatgctgtcaagtggatggatacaggtttcaaatggtaaggaatatgcactgagcgatgtcatcgataccatcaaacatgcttttgggggatcaccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacgtatgatccccttgtgcttgccaattcaactgtagagatcatgacacagttcgatgaatttgaggtgcctgcagctctttatacagcctaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgccca

SEQ ID NO: 735 - DNA, 1262 bp, Saccharum officinarum
tctgccttttggcctcgtcgccccgcagagttgttgtactgagctgagctgccggaggcagaggaggagagggaggcgatgacgacggcgtgcgtgctggcggtgtgggtgctggtcgccgcgggtctggccgacctgggctccgcccgcgcgccactgggcagcaagccgcagcgggagttcgactacttcgcgctctccctgcagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgacatggacaagatattgccactgaaggaggtgcttgacaagtactggccgtccctctactgctccaaatctggaacttgcttcagcggcaagggactcttctgggctcacgagtgggagaagcatggaacttgctctgcccctgtggttcaggatgaactacagtatttcaccattgcccttgacctctacttcaagtataacgttacggaaatgctgtcaagtggagggatacaggtttcaaatggtaaggaatatgcgctgagcgatgtcatcgataccatcaaacatgcttttgggggatcaccacaaattgtttgcaagagtggttcagtccaagaacttaggttatgcttcgacaaagaattgaagcctcgtgattgtcttactacttctttgacgattggaagtgtatcaaaaagcaagcactgcccacggtacatcaccttgccaacatatgatccccttgtgcttgccaattcaactgtagaggtcatgtcacagttcgatgaatttgaggtgcctgcgtctctttatacagcctaagatgcagtaattgcagcagagcattccatggctgcgataaagcgccatggccgcatctcttgggcaattatgatagcagaaggtgctcgcgtgagcacctatagatccaggcacatttatccctgggatattcaatcatttgtatatgcacttgaaagagaactggcgtcttttcagcctggaaatttataagctttatgtaaccttgaaggtcggatatggtcaatgcatacacaaaatctgtagctggaggtagaatttgatgtgcaatattcaaaatggtgttggcctcagggctccatgtcatatatattgcacatgtaatgtaattcgctaaatcaaaattgtatcttgaggta

SEQ ID NO: 736 - DNA, 1319 bp, Panicum virgatum
tactgagcagctgcccgccccaccgctgcccctagaggccgggagcgagagaggaggaggaggaagagatggcgatggcgacggcgaggacggcggtgtgcgtgctggtggtctgggcgctggtggccgccggcctgggctccgtctccgcgcgcgcgccgctgggccgcaagccgcagcgcgagttcgactacttcgcgctctccctgcagtggcccggcaccatctgcgcctccacccgccactgctgcaccaccaacgggtgctgccgctcggagccgctccagtggttcacgatccatggtctgtggccggactatgacgatgggacatggccgtcgtgctgccgccgcacccagttcgagatgaacaagatactgccactgaaggatatccttgacaagtactggccgtccttgtactgctcctcctcttccacttgcttcagtggcaagggacccttctgggctcacgagtgggagaagcatggaacatgctctgcccctgtggttcaggatgaattacaatatttcaccattgcccttgacctctacttcaaatataatgttacggaaatgctgtcaagtggaggtatacagatttcaaatggtaaggaatatgcactgagcgatgtcattgataccatcaaacatgcttttggggggtcaccacaaattgtttgcaagaagggctcagttgaagagctcaggttatgcttcgacaaagaattgaagcctcgtgattgccttactacttctttgacgaatggaagtgtgtcaaaaacaaagcattgcccacagtacatcacactgccaaaatatgatccccttgtgcttgccaattcaactggagagatcatgaaacagttcgacgactttgaggtgtctgcagcaatttatacagcctaacatgtagttgttgcagcagagcaatccatggctgtgacgaaacaaatgtcttcagggccacgaactgcatttatgatagcaggtggttgcctgagcactccagggaaattgatgtctgtgaatcaattatttgtacactaggaagagaaccgtactcttttagatccatgcgaattgaaatttacaggttttacgaaaccttgaaggtcggatcaatgtatatacacattccatagctggatggtgtccttgttgccattattctaaaggtttctggtgcaagttttaaaataatcgtgttggtttcagctctatgttataggaattgccaatttgtaaactcaaaatcgaaccgtgagctaggatttttcaagtgacgagagaagaagaaactcagaactatattatcat

SEQ ID NO: 737 - DNA, 1652 bp, Hordeum vulgare
  misc_feature (1652)..(1652): n is a, c, g, or t
aaggaaccagctcaagctcaaagctccagagcctcgtcccaagactcccacgcgcacaatcgcaaacacacgcctcaaagaagcggccatggcgtcgtcgagcttcaaggtgacgcggatctcggagggcgcggtgaagccggcgtcggagacgcccgaccacacgctgccgctggcgtgggtggaccggtacccgacccaccgcggcctggtggagtcgatgcacatcttccggtccggcgccgacgcggcccccggcgtgatccgcgaggcgctgggcaaggcgctggccttcttctacccgctggcggggcgcatcgtggagcagccggagaaggggtgccccgccatccgctgcaccgccgacggcgtctacttcgcggaggccgtcgccgagtgcagcctggaggacgtccggttcctggagcgccccctgctgctccccaaggaggacctcgtcccctaccccgccgccgacctctgggccgtcgagccccacaacaccatcatgatgatgcagatcacgaaattcacatgcggcgggttcgtgatgggcctccggttcaaccacgcgtcggcggacggcatgggcgcggcgcagttcatcaaggcggtcggcgacatggcccgggggctcccggagccgacggtgaagccggtgtgggacagggagaagttccccaacccgagcatcaagccgggccctctcccggagctcccggtgctggcgctggactacatcgtgctcgacttccccacgggctacatcgacgggctcaagacgcagtacaaggcgcacagcggcaagttctgctccggcttcgacgtgctgacggccaagctgtggcagtgccgcacccgggcgctgaacctggagccggacgccacggtgaagctgtgcttcttcgccagcgtgcgccacctgctgaagctggacgccgggtactacggcaactccatcttccccgtgaagatgtccgggacgagcaagaaggtgctggagtcgtcggtgatggaggtgatcgacatgatccgggaggccaagcagcggatggcggtggagttcttccagttcgccaaggaggagacgcggcaggaccccttccagatgaccttcgactacgagtccatctacgtctccgactggagcaagctggggttctccgacgtggactacggcttcggcccgcccatgttcgccggaccgctcgtcaacaacgacttcatcgcctccgtcgtcatcctcaaggcgccgctgccgctggacggcaccaggatgctcgccagctgcgtcaccaaggagcactcgcaggagttcgcccgcggcatgaaggaggacctgccatgagcgagcgacttccctttgctggaccggagaaaatcttcgcgtcgtggagctgctgatacggttgtttggttgatatcgttgctgctaatgttgttgtatttgtacctgttctggtgtactgctgctctcgttttcgctgtacttactttgtttctacatcttgagcaatacgttactattcttattagaaacctaggcagccgatttgatttttttaatcatttgatacgagacaataaaaatgatatatacctgtatttgattatatttgattgatgatggcttgtatgatctgcaaaaaaan

SEQ ID NO: 738 - DNA, 1597 bp, Leymus cinereus x Leymus triticoides
ccgttgctgtcgcaaaactccacacacctcagagaagagagaaacccagagccagagcggccatggcgtcgtcgagcttcaaggtgacgcggatctcggagggcgcggtgaagccggcgtcggagacccccgaccacacgctgccgctggcgtgggtggaccggtacccgacccaccggggcctggtggagtcgatgcacatcttccggtccggcgccgacgcggcccccggcgtgatccgcgaggcgctgggcaaggcgctggccttcttctacccgctggcsggccgcatcgtggagcagccggagaaggggtgccccgccatccggtgcaccgccgacggcgtctacttcgcggaggccgtggccgagtgcagcctggaggacgtgcggttcctggagcgcccgctgctgctccccaaggaggacctcgtcccctaccccggcgacgacctctggggcgtcgagccccacaacaccatcatgatgatgcagatcacgaaattcacctgcggcgggttcgtgatgggcctccggttcaaccacgcgtcggcggacggcatgggcgccgcgcagttcatcaaggccgtgggtgacatggcgcggggcctcccggagccgacggtgaagccggtgtgggacagggagaagttccccaacccgagcatcaagccgggccctctcccggagctccccgtgctggcgctggactacatcgtgctggacttccccaccggctacatcgacgggctcaagacgcagtacaaggcgcacagcggcaagttctgctccgggttcgacgtgctgacggccaagctctggcagtgccgcacccgggcgctsaacctggagcccgacgcsacggtgaagctstgcttcttcgccagcgtgcgccacctgctgaagctggacgcgggctactacggcaactccatcttccccgtgaagatgtccgggaccagcaagaaggtcctggagtcgtcggtgatggaggtgatcgacatgatccgggaggccaagcagcggatggcggtggagttctcccagttygccaaggaggagacgcagcaggacccgttccagatgaccttcaactacgagtccatctacgtctccgactggagcaagctcgggttctccgaggtggactacggcttcggcccgcccatgttcgccggcccgctcgtcaacaacgacttcatcgcctccgtcgtcatcctcaaggcgccgctgccgctggacggcaccaggatgctcgccagctgcgtcaccaaggagcactcmgaggagttcgcccgcggcatgaaggaggacctgccctgagcgccttttgctagaccgagaaaaccttcgcgtgcagggtgggtcgaagcatggtggagctgctgatacacttgtttggttgatattgttgctaatgttgttgtatttgtacctgttctggtgtactgctgctctctttttcgtygtayttactttgtttctacatcttgagcaatacgttactattcttagaatgtagacagycaatttgattttttaatcatttgatacgagacaataaaaatgatatatacctgcattygattaaaaaaaaa

SEQ ID NO: 739 - DNA, 1703 bp, Zea mays
actacaaccagtacacgacgcgctgtgcagcctgcaagctgcaaggcaagttccgtccagctcctcctccatttaagccgcctgcctggtgcctccagtccacccaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggccttcttctacccgctggcgggccgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcagatcaccaagttcacctgcggcggcttcgtgatgggcctgcggttcaaccacgcgtcggcggacggcatgggcgcggcgcagttcatcaacgcggtgggggacatggcgcgggggctggcggagccgagggtgctgcccgtgtggcaccgggagaagttcccggacccgagcatcaagccaggcccgctcccggagctgcccgtgctggcgctggactacgtcgtgctcgacttccccacggcctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggccgacaaggtgctggcctcctcgctcgtggaggtggtcgacatcatccgggaggccaaggacaggatggccgtcgagttctcccgcttcgctggggaggagacggaccaggacccgttccagatgaccttcaactacgagtccatctacgtctccgactggagcaagctcggcttctccgaggtcgactacggcttcggcccgcccatcttcgccggcccgctcgtcaacaacgacttcatcgcctccgtcgtcttcctcaaggcgccgctcccgctcgacggcaccaggatgctcgccagctgcgtcaccaaggaacactccgaggagttcgcccgtggcatgaaggaagacctgccctgaacttgttcttcctagcttattatatactgctgatgatcatcctgagccctggctgcagggagatgatgaatggtgacgtaaacatgcttctgtttcgttgatgctgttgttacttttggttgtattttttttggggttcactttatcttggtcaatacgtaccacattagatcacagcaagcaaattcgatcttaatttgtactacaccatttgatatgagaccgagacaataaaaaaggttatactgtccatttttccgttgtttg

SEQ ID NO: 740 - DNA, 1843 bp, Oryza sativa
agtgcaaatcacgttcattgtttctttttatttaaactcaaatcacgtcgagattgttggagaggcgatcacacacagccagctgcatttttgaattgaacgggtaagcggcatccgtgcgcgatctgagccgttgattccaccgaacgcccccggctgctacgacacctccgtgtggggcccacgtgacagcgacccactcgcccaacactccgccgctccatttaaggccaagctgtttgcacgcagccactactcgaagacgaatcgtaaaagctcaaaaaaaaaaaagagaaaaaaagaaaaaaaagggagacgcggccatggcggggacggggagcttcaaggtgacgaggatctcggagggggcggtgaagccggcggcggcgacgccggaggagacgctgccgctggcgtgggtggaccggtacccgacccaccgcgggctggtggagtcgatgcacatcttccggtcgggcgccgacgcggccccgggcgtcatccgcgacgcgctcgccagggcgctggtcttcttctacccgctcgccgggcgcatcgtggagcccgaggccgggtcccccgccatccggtgcaccgccgacggcgtctacttcgccgaggccgccgccgactgcagcctggaggacgtccgcttcctggagcgccccctcctcctccccaaggaggacctcgtcccctaccccggcgacgaccgctggggcgtcgagccccacaacaccatcatgatgatgcagatcaccaaattcacctgcggcgggttcgtgatggggctccggttcaaccacgcgtcggcggacggcatgggcgcggctcagttcatcaacgcggtgggcgacatggcgcgggggctcccggagccgagggtgaagccggtgtgggacagggagaagttcccgaacccgagcatcaagcccggccccctgccggggctgccggtgctggcgctcgactacatcgtcctcgacttccccaccggctacatcgacggcctgaaggcgcagtacaaggcgcacagcggcaagttctgctccggcttcgacgtgctgacggcgaagctgtggcaatgccgcaccagggcactcaacctcgagcccggcgccaccgtgaagctctgcttcttcgccagcgtgcgccacctgctgaagctggacagggggtactacggcaactccatcttcccggtgaagatgtcagcgccgagcgagacggtgctgtcgtcgtcggtgatggaggtggtggacatgatccggcaggcgaaggagaggatggcggtggagttcttccagttcgccaaggaggagacggagcaggacccgttccagatgacgttcaactacgagtccatctacgtctccgactggagcaagctcgggttcgccgaggtggactacggcttcggcccgcccaagttcgccggcccgctcgtcaacaacgacttcatcgcctccgtcgtcatcctcaaggcgccgctgccgctcgacggcacgcggatgctcgccagctgcgtcaccaaggaacactcggaggagttcgtccgcggcatgaaggaggacctgccatgaactgagcaaatgaggtgatgagctttttttcttttgttacttgaagctgctgcttgtgagctgaagtgaagggcttcttctaatagggaggggaacacatgctggtgaaaaatgatgttgttgtaagaggcgtattttgtttgtatttatttgtttctttactcttggttaatacggattcgagttatgttcttagacagtttaatatttgtaccatttgatatgggaataaaagaaaagatatactctccatttgatta

SEQ ID NO: 741 - DNA, 1560 bp, Panicum virgatum
catctccacacaagcccgagacccgagaggaggtagagcagagcagagggggagtagtcgtcgtcgtcggcggcggcggcggcgcgaggtggagatggcggggttcaaggtgacgcggatctcggagggcccggtgaagccggcgtcggcgaccccggaggagacgctgccgctggcgtgggtggaccggtacccgacccaccggggcctggtggagtcgatgcacatcttccggtcgggcgcggacgcggcgcccggcgtgatccgggaggcgctgggcaaggcgctggccttcttctacccgctggcggggcgcatcgtggagggcgcggagcccgggtgccccgccatccgctgcaccgccgacggcgtctacttcgcggaggccgaggcggactgcagcctcgaggacgtgcggttcctggagcgcccgctgctgctgcccaaggaggacctcgtcccctaccccggcgacgaccgctggggcgtcgagccgcacaacaccatcatgatgatgcagatcaccaagttcacctgcggcgggttcgtgatggggctccggttcaaccacgcgtcggcggacggcatgggcgccgcgcagttcatcaacgccgtcggcgacatggcgcgggggctcgcggagcccaaggtgaagcccgtctgggaccgtgagaagttccccaaccccaagatcaagcccggcccgctcccggagctccccgtgctggcgctggactacatcgtcctcgacttccccaccggctacatcgacggcctcaagaagcagtacaaggagcacagcggcaagttctgctcgggcttcgacgtgctcacggccaagctctggcagtgccgcacccgcgctctgaacctggagcccaacgccgaggtcaagctctgcttcttcgccagcgtccggcacctgctcaagctcgacaggggatactacggcaactccatcttcccggtgaagatgtccgcgccggctgagaaggtgctcggctcgtccatcatggaggtcgtggacatgatccggcaggccaaggacaggatggccgtggagttcttccagttcgccaaggaggagaccgaccaggacccgttccagatgaccttcaactacgagtccatctacgtctcggactggagcaagctcgggttctcggaggtggactacggcttcgggccgccagtgttcgccggcccgctggtgaacaacgacttcatcgcctccgtcgtcatccttaaggcgccgctgccgctcgacggcacgcggatgctcgccagctgcgtcaccaaggagcattccgaagagttcgttcgtggcatgaaggcagacctgccatgaatttctttccttttatagctgaaatggcaaaacttaactgcagggagatgaatggtcacgcaaaagatgcctctgtttggttaatgctgttgttacttttggttgtatttatttgtcatattgtcttggttaatactactttagacagcaaattcgatcatttgtaccatttgatatgagacaataaaaggttatactgtcaatttgattat

SEQ ID NO: 742 - DNA, 1585 bp, Triticum aestivum
ctccacacacytcacagaagcccagagcagagcgggagcggccatggcgtcgtcgagcttcaaggtgacgcggatctcggagggcgcggtgaagccggcgtcggagacgcccgaccacacgctgccgctggcgtgggtggaccggtacccgacccaccggggcctggtggagtcgatgcacatcttccggtccggcgccgacgcggcccccgccgtgatccgcgaggcgctgggcaaggcgctggccttcttctacccgctggcggggcgcatcgtggagcagccggagaaggggtgccccgccatccgctgcaccgccgacggcgtctacttcgcggaggccgtggcggagtgcagcctggaggacgtgcggttcctggagcgccccctgctgctccccaaggaggacctcgtcccctaccccgccgacgacctctggggcgtcgagccccacaacaccatcatgatgatgcagatcacgaagttcacctgcggcgggttcgtgatgggcctgcggttcaaccacgcgtcggcggacggcatgggcgcggcgcagttcatcaaggcggtgggcgacatggcgcgggggctcccggagccggcggtgaagccggtgtgggacagggagaagttccccaacccgagcatcaagccgggcccgctcccggagctccccgtgctggcgctggactacatcgtgctcgacttccccacgggctacatcgacgcgctcaagacgcagtacaaggcgcacagcggcaagttctgctccggcttcgacgtgctgacggccaagctgtggcagtgccgcacccgggcgctgaacctggagccggacgccacggtgaagctctgcttcttcgccagcgtgcgccacctgctgaagctggacgccgggtactacggcaactccatcttccccgtgaagatgtccgggagcagcaagaaggtgctggagtcgtcggtgatggaggtgatcgacatgatccgggaggcaaagcagcggatggcggtggagttcttccagttcgccaaggaggagacgcggcaggatcccttccagatgagcttcgactacgagtccatctacgtctccgactggagcaagctggggttctccgacgtggactacggcttcggcccgcccatgttcgccggcccgctcgtgaacaacgacttcatcgcctccgtcgtcatcctcaaggcgccgctgccgctggacggcacccggatgctcgccagctgcgtcaccaaggagcactcggaggagttcgcccgcggcatgaaggaggacctgccatgagcgagctccttcgctttgctttgccagacgaccgagagaaccttggcatgcatgcatgcatgcaggggggtggggatggaagcatcgtggagctctgctgatgcggctgtttggttgatatattgttgcagatgttgttgtatttgtacctgttttcgttgtatttacttactttgtttctacatccatcttgagcagtacgttaccattcttagaatgtagacagccaatttgattttttaatcatttgatacgagacaataaaaatgatacatacctgca

SEQ ID NO: 743 - DNA, 1231 bp, Hordeum vulgare
cggcacgaggcttgtttttattattaaggcaaacaaggcaaaggaggattcaatcccagtttcgtttgattgcatcggcagggaaggaaggaaccctagcctcctctctcaaaacgaggattgggtgattggattggagcagatgtcgtcggatcctcggaaccctaaccctcctcctcctcccggttcttcgtcatcttcgcttccggcgggccccagttatttcccgctccctttccacctgcagcagcagcagcagcagccggtggcgacctaccagtaccagcagctgcagcaagcacatcagctcttccagcgggacgctcagaccatcacccccgaggcgctcgagagcgtcaaggccgccctcgccaccagcgacgtcctcgacccctctgctgccagggccaccgcctcctcctccgaccctgccgccaagaagaagacaatccctcgtcgagcagccggacagtcctgggaggatcccaccctcaccgagtggcccgagaatgactacaggttgttttgcggagatctaggtaacgaagttaatgacgatgttctctcaaaagccttttcacggttcccctccttcaatatggcaaaggttgttagagataagaggactggcaaaacaaaaggttatggattcgtcagtttttcaaaccctacagacctcgctgcagcaataaaagaaatgaatggaaagtatgttgggaatcgccctattaaattgcgtaagagcaattggaaggagaggacagatgtcgaggctctacaaagacaaaagaatcatattcagaagaaacctaaaacacaaaagaagggtattcttcacaagtaaagctctattgggttgtaccgggtgagccctgtagaacaagacttgctcctttggatgaaggacatctgaaagatacatgggctgttcagtcttacagcaccggtcgatgtgcgcaaggatgataatatacctattgaattgtaacgcttagtaagcaatgttctgttctatctgggtgacaagcatatttttacatttgcaagagttacaatgagtgtttcttgtattaataatcagctttgttttggtgtaacgatgtcactgtattgcaacatagagatgttatttttaggcaatgttttgttttatttgggtgacaagcatatacaaattcaaacctttgrccaatcaaataaatgtggaatatgagatttatttgaaaaaaat

SEQ ID NO: 744 - DNA, 782 bp, Brachypodium distachyon
gatccccaatctgcgtcggggaaggaaggaaggaaggaaccctagcccaaggaaggcgattggattggacatgtcgtcggatcctcggagctccaatccgccccctcctcccggttcttcgtcggcgccgcccccggccgggcccagttacttcccgctccctttccacctgcagcagcagccggcggcgacctaccagtaccagcagtaccagcagctgcagcaagcgcagcaactcttccagcgggacgcgcagaccatcacccccgaggcgctcgagagcgtcaaggccgccctcgccaccagcgacgtcctcgacccttcctccgccagggccgtcgcctcctcctccgacgccgccgccaagaagaaggccatcccccgccgcgccgccggacagtcctgggaggatcccaccctcaccgagtggcccgacaatgactacaggttattttgcggagatctaggcaacgaagttaatgatgatgttctctccaaagctttttcacgatttccctccttcaacatggccaaggttgttagagataagaggactggcaaaactaagggttatgggtttgtgagcttttcaaaccctacagaccttgctgcagcaataaaagaaatgaatggaaaatatgttggaaaccgccctattaaattacgtaagagcaattggaaggagaggacagatgttgaggctctacaaagacaaaagaaccatattcagaagaaacctaaaatgctcaagaagagtattcttcacaagtaaagttctattg

SEQ ID NO: 745 - DNA, 1123 bp, Leymus cinereus x Leymus triticoides
agcaaggattgtttttctgcggggtgattggattggagcagatgtcgtcggatcctcggaaccctaatcctcctcctcctccacctcccggttcttcgtcatctgcgcttccggcgggggccagttatttcccgctccctttccacctgcagcagcagcagccggtggcgacctaccagtaccagcagctgcagcaagcgcagcagctcttccagcgggacgcgcagaccatcacccccgaggcgctcgagagcgtcaaggccgccctcgccaccagcgacgtcctcgacccctctgctgccagggtcaccgcctcctcctccgacgctgccgccaagaagaagacaatccctcgtcgagcagccggacagtcctgggaggatcccaccctcaccgagtggcccgaaaatgactacaggttgttttgtggagatctaggtaacgaagttaatgacgatgttctctcaaaagccttttcgcggttcccctccttcaatatggcaaaggttgttagagataagaggactggcaaaacaaaaggttatggattcgtcagtttttcaaaccctacagaccttgctgcagcaataaaagaaatgaatggaaagtatgttgggaatcgccctattaaattgcgtaagagcaattggaaggagaggacagatgtcgaggctctacaaagacaaaagaatcatattcagaagaaacctaaaacaccaaagaagggaattcttcacaagtaaagctctattgggttgtaccggggtgagccctgtagaacaagacttgcttctttggatgaaggacatctgagaaatacaggggctggtcacttacagcaccggtcaatgtgcgcaaggatgataatataccgattgaattgtaatgcttactaagcaatgttctatctgggtgacaagcatatttttacatttgcaagagttacaacgagtgttgtcttgtatttataatcagctttgttttggtgtaacgatgtcattgtattgcaacatagaggtgtttttaggcactgttccttttttgaaagaattttcagacctacaaattcgaacctttgaccaatcaaacaaatgtggaatataagattatatatctgatgcta

SEQ ID NO: 746 - DNA, 1565 bp, Zea mays
agaaatccatcccgatcctatcgtccccaatttcttctgctccacctaaatagatccgtagccgtagcctaggcgcgcacattgcagaaagatcgagcggaaggtcggcagcaggcgcatagatgcaggggtgagggcacgggcggcagcgcttgacgggcgacgagtaaaccctaacgctttgattgcgggcggcgtcgtctgagccagtcccgagtcgatacgctgtcatgcctgtcaatcctcctccgccacctcctgggtcgtcgtctttggctccggcgggggccagctacttcccgctccctttccacctgcagcagcaccagccgccgccgccgcaggtgccgccgcctatggcggcgagcagctatcagcagtatcagcaacagctgcatcaggcccatcagctcttccagcgggacgcgcagaccataacccccgaagcgctgcagagcgtcaaggctgccctcgccaccagcgacgtcctcgaccccgtcgccgccgccaacgccaggctctccgatccctctaccagcaagaagcccatcccccgtcgcgctgccggacaatcctgggaggatcctaccctcactgaatggcccgaaaacgactaccggctgttctgtggagatctaggcaacgaagttaatgatgatgttctctccaaagcattttcacggtttccatccttcaacatggcaagggttgttagagataagaggactggcaaaactaaaggctatggatttgtgagcttttcaaaccctactgatctggctgcagcaataaaagagatgaatggaaagtatgttgggaaccgccctattaaattgcgtaagagtaactggaaggagaggacagatgttgaggctctggaaagacaaaagaatcatgtcaagaggaagcctaaaattcccaagaagactattcttcacaagtagagatacaaaggccctaccgagggtgaatgccagctcatgtgctgccttgggatgatgctaccttctggaatctctttactctctgcaatgctcggggtggaatcacgcaatgctcggggtggaatcacacgcaagggctgttgtttaatgtgtagtttggaaacttaaattcttttgggatacctgtcttttatcaggatgagtaacccagggatataatttaaataagacatttagttatttaggagatggtttctctctctggtttgacttccccttccaaactaggtctaaggccatcttcagcagatcgtgtaaatggacgtgtaaagtactgttttgcattgtatattgtaatatgaagtgagatagagtctactggagataatcgacttgttcgctttaaggtggattgaggaggattggaagggattaaattctcttctattcaaatttgtataggagaggatttaattctctctaatccctctcaatctacctctaaccgaataagccgggcaacgtgctgcctgttggtccccatggtttaggctggggttgtgggcttgtgaacatagagttagtgttaagtgccacccgatgcaatttgtgctctgtttt

SEQ ID NO: 747 - DNA, 1437 bp, Zea mays
aatcatcaattcatcacggcatcacccccaatttcttctactccaccgaaacataaatctgtagccagcagaaagatcttgcggaaggtggcagacgcatagatgagggtgagagcatttggcggtagcgcttgacgagcgacgagtaaaccctaatgctttgatcgcggcggcgtcgtttgggacactcccgaatcgatccgcctacatgcctatgaatcctcctcccccgccgcctcctgggtcggcgtcttcggcgccggcggggcccagctacttccctctccctttccacctgcagcagcaccagccgcagccgcagatgccgccgcctatggcggcgagcagctaccaacagtaccagcaacagctgcatcaggcgcatcagctcttccagcgggacgcgcagaccataacccccgaggcgctgcagagcgtcaaggctgctctcgccaccagcgacgtcctcgaccccgccgccgccgcgaacgccaggccctccgatccctctaccagcaagaagcccatcccccgccgcgctgccggacaatcctgggaggatcctaccctcactgactggcctgaaaacgactaccggctgttctgtggagatctaggcaacgaagttaatgatgatgttctatccaaagcattctcacggtttccatccttcaacatggcaagggttgttagagataagaggactggcaagactaaaggttatggatttgtgagcttttcaaaccctactgacttggctgcagcaataaaagagatgaatggaaagtatgttgggaatcgccctattaaattgcgtaagagtaactggaaggagaggacagatgttgaggctctgcaaagacaaaagaatcatgtccaaaggaagcctaaaattcccaagaagagtgttcttcacaagtagagatatataggccctaccgagggtgaagggcagctcatggatgcgctgctgccttgggatgatgctacttctggaatgtcttcactctctgcactactggggggcggaaatcacgcaagggctgttgtttcatgcaaattgcaacgagctactgctgccatctgatgcaatttgtgctccgttttactgtttcccatagtttgcgttcatccatttgcggtgttggagtactgtcatggctactgactaaccaggccgagctgaacaagaaccaaatggaattttcagttttggtttcagcaagtaatagcatgacgtgttgtactatctatctcggttccagctcaaggttatgttcttgtccacggcatccacggccgccagcgtctaggaggccaggagggcctgcacgtacttgagctccagtcacttctccaccccttccccccatcacttccttaaggctctgcagctccagattaatttgatttgtattagcaatttatcctcctttt

SEQ ID NO: 748 - DNA, 2079 bp, Oryza sativa
ggcccatttacatctttctcccctttcctcggcttggatctttgattttttatttcttttttggctaaaattcggtgagattaatagtttcgtcgcggaaggccgaaaccctagcaagccaccccaaattcgattcgattcgataagattaagaaggctagcccgatccaagaagagaaggaagaagcgatgtcgtcgtctcggaaccctaatcctcctcccggatcctcctcctcggggaccaattacttccctctccccttccatctgcagcagcaaccgccgcagccgccgccgatggcgatggcgagcacctaccagtaccagcagtaccagcagctgcagcaggcgcagcagctcttccaacgcgacgcgcagaccatcacccccgaggcgctcgagagcgtcaaggccgccctcgccaccagcgacgtcctcgaccccgccaatgccagagccaccgcaacctcctcctccgaccctgccgccaagaagaaagccatcccccgccgcgccgccggccaatcctgggaggatcccaccctcaccgactggcccgacaatgactatcgcttattttgtggagatctgggcaatgaagtcaatgacgacgtcctctcaaaagctttttcacggttcccctccttcaacatggcaagggttgttcgagataagagaactggcaaaacaaaaggatatggatttgtgagcttttcaaaccctactgaccttgctggagcaattaaagaaatgaatgggaagtatgttgggaaccgccctattaaattgcgtaaaagcaattggaaagagaggaccgatgttgatgctctagaaagacagaagaatcacatccagaagaaacctaaaatgcccaagaaaagtatccttcacaagtaaagctatattagccctactaagcgccatccatgtaaacatactttgttgggtgatggggctcaagaaaactactcttactgcaaaggttgtggaccagggagggtgtacatttgactgcagctgtctgttagcagagtggtgcgtcgcttctaagcaatttttcttcttacgacaagctgatgtttacatctgcaggaagtttgttaaagctgaagctagttttgctgatgtttactgagaatgactccctagaatggatggtttgcttaaggtggtaatgatgtgtatttagatatggcatttgcatttaaggatggcattgcaatgtaataaagatgttgttggtattgtagtttatcttataaagtggcatcgcagtacaaggatttggttgtcgcggaaaagagcagcaaagcacgacctttgccaattgaattagaatcaatgcactttgtcattgcatatttgcattgccacacaagcactaggaaatcatgtgaatctgaactgtttggatgacaaagccagatgctcatgctctcatgcacgggaagaaacaagtaacaataacatttgatttgagtcgagtgtagcaagggaccaaagaaatcaaagaagctactagctagctggcttaggctaagctctgcaattcagctagctggctggactaaactcggatcggaattatattgttgttggaatgatagaattaatggagggggggggatcaatattccatggaaagctgacgctggagcttcttgctggcggacctccgttccggctgcgacaagctctggaagccggatgcccggctgctgacgttgacggcgccaagcatcctggagcagaaggtggcatctgttcctgggcggccgcgccgctgcagcagggacaagtcgtggacgtgggcgtcccagctgcggggtgtagtgtgaggaggatgattcgggcagtcgtggtcgtcgtgggcgtcccagctgcggggtgtagtgagaggaggatgattcgggcagtcgtggtcgtggtcgtggtcgtcgtcgtactccagcgtagtggtggtgttgtgaacctgcaggtgctgcatccagtcgtcgtccgccgtgtaggcgtcgaacttcttgtcgtggcggtagtcggcggcggcggcacagtggcagaccatggtggggctatcgg

SEQ ID NO: 749 - DNA, 2356 bp, Saccharum officinarum
gactccaagcatctcgtttcctccggacagtagccaaagggcgactccgaggcgactcaagctacctccgccggatccaccggcttcctcaccgccggtggcctttttaggcgccggtgggttggggaagccgtggatccggtggagggtgtatattttccctagtattacagtagttttagggttagggttggagtcttcttcgagcttcttcggcattggccatggtgggcgggtttctgtgctggtccgtaggcaggaggagcacagcaacaagtatcatctgcaggaggtttggcatcggcgaatttttcttcgttttctttttctgcgtggatgttcgaatcttctgtgtgcttctttgggttgtctgtgtccttctcgttcatggcatcgccgaatccgtatcctacagccttggttgttgttcgtaggagactcggtgcttttaccggtgaagtgttcaccggatttgtgtccctcccctggaggttaagtttccacctgctcctgtatacgggtaggtgtccttggatcccctttgtgggattgctgcttgttggccggagcatgccggtgttgcaactggcgtctgttttcggtgaaaatargatttgctcggggcgttcaacgtttgaacgacactatgtgctgctgatgggcttcaaatttgaagactctttgttgaatcgggaatcggccggaagcttcattctggatcttcttcattgcgggagatggaggaggtctagataattttattttctttcaggggtacctggtcaggggcttkgttgtaataattctgtatcaataaaaaaaaaagggcagacccagtgccagaggctcccacacgagtggggtctggggaagggaataaccgaagcaaagtcttacctccgcagaaattctgcagagagacggcttcgaacccaggacctgatgactcggcgagctagcactcaccaactgctacatgcgaaaagagcgtttccagcttcattgcaaacagaaccaagagggaaattagaaatccatccccaatcctatcacccccaattgcttctgctcccctaaaacatagatccgtagcctagcctcgtgcttcctagaaagatctcccggaaggcgggcaggccggcggcaggcacatagatgcagggtgagggcacgggcggcagcgcttgacgggcgacgagtaaaccctaacgctttgatcgcgggcggcggcgtctgaaccactcccgagtcgatccgccgccatgcctgtcaatcctcctcccccgccgcctcctgggtcgtcgtcgtcggctccggcaggggccagctacttccctctccctttccacctgcagcagcaccagccgccgccgcagatgccgccgcctatggcggcgagcagttaccagcagtaccagcaacagctgcatcaggcgcatcagctcttccagcgggacgcgcagaccatcacccccgaggcgctgcagagcgtcaaggctgccctcgccaccagcgacgtcctcgaccccgccgccgccgccaacgccaggccctccgatccctctaccagcaagaagcccatcccccgccgcgctgccggacaatcctgggaggatcctaccctcactgactggcccgaaaacgactaccggctgttctgtggagatctaggcaacgaagttaatgatgatgttctctccaaagcattctcacggtttccatccttcaacatggcaagggttgttagagataagaggactggcaaaactaaaggttatggatttgtgagcttttcaaaccctactgacctggctgcagcaataaaagagatgaatggaaagtatgttgggaaccgccctattaaattgcgtaagagtaactggaaggagaggacagatgttgaggctctggaaagacaaaagaatcatgtccaaaggaagcctaaaattcccaagaagagtattcttcacaagtagtgatatataggcttgatgtgctgctgcggtgctgccttgggatggtgctacttctggaatctcttcactctctgcactactcgtggtggaatcacgcaagggctgttgtttcatggaaattggcaacgagctgctgctgccttttggtccccatggttaggatgggcttgcgggcttgtgaacatagagttagtgttaagtaccacccgacgcactttgtgccccgttttactgttccccctagttgtacgtttacatggtgttcatttgagatgttggagtagtgtcatggctactgactaacgaggctttggcattatcagatggcttccttggttgggagctgaacaagaaccaaatggaattttcagtttgggttt

SEQ ID NO: 750 - DNA, 1168 bp, Panicum virgatum
aaatccgtagtggagcaacttccttcgcagcaggatcgagcgggaggcggggcagccaggcggcaggcgcacacgcgaaggcggtgagggcgcgggcggcggcgcctgacgaggagaagaaaccctaactcttgggtcgcggctgagccactcccaactccaaagattcgcctccatgccttccaatcctcctccgccgccgcctcccgggtcgtcgtcttcggctccggcgggggccagctacttcccgctccctttccatctgcagcagcaccagccgcagccgcagatgccgccgccgatggcgccgaacagctaccagcagtaccagcagcagctgcaccaggcgcaccagctcttccagcgggacgcgcagaccatcacccccgaggcgctgcagagcgtcaaggctgccctcgccaccagcgacgtcctcgaccccgccaccagcgccggcgccaggccctccgacccctccagcagcaagaagcccatcccccgccgcgccgccggacagtcctgggaggacccgacccttaccgactggcccgaaaatgattataggctgttctgtggagatctaggcaacgaagttaatgatgatgtcctctccaaagcgttctcacggtttccctccttcaacatggcaagggttgttagagataagaggactggcaaaactaaaggttatggatttgtgagcttttcaaaccctactgatctggctgcagcaataaaagaaatgaatggaaagtatgtaggtaaccgcccaattaaattgcgcaagagtaactggaaggagaggacagatgttgaggctctggaaaggcaaaagaatcatgtccagaggaagcctaaaatgcccaagaagagtattctgcacaagtaaagctatataggtcattctgataatgatccctgcagatgtgctgctcccttgggatacttcaggaagttcttctctttctgcactactagtcgagacgaaaggctacctgatgttacttttaggctgtgcgaatacttgtgaccataaaacggagcatcaatagctacttgatacaagctgtgctccatctttctgtttccctttctcaacagttgtacttgcacgttgatgcattctggaacagtattatgacgaatgactaatgagggcgttttggtg

SEQ ID NO: 751 - DNA, 1152 bp, Triticum aestivum
ccacgcgtccgcggacgcgtgggttttgattgcatcggcagggaaggaaggaacccctaaccctggcctcctatttagcggggtgattggattggagaagatgtcgtcggatcctcggaaccctaatcctcctcctcctccacctcccggttcttcgtcatccgcgcttccggcggggggcagctatttcccgctccctttccacctgcagcagcagcagccggtggcgacctaccagtaccagcagctgcagcaagcgcagcagctcttccagcgggacgcgcagaccatcacccccgaggcgctcgagagcgtcaaggccgccctcgccaccagcgacgtcctcgacccctctgctgccagggcctccgcctcctcctccgacgctgcygccaagaagaagacaatmcctcgtcgtgcagccggacagtcctgggaggatcctaccctcaccgagtggcccgaaaatgactacaggttgttttgtggagatctaggtaacgaagttaatgacgatgttctctcaaaagccttttcgcggttcccctcctttaatatggcaaaggttgttagagataagaggactggcaaaacaaaaggttatggattcgtcagtttttcaaaccctacagaccttgctgcagcaataaaagaaatgaatggaaagtatgttgggaatcgccctattaaattgcgtaagagcaattggaaggagaggacagatgtcgaggctctacaaagacaaaagaatcatattcagaagaaacctaaaacacaaaagaagggtattcttcacaagtaaagctctattgggttgtaccaggctgagccctgtagaacaagacttgctcctttggataaaggacatctgaaaagtatagtggctgggcaccggtcaatgcgtgcaaggatgatactatacctattgaattgtaacgcttactaagcaatgttccatctgggtgacaggcatatttttacatttgcaagagttacaacgagtatttataatcagcgttgttccgttgtaacgatgtcattgtattgcaacatagaggttaggcactgttccttttttgaaagaattttcagacctgcaaattcgaacctttgatcaaccaaacaaatgtggaatataagattatactccct

SEQ ID NO: 752 - DNA, 2092 bp, Zea mays
tcgcgtcgcgtggtaaccatgaaggccgcgcggcaggccataaatgtgcacctcctccgatccgggtcctcccaaccgaaccatctaccacctccatcgcttttctccacctccaaggctccaattcaattccatcgcgctgtcgtcttcgttgcccggtcgccattttttcctcctgatttcttctttttcttccctcactatatggtcaggcctctgcctgtccctctcgtgtcgtgccgttgtgcggtgctcgatcctgcccgtcgcctctccggccaccgctgagaagatccaccattaaatgcctgatccacccacctcctcctcctggcttccctatatcactcacccatccacctcgcttcgacctcacctcacagactcctcacacttagtactgttagccaggaacaagccccagcagcagcagcagcaatggccgtggagaacggcagcgccgacgaggcggcggcggtgaccgtgaccgtgaccggcgcccgcaccgtggcgccggccaagaaccgctgcacgctcgccaccttcgacctcccctacatcaccttctactacaaccagaagctgctcctgtaccgcgccgcccccgacttcccggacgccgtggcgcgcatgacggccgcgctcgccgacgcgctccgcgtcttctacccgctcgccggccgcatccgccaggacgacggcggcgcgctggcagtcgagggcgacgagggcgccgaggtcttcgaggccgaggcccagggcgtcgccgtcgacgacctcgccggaggggactgcagcgacgaggcggagaaggtcttgcagcacctcgtgccctacaccggcgtcatgaacctcgagggcctccgccgcccgcttctcgccgtccaattcacaaagctcaaggacggtctggcggtggggtgcgccttcaaccacgcggtgctggacggcacctccacgtggcacttcatgtcctcctgggccgagctctgccgcggcgtacccctgtcgctgcagcccatccacgaccggtccctgtcccgctccgtgcgcgtgcggctggagctgccggcgtccgccgaggcccacgagaagacggacccgaacgggccgaagaaggcgctggtggcccgcgtcttctcgttcccggagcccaccgtggcgcgcatcaaggccgcggccaacgcggcgctgccgccgggcgcaaagcccttctcaacgttccagtccctgggggcgcacatctggcgcgccgtctcccgcgcccggggcctcggccccgccgacatcaccgccttcgccgtcttcgccgactgccgcgcccgcctcgacccgcccctcccgccggcctacttcggcaacctcatccaggcggtgttcacgggcgtgcccgcggggatgctcctgggcgggccccccgagctgcccgcgggcctgctgcagaaggccatcgacgagcacgacgccgccgcggtcaccaggaggctggaggagtacgaggcggcgcccaagctgttccactacagcgacgccggccccaactgcgtggccgtcggcagctcgccgcgcttcagggtctacgacgtcgacttcggcttcggacggcccgagcgcgtccgcagcggcgggaacaacaagttcgacggcatggtgtacctgtaccccggccgcggcggtgacggcggcatcgacgtcgagctggcgctgcagccggagcccatgcagaggctggagaaggacgacgacttcttcctgcgccaggcggcagcctaagcccgagtcgtcgatcgtcgtgtcagtgtccactgtccacccatccagttcgttgatcgtgctttattttagtagtaagtattgtgtacgttcctgcttgctatattattattatactagtgttttgctttgttccttgattaattgtacgagctaggcgtgcgtgttggattacactgtatttgctggactggagctgaataaggatggaccagacttcgattagtttgtgcaagctcacgagtgatcgagcatggtccctatatatgtcatcactcgttgtagtaatgcagtaatgtactcattatattgttatgca

SEQ ID NO: 753 - DNA, 1809 bp, Oryza sativa
ctctcccctaccataccatcagctagctagcttctactcgatcctcttctcctctcctctcctctggagcacatcacatccacctcttcgtctatatcaaccccgccttcctctagctacctcttcactcgctcacactctgatcagctctctaatcacatatatatcgtatcgatcaacgacgacgacaatggcggccgtcgacaatgccccgccgtcgccagtggtcaccgtcacctccacccgcaccgtcgccccagccgccgccaagtgcgtcctcgccacattcgacctcccctacatcaccttctactacaaccagaagctgctcctctaccgcctccccaacggcgcctccgacttccccgacgccgtcgcccgcatgtccgcctccctctccgacgccctcgcctacttctacccgctcgccggccgcatccgccaggacgaccacgacggctccctctccatccacggccaacacggcgccgaggtcatcgaggcctccgccgaccatgtctccgtcgaccaactcgccggagaggagtgctcggaggaggcggagaaggtgatgcagctcctcgtcccctacaccggcgtcatgaacctcgagggcctgaaccgcccgctgctcgccgtccagttgacacgtctgcgggacggggtggcagtggggtgcgccttcaaccacgccgtcctcgacggcacctccacctggcacttcatgacgtcatgggcggagctctgccggggcggcggcgcgccgtcgctgctgccggtgcacaaccgcggcatggcgcgctccgtccgcgtcaacctcccgctcccggcgtccgccgaggcgcacgagaagaccgaccccaatgggcccaaggtgcccctcgtggcccgcgtcttctccttcccgccctccgccgtggcccgcgccaaggccgccgccaacgccgccctgccccccggcgccaagcccttctcctccttccagtcgctcgccgcccacatctggcgcgccgtctcccgcgcccgcgccctcggcccctccgacatcaccgtcttcgccgtcttcgccgactgccgcgcccgcctcagcccgcccctcccgcccgcctacttcggcaacctcatccaggccgtcttcaccggcgtgcccgcggggatgctcctcgctggcccgcccgagctcgccgcggggctgctgcagaaggccatcgacgaccacgacgccgccgccatcacccggaggctggaggagtacgaggcggcgcccaagctgttccactacagcgacgccggccccaactgcgtcgccgtcggcagctcgccgcgcttcagggtgtacgacgtcgacttcggcttcggccgcccggagcgggtgcgaagcggcgccaacaacaagttcgacgggatggtctacctctacccgggccgcggcggcgacggcggcatcgacgtcgagctctcgctgcagccggagccgatgcagaggttggacaaggaccaagacttcctccaaatgcgagccccttaattcttttttttttcttttatactcctatatattatgatgattcatcagctgcatgttactccctagtagtcttgttcctcctaaattgcaacttctcctactactcctttatgtttagttggatgcatgcatggattccttgttgcttgctactatttatatatagtggagtactatgttgtgtactatgttgcttgcaagctacatttatatgtggatttgcatatattgaattggtccattacttaaataaggatcggatatggaattaattagcagct

SEQ ID NO: 754 - DNA, 1731 bp, Triticum aestivum
cccgctgacactcgcagcttacatcacagaccaattaaacaaacagcaatggccgtggacaacggggacgccgccatggccgtcgcggtcaccggcacgcgcacggtggcgccggccaagaccaaggtcaccctcgccaccttcgacctgccctacatcaccttctactacaaccagaagctgctcctctaccgcctcccgcagggcgccgccgacttccaggacgtcaccgcgcgcatggccgacgcgctcggggacgcgctcgcctacttctacccgctcgccggccggatccgccaggagaagggcgacggcggcgcgctgtacgtcgatggggaggaaggcgcggaggtcgtcgaggccgctgccgagggcgtctccgtggaccagctcgccggcgaggactgcggcgaggaggcggagaagctcatgcagcagctcataccctacaccggcgtcatgaacctcgaggggctccaccgcccgctgcttgcggtccagttcaccaagctcaaggacggcctcgccgtgggctgcgccttcaaccacgccgtgctggacggcaccgccacgtggcacttcatgagctcctgggccgagctctgccgcggcgccgccgccccgtcggcgctcccgatccacaaccgcgccatggcgcgctccgtgcgcgtcggcctcaccctcccggcctccgcggaggcgcacgagaagacggaccccaacgggcccaagaagccgctcgtggcccgcgttttctccttcccggggcccgtcgtggcccgcatcaagaccgccgccaacgcggcgctacccccgggcgcgaagcccttctcggccttccagtccctgggcgcccacatctggcggtccgtctcgcgcgcccgtgagctgggccccgccgacatcaccgtcttcgccgtgttcgccgactgccgggcccgcctcgacccgcccgtgccggcgacgtacttcggcaacctcatccaggcggtcttcacgggcgtgcccgcggggatgctcctgggcggccccccggagctggcggccgggatgctgcagaaggccatcggcgagcacgacgcggccgccgtgacgcggaggctggacgagtacgaggcggcgcccaagctgttccactacagcgacgccgggcccaactgcgtggccgtgggcagctcgccgcgcttccgcgtgtacgacgtggacttcgggttcggcaggccggagcgcgtccgcagcggcgggaacaacaagttcgacgggatggtgtacctgtacccgggccgcggcggcgacagcggcggcatcgacgtggagctggcgctgcagccggagcccatgcagaggctcgagaaggacgaggagttcctgcagatcgcggctgcatgatcgcctgcgcgtcgctgcctgcgttatttagtgagcttaattaagcaaaggtttgtgatttagccagcttcgttaattcgatcttcttcactagtgcatgtgtgtttgcttgttactgctgcggatctgttccggttaaataaggatcgatcgattagtttgtgtaagatcaccatcctatttctcgtgtcatgtcacacaaatagtcatgtaatgtactagtagtatgtgatccgcctacaggatttgcatatttgtttgcacgtactcggctcatcccttctgaattaaaactactgtgtttcctttttcaaaaaaaaaaaaacaaagggcacgcgctct

SEQ ID NO: 755 - DNA, 1833 bp, Hordeum vulgare
aagccttctactcttctcccttttgtttcccctcgacggcggcggcggcggcggcaaccagggtttagaggaggagaagcttgcccggcgcaaaaccctagccctgcaccttcatctacggattcaccgcgcctctgccgcgtatcctttacgagtgccctgcctcgctgcatcggcggtcgcgatgagggtgaaggtgatatcgcgctcgaccgacgacttcacgcgcgagcgcagccaggacctgcagaaagtattccgcaattatgatccagcactccgtagtcaagagaaagctgttgagtacactcgggcccttaatgctgcaaagttagagaagatatttgccaggccatttattggagcaatggatggtcacattgatgctgtttcgtgcatggcgaagaactccaattatgtgaaagctatgttttctggctcgatggatggggatattcgactatgggacattgctgcaaggaagacagtctgccagttccctggacaccagggtgctgtgagaggtttggcaacatctaccgacggtgatcttctggtatcctgtggtgttgattgcactgttcgactctggaaagatcctatgcgtaagatgatggacagtaatgatgctattggagatgcttcccagccgtcagcagtctatacatggaagcatgcattttggggtgtggaccaccagtgggatcataatgttttcgcaactgttggtgctcaggtagatatatgggatcataacaggtcggagccaataaataccttcgaatggggtaaagatacagttctttctgtgcggtttaatcctggagaacctgatgttttacttacatcatctagtgatcggagtttaacactttttgacctgcgcatgtcatccccagctagaaagttaatcatgaagacaaggtgcaattcagtttgctggaaccctaaggagcccatgaacttcactgctgcaaacgaagatacaaactgttattcttttgatgctagaaagctgaatgaagccaaggttgttcacaagggtcatgtttcarcagtgatggatgttgattacaacccaacaggacgggaatttgttactggttcctatgatagaacggtacggatcttcaattatattggtgatcatagcagggagatataccatactaagaggatgcaaagggtgttttgtgtgaaatacacatatgatgggacctatctagtttctggcagtgatgatacaaatcttcgactgtggaagtccaatgcttcagaacaattgggagttgttcttccaagggaacgcaaaaagcaagaatatctagatgctgtcaagctgcggtatggtcaccttccagaaatcaggcggattgtcaaacataagcacgtacccaagccgatctacaaggcaggcaagatacggcgtgccatgattgaagcagaaagccggaaagaagaaagaaggcgagcgcacagtgctccagggagcaggaccatgcagcccttcaggaagagaaggctcatcacagaagttgagtagggtggatctgaccatggcgaggccaaacaaagtggtattctggtgtttaatttttgatcgagtgtgagagatggcatgttgggaacatatttattatgtggagtacttggaaaccttagatgaagcaccggattacttttgacaaggaaaaaagaacttgtgtatcagcgatgctagtttgtgaccctcgagtgtaagctcaccaatcagtcgctgtaaaagtctgtagcatgtgctgtgttattctccatggatgcctttatggcagcacctacgtgtgtctgtcttct

SEQ ID NO: 756 - DNA, 1432 bp, Brachypodium distachyon
tgctcggccgtcaggatgagggtgaaggtgatatcgcgctcgacagacgagttcacgcgcgaccgtagccaggacctgcagaaagtattccgcaattatgatccagcacttcgtagtcaagagaaagctgtcgagtacactcgggccctgaatgctgcgaagttagagaagatattcgccaagccatttattggagcaatggatgggcacattgatgctgtctcgtgcatggcgaaaaatcccaataatttgaaagctgtattttctgggtccatggatggggatattcgactatgggacattgctgcaaggaagacagtctgccagttccctggacaccagggtgctgtgagaggtttggcaacatctaccgatggtgatcttctgatatcctgtggcgttgattgcactgttcgactgtggaaagatcctatgcgtaggatgatggacactagtgatgctattggagatgcttcccagccgtcagcagtctacacctggaagcatgcattttggggtgttgaccaccagtgggatggcaatatttttgcaactgtaggtgctcaggttgatatatgggatcataataggtcggagccaataaatagctttgaatggggtaaagatacacttctttctgtgcggtttaatcctggagaacctgatgttttaattacatcagctagtgatcggagtttaacactttatgacctacgcatgtcatccccagctagaaagctaatcatgaagacaaggtgcaattcagtatgctggaaccctagggagcccatgaacttcactgctgcaaatgaagatacaaactgttactcgttcgattcgagaaagcttgaggaagccaagattgttcacaggggtcatgtttcagctgtgatggatattgattactcaccaaccggtcgtgaatttgttacgggttcatatgatagaacggtgcggatcttccaatataatggtgaccatagcagggagatatatcatactaagaggatgcagagggtgttctgtgtgaagtacacctatgatggaacctatctagtttctggcagtgatgacacaaatcttaggctgtggaaatctaaagcttcagaacaacttggagttattcttccaagggaacgcaaaaaacaagaatacctagatgctgtcaaggagcggtataagcaccttccggaaatcaagcggattgtcaggcataggcacttgcctaagccgatctataaggcagccaacataaggcgtacgatgatcgaagcagaaagccgcaaagaagaaagaaggcgagcgcatagcgcacctggaagcaggcctgtgcagccgttcaggaagagaagactcatcaaagaagttgagtagggtggatctgactatcgcgaggccaaacaaggatatattccggcacattgttttggtc

SEQ ID NO: 757 - DNA, 1921 bp, Oryza sativa
ggggttcgcttcgaagcctcggcctctttttcgcttccccctcccttccgactccccaacggcggcggcggcggcggcgtggtgcggcggcgagggttttaagtaggctgcgcggcggagaacgccggggacgcgagcggagtgatctagccttatcctccttcgtcgcctccggattggtttcgcggcggccggccgtgtctcctgactgcgtctgtggccgggatgagggtgaaggtgatatcgcgctccaccgacgagttcacgcgggagcgcagccaggacctgcagaaagtattccgcaattatgatccagcacttcgttctcaggagaaagcggttgaatacaccagggctcttaatgctgcgaagttagagaagatatttgctaggccatttattggagcaatggatggccatgttgatgctgtatcatgcatggcgaaaaaccccaattatttgaaagcaatattttctggctcaatggatggggatattcgtctgtgggacattgctgcaaggaagacagtctgccagttccctggacatcagggtgctgtgaggggtttggcgacatctactgatggtgatcttctagtatcatgtggtgttgactgcactgttcgactatggaaagtccctatgctcaagatggtagacactaacgatgctattggagatgcttctcagccatcagcggtctacacctggaagcatgcgttttggggtgttgaccaccagtgggatggcaatctttttgcaactgtaggtgctcaggttgatatatgggatcaaaacaggtcagagccaataaatagctttgaatggggtaaagatacagttctgtccgtgagatttaatcctggagaacctgatgttctaattacatcagctagtgatcggagtataacactttatgatctacgcatgtcatcccctgctagaaagctaatcatgaagacaaggtgcaactcaatatgctggaaccctagggagcctatgaacttcactgccgtaaatgaagatacaaattgctattcctttgatgctagaaagcttgatgaagccaaagttgttcacaagggccatgtttcagcagtgatggacattgattattcaccaacagggcgtgaatttgttacgggttcctacgatagaacagtgcggatcttccaatataatggtgatcatagcagggagatataccatactaagaggatgcaaagggtgttttgtgtgaaatacacctatgatggaacctatttggtttctggcagtgatgatacgaatcttcggctgtggaagtccaaagcttcagaacagttgggagttcttcttccaagagaacgcagaaaacaagaatacctagatgctgtcaaggagcggtataagcaccttcccgaagtcaagcggattgtgaggcataggcacttacctaagccaatctacaaggcggccaacttaaggcgaacgatgattgaagcagaaaaccgtaaagaagaaaggaggcgtgcgcacagtgcccccgggagcatgcctgtgcagcccttcaggaagagaagaataatcaaagaagtagagtaaaatggaagaatatgtgtggcacaaaaccaaacgccgcgattttacaggtctagctcaagacggggacatgtctaatcatccaccaaaccattcatcggagagtgacgtctgttgcaaacagtgtttagaaagcagccccagcagcagcagaaatcgaagggtctatggttcatcagtttataaagggctgaaatttttgcttctgctcaatttgttgtatcgttttgcttgtaacgatttatgaaccttctagttatgtatctcgtattacttttctgatgagtaacctgtgtaatagctatgtcgaatggaacaatacatgtgtggctctgtcagc

SEQ ID NO: 758 - DNA, 1709 bp, Sorghum bicolor
gtctgattttccccggcggcggcggcggcgttgggcgctgggttgggagaggaaggcggtgcgcggcgcaaaaccccagctcctcttcgtcgtcaagtgctctccggcctcgccgaccttggggtcgcgatgagggtgaaggtgatttcgcgctccaccgacgactacacgcgcgagcgcagccaggacctgcagaaagtgttccgcaactatgatccagcgctccgtagtcaagagaaagctgttgagtatactcgagcactcaatgctgccaagttagagaagatatttgctaagccatttatcggagctatggatgggcatattgatgcggtatcatgcatggcgaaaaaccccaatcatttaaaagcaatattttctggttcaatggatggagatgttcgcctttgggacattgctgcgaggaaaacagtttgtcagttccccggacaccagggtgctgtaagaggtttaacaacatccacggatggtgattttcttgtatcatgtggcgttgactgcactgttcggctctggaaagatccgatgcttaaaatggtggacaatagcgaccgtgccggagataattcccagccatcagcagtctacacctggaagcatgcattctggggtgctgaccaccagtgggacggtaatctttttgcaactgttggtgctcaagttgatatatgggatcctgacaggtcagagccaataaatagcttcgaatggggtaaagatacgattctttctgtgcgatttgatcctggagactgtaatattttgattacatccggcagtgatcggagtctaacactctatgacctgcgcatgtcatctccagctagaaagctaataatgaagacaaggtgcaattcagtatgctggaaccccagagagcccatgaacttcactgctgcaaatgaagacacaaactgttactcctttgatgctagaaagctagatgaagcgaaaattgttcacaaaggccatgtttcagcagtgatggatattgactactcaccaacagggcgtgaatttgtcactggttcatatgatagaacagtaaggatctttaattatcttggagaccacagcagagagatttatcacaccaagaggatgcaaagggtgttttgtgtgaaatacacctatgatgggacctatctagtctctggcagtgatgatacaaatcttcgtctgtggaagtccaaagcttcagaacaacttggagttcttcttccacgggagcgcaaaaagctagagtaccaggatgctttgaaggagcggtacaagcatctcccagaagtgaagcggattgtaaggcatagacacctgccgaagccaatctacaaggcagccaacctacggcgtacgatgatggaagctgaaaaccggaaagaggaaagaaggcgaaagcacagcgctccggggagcatgcctgtgcagccgttcaggaagcggagaatcatcaaagaagttgagtaagccatgcatggccgtggagtttgtgttgttgaggcggtgctgtgatgagaacgcatgtttcccattgagagctgagctccagttttgcccttgctacatatatatatatatatatatatatttgaaataccaaaccaatattcgtatcgagccactgcgttataagagtctgtaaccatgagcaatccgaattgaagagtgtaaccaaatatttgaaatac

SEQ ID NO: 759 - DNA, 1674 bp, Saccharum officinarum
ggcgtctaacgtctattcctgtgatttcccccggcggcggtagcggcgggggcggcggcggttgggaagaggaagacggtgcgcggcgcaaaaccctagctcctcgtcggcgtcaagtgctctccggcctcgccgaccttgggggcgcgatgagggtgaaggtgatttcgcgctccaccgacgactacacgcgcgagcgtagccaggacctgcagaaagtgttccgcaactatgatccagcgcttcgtagtcaagagaaagctgttgagtatactcgggcactcaatgctgccaagttagagaagatatttgctaagccatttattggagcaatggatgggcatcttgatgcggtatcgtgcatggcgaaaaaccccaatcatttgaaagcaatattttctggttcaatggatggagatgttcgcctttgggacattgctgcgaggaagacagtttgtcagttccccggacaccagggtgctgtaagaggtttaacaacatccacggatggtgatcttcttgtatcatgtggcgttgactgcactgttcggctctggaaagatccgatgcttaaaatggtggaccctagcgaccgtgctggagataattcccagccctcagcagtctacacctggaagcatgcattctggggtgctgaccaccagtgggacggtaatctttttgcaactgttggtgctcaagttgatatatgggatcctgacaggtcagagccaataaatagcttcgaatggggtaaagatacggttctttctgtgcgatttgatcctggagaytgtaatattttgattacatcgggcagtgatcggagtctaacactctatgacctgcgcatgtcatctccagctagaaagctaataatgaagacaaggtgcaattcagtatgctggaaccccagagaacccatgaacttcactgctgcaaatgaagacacaaactgttattcctttgatgctagaaggctggacgaagccaaaattgttcacaaaggccatgtttcagcagtgatggatattgactactctccaacagggcgtgaatttgttactggttcctatgatagaacagtaaggatttttaattatcttggagatcacagcagagagatttaccacaccaagaggatgcaaagggtgttttgtgtgaagtacacctaygatgggacctatctagtctctggcagtgatgatacaaatcttcgkctgtggaagtccaaagcttcagaacaacttggagttcttcttccacgggagcgcaaaaagcaagagtaccaggatgctttgaaggagcggtacaagcatctcccagaagtgaagcggattgtaaggcatagacacctaccgaagccaatctacaaggcagccaacctacggcgcacgatgatcgaagctgaaaaccgwaaagasgaaagaaggcgaaagcacagtgctccggggagcatgactgtgcagcccttcaggaagcggagaatcatcaaagaagttgagtagccataaagtttgcatggtcgtggrgtttgtrttgttgaagtggtgcttagatgagaatgcatgtttccattgagagttgagctccagttttgcccttcctacatatatgtgctgyatccatgactttgwtttactagttatatatttgaaataccaaaccaaatat

SEQ ID NO: 760 - DNA, 1713 bp, Panicum virgatum
gactggtctgccactgcggacgagggtttggaggacggtaagcttgcagtgcgcggcgcagaaaccctagctcctcgccctcttcttctctccaagtgctctcctgcctcgctgatccgcgatccaagtgctctcctgcctcgctgatccgcgatgagggtgaaggtgatatcgcgatccaccgaagagttcacgcgcgaccgcagccaggacctgcagaaagtattccgcaactatgatccagggcttcgtagtcaagagaaagccgttgagtacactcgggcacttaatgctgcaaagttagagaagatatttgctaagccatttattggagctatggatggtcatattgatgcggtatcgtgcatggccaagaaccccaatcatttgaaagcaatattttctggttcaatggatggagatattcgcctttgggacattgctgcgaggaagacagtttgccagttccctggacaccaaggtgccgtaagaggtctaacaacatctacggatggtgatcttcttgtatcatgtggcgtggactgcactgttcgactctggaaagttccaatgcttaaaatggtggacactagtgaccatactggagatacttcccagccatcagcagtctacacctggaagcatgcattctggggtgctgaccaccagtgggacggtaatctttttgctactgttggtgctcaagttgatatatgggatcctaacaggtcggagccaataaataactttgaatggggtaaagatacagttctttctgtgcgctttgatcctggagactgtaatattttgattacatcagccagtgatcggagtctaacactttatgacctgcgcatgtcatctccagctagaaagctaataatgaagacaaggtgcaattcagtatgctggaaccctagggagcccatgaacttcactgctgcaaatgaagacacaaactgctactcctttgatgctagaaggctagatgaagccaaaattgttcacaaaggccatgtttcagcagtgatggatattgactactcaccaactgggcgtgaatttattactggttcctatgatagaacagtaaggatttttaattatcttggtgatcatagcagagagatttaccacaccaagaggatgcaaagggtattttgtgtgaagtacacctacgacgggacatatctagtctctggcagtgatgatacaaatcttcggctgtggaaatccaaagcttcggaacaacttggagttcttcttccacgggagcgcaaaaagcaagaatacctggatgctgtgaaggagcggtataagcacctcccagaagtgaagcggattgtgcggcatagacacctgccgaagccgatctacaaggcggccaacctacggcgtacgatggttgaagccgagaaccggaaagaggagaggaggcgaaagcacagcgctccagggagcatgcccgggcagcccttcaggaagcgaaggatcatcaaagaagttgagtaggcgtagggtttgcagggccgtgctgtttatgttggcccccaaacgtctagttatcgtggagattgctgtagtgtgtgtcactatgttgagaattaatgtatcgattgagaattgggaccactagctgaagttttgcattgttgtttacgtatatgcatggtgtatccagatggtcactgaattccaaaacatttctcctat

SEQ ID NO: 761 - DNA, 1669 bp, Triticum aestivum
cggcggcggcggcggcaaccagggtttagaggaggagaagcttgctcggcgcaaaaccctagccccgcaccttcatctacggattcatcgcgcctctgcagcgcatccttgccgagtgcccygcctcgctgcatcggcggtcgcgatgagggtgaaggtgatatcgcgctcgaccgacgacttcacgcgcgagcgcagccaggacctgcagaaagtattccgcaattatgatccagcactccgtagtcaagagaaagctgttgagtacactcgagcacttaatgctgcaaagttagagaagatatttgccaggccatttattggagcaatggatggtcacattgatgctgtttcgtgcatggcgaagaactccaattatgtgaaagctatgttttctggctcgatggatggggatattcgactatgggacattgctgcaaggaagacagtctgccagttccctggacaccagggtgctgtgagaggtttggcaacatctaccgatggcgatcttctgatatcctgtggtgttgattgcactgttcgactctggaaagatcctatgcgtaagatgatggactctaatgatgctattggagatgcttcccagccgtcagcagtctatacatggaagcatgcattttggggtgttgaccaccagtgggatcgtaatgttttcgcaactgtaggtgctcaggtagatatatgggaccataacaggtcggagccaataaatacctttgaatggggtaaagatacagttctttctgtgcggtttaatcctggagaacctgatgttttacttacatcatctagtgatcggagtttaacactttttgacctgcgcatgtcatccccagctagaaagttaatcatgaagacaaggtgcaattcattatgctggaaccctagggagcccatgaacttcactgctgcaaacgaagatacaaactgttattcttttgatgctagaaagctgaatgaagccaaggttgttcacaagggtcatgtttcagcagtgatggatgttgattacaacccaacaggacgggaatttgttactggttcctacgatagaacggtacggatcttcaattataacggtgatcatagcagggagatataccatactaagaggatgcaaagggtgttttgtgtgaaatacacatatgatgggacctatctagtttctggcagtgatgacacaaatcttcgtctgtggaagtccaaagcttcagaacaattgggagttattcttccaagggaacgcaaaaagcaagaatatcwwgatgctgtcrwggmgcggtatrrtcacctkscagaaatcaggcggatygwcaaacataagcacttgcccaagccgatctacaaggcaggcaagataaggcgcgccatgattgaagcagaaagccggaaagaagaaagaaggcgagcgcacagtgctccagggagcaggactatgcagcccttcagaaagagaaggctcatcacagaagttgagtagggtgggatctgaccatcgcgaggccaaacaaagtggcattacgttggagtattatttttggtcgagtgtgagtgatgggaagctgggaacatatttattatgtgtagtgtcatgttgttacttgcaaaccttggacaacgtaccggattacttttgagaaggaaa

SEQ ID NO: 762 - DNA, 1920 bp, Malus domestica
gggaccttgaaccttcccttgaattgaatccttgagatcgaataacattcaaatttccaaacgcgtcctcgtgataaaagcaaatttacacggaaggacaaccctcccctctcctctcctctcctccctcgtcctctccatcgagatcaaagctcttcgattttttttttctcgataaccaaacagctcttaacaataaagaaaataaaatctagggcttccccacctaaaaattaccctacgatccccgatttttttcaccccatcgatatgaaattattcaaactcttcaaactcttcaaactctagggctttttccctttttcgattccggagctccgaattctgtatgcgtgatcggtcaggcgagatcaaaagagatgtatagcaatttcaaggagcaagcgattgagtacgtgaagcaagccgtgcaggaagataatgcgggaaattacgcaaaggccttccccttgtacatgaacgccttggagtacttcaagacccacttgaagtacgagaagaaccctaagatcaaggaggcaataacccagaagttcaccgagtacttgcgccgtgccgaggagattcgggcggtgttggatgacggcggcccagggccggcgtctaacggggatgcggcggtggccaccaagcccaagaccaagcccaaagacggggagggcggtgacggtgaggatccggagcaggcgaagctccgggcggggctgaattcggcgattataagggaaaagcccaatgtgcaatggaatgatgttgctggtttggagagtgccaagcaggccttgcaagaggcggttatattgccggtcaaattcccgcagttctttactggcaagagacggccatggagggcttttctattgtatgggcctcctggaactggaaagtcttacttggccaaggctgttgcaactgaggcggactcgacatttttcagtatttcttcttcagacctggtttcaaagtggatgggtgagagtgaaaagctagtttcaaaccttttccaaatggctcgtgatagtgcaccatccattatattcatcgatgagatagattccttgtgtgggactcgtggagaaggcaatgagagtgaagcttctagacgaattaagacggaacttcttgtgcagatgcagggtgtgggaaccaatgatcagaaagttcttgttctcgcagcaacaaatactccatatgcactagatcaggccattcggcgccgtttcgacaagcgtatatacattcccctcccagatttaaaggctcgtcagcatatgttcaaagttcatctaggagatactcctcacaacttaacagaaagtgattatgaaagcttagctcgcaaaactgatggtttttcaggttccgatattgctgtttgtgttaaagatgttctctttgaacctgttcgtaaaacgcaagatgccatgttctttttcaaggatcctaaggatatgtggataccatgtggaccaaagcaaccaggtgctgtccaaatcaccatgcaggatctggcggcaaaaggacttgcgtcacagatccttccgcctcctatcacaaaaacagatttcgataaggttcttgctagacagaggcctacagtgagcaagaatgaccttgaagtccatgagagattcacaagagagttcggagaggaagggtgacgaattctctgcacttatatatcacattaatccacacttgtcgtcagtcaccatgatttgtattttattttacaaagtgctggatttaatgaattacatactctgaatgagtttcttcaatgaggaaggtgacttgacttcccttttctgtattgagatggaaacctctggtgtttgatacatcttgaatcgctcgttttcaaattgtgtaaaggagagttgaaaaagtattgcttca

SEQ ID NO: 763 - DNA, 1773 bp, Arabidopsis thaliana
ctagcttttttcttcatcgctttgcataatccattccttcttctctcttctccatctccttcctccgatcttcgtctccaattcggaatcttcctatcacaatttcaaggctcctttaacccttgatcatcaccgattcaatcaattcggaatcacaatttcaaatcgagagaatttcaatttctcttgtaaaaccctaaattatgtacagcaatttcaaggaacaagcgatcgagtacgtgaagcaagcggttcatgaagacaatgctgggaattacaataaagctttccctctatacatgaacgcgcttgagtacttcaaaactcatctcaagtatgagaagaaccctaagatcagagaagctattacccagaaattcaccgagtatctccgtcgtgctgaggagatccgtgctgttctcgatgaaggtggatcgggtccaggatctaacggtgatgcagccgtcgcaacgaggcccaaaactaagcctaaagatggagaaggtggtggtaaagatggagaagatcctgaacaatcaaagcttcgagctgggttaaactctgcgattgttagagagaaacctaatatcaagtggtcagatgttgctgggcttgaaagtgctaaacaagctctgcaggaagctgtgattttgcctgtcaagtttccacagttcttcactggaaagagacggccttggagagcttttctgttgtatgggcctcctggaacaggaaaatcgtatttggctaaggctgttgccactgaagctgactctaccttttttagcgtgtcttcatcagaccttgtctcgaagtggatgggtgaaagtgagaagctagtatcaaaccttttcgagatggcccgtgaaagtgctccctcgattatttttgttgatgagatagattctttgtgtggtacacgtggagaaggaaacgagagtgaagcttcaagacgtatcaaaacagagcttctagtgcagatgcagggtgttggacacaatgatgagaaagtacttgtacttgcagcaaccaatacaccctatgctcttgatcaggctatccggcgacgttttgacaagcgtatctatattcctctcccagaggccaaggctcggcagcacatgttcaaagtccacttgggagatacacctcataatttaactgaacctgattttgaatatttaggccaaaagacagaagggttttctggttcagatgtgtctgtttgtgtaaaagatgttctgtttgaacctgttcgtaaaacacaagatgcaatgttctttttcaagtctcctgatggtacatggatgccatgtgggcctaggcaccctggtgccatccagactacaatgcaagatctagcaacaaaagggcttgccgaaaagattattccaccaccaatcaccagaacagatttcgagaaggtacttgcaagacaaaggccaacagtgagcaagtctgaccttgatgtccacgagagattcacacaggagtttggagaagaaggttgatagatttgacattcccatcaagcatctttcacaatcatattattattagtctcttcaccatctccttatgtatgtactgagaagcaaaacaaaatctcaaacccatgtttgatttcttcccaaaacattgaatttgctttatttctcgaattgtgtaaaaaaaaaatgttctgaacaatgttttctatttattatgtcaccaaaagtctccacatgagcaaactccatcactgctaaagtgatgaaaccgatttgaatctct

SEQ ID NO: 764 - DNA, 1556 bp, Brassica rapa
ggcttcccattcgttcttccatctcttcccgatcctctccgatcgtctgctcaaattcatctccgagctttctcctcgattcgaaaaatcggtaaaaacccaaagcgatgtacagcaatttcaaggaacaagcgatcgagtacgtgaagcaagccgtacaagaagacaatgccgggaactacaacaaggccttccctctctacatgaacgcgctcgagtacttcaaaacgcatctcaagtacgagaagaaccccaagatcagagaagccatcacccagaaattcaccgagtacctccgccgcgcggaggagatccgcgccgttctcgacgaaggcggatcggggcccggacctaacggcgacgcggcggtggcgacgaggccgaagagtaagccgaaagatggaggaggagaaggtggggaggacgcggagcagtcgaagctcagagctgggttgaactctgcgattgtgagggagaagcctaacattaagtggacggatgttgctgggctcgaaagcgctaagcaggctttgcaggaagctgtgattttgcctgtcaagttcccacagttcttcaccgggaagaggaggccatggagagcttttctgctgtatggcccgcctggaacagggaagtcctacttggctaaagctgttgctactgaagctgactccaccttctttagcgtgtcttcatcagacctggtctccaagtggatgggtgaaagtgagaagctagtatcaaaccttttcgagatggcccgtgaaagttctccctcgattattttcgttgatgagatagattcgttgtgtggtcaacgtggagaaggaaacgagagtgaagcttcaaggcgtatcaaaacagagcttcttgtgcagatgcagggtgttggacatagtgatgataaagtacttgtgctcgcagcaaccaatacaccttatgctcttgatcaggctattaggcgacgttttgataagcgtatctatattcctctcccagaagccaaggctaggcagcacatgttcaaagtccatttgggagacacgcctcataatttaactgaatctgattttgaatatttggggctcaagacagaagggttttctggttcagatgtttccgtttgtgtaaaagatgtcctttttgagcctgttcgcaaaactcaagatgcaatgttctttttcaagtcacctgatggtacatggatgccatgtggaccgaggcagcctggagctatccaaaccacaatgcaagatttagccgctaaaggccttgccgaaaagattattccaccaccgatcacaagaaccgatttcgagaaggtacttgccagacagaggccaacagtgagcaaatccgaccttgacgtccatgagagattcacacaggagtttggagaagaaggttaatagatttgtcattccatcaaatacctctcagtatcattagtctcttcactttctccttatgtttgatttgattccaaaacatttcatttgctttatttctcgaaatgtgtaaaaaaatgttctaaatgcttaaacaatgattttctt

SEQ ID NO: 765 - DNA, 1581 bp, Brassica rapa
attcgttcttcccttttctctccaatcctccacgatcgatcttctcatcctcgatcagaatcggattgggtaagaagtgataatgtacagcaatttcaaggagcaagcgatagagtacgtgaagcaagcggttcaagaagacaatgcggggaactacagcaaggccttccctctctacatgaacgccctcgagtacttcaaaacccacctcaagtacgagaagaaccccaagatccgtgaagccatcacccacaaattcaccgactatctccgccgcgccgaggagatccgcgccgttctcgacgaaggcggtcccggtcctggatccaacggcggggacgcggcggtggcgacgaagccgaagagtaagcccaaagacggaggaggggacggcgaggatccggagcagtcgaagctccgagctgggttggactctgcgattgtgagggagaagcctaacattaagtggactgatgtcgccgggctggagagcgctaagcaggctttgcaggaagctgttattttgcctgtcaagtttccgcagttcttcactggaaagaggcggccttggcgagcttttctgctgtatgggccgcccggaacgggtaaatcgtacttggctaaggcggttgctactgaagcagactctacctttttcagcgtgtcatcatcagacctggtctccaagtggatgggtgaaagtgagaagctagtatcaaaccttttcgagatggcccgtgaaagttctccgtccattattttcgttgatgagatagattctctgtgcggtcaacgtggagaagggaatgagagcgaagcttcaagacgtatcaaaacagagcttcttgtgcagatgcagggtgttggacacagtgatgataaagtactcgtgcttgcagcamccaatacaccttatgctcttgatcaggctatcagacgacgttttgataagcgtatctatattcctctcccagaagccaaggctaggcagcacatgttcaaagtccatttgggagacacacctcataatttaacggaatctgattttgaatatttggggctcaagacagaggggttttctggttcggatgtgtctgtttgtgtaaaagatgttctgtttgagcctgttcggaaaactcaggatgctatgttctttttcaagtcacctgatggcacatggatgccatgtggacctaggcaacctggagccatccaaaccacaatgcaagatctagcaactaaaggccttgcagagaagattattccgccaccaatcacaagaaccgatttcgagaaagtacttgctagacaaaggccaacggtgagcaaatctgaccttgacgtccatgagagattcacacaggagtttggagaagaaggttaataaatttgtcgttccagttgtatacttttcactatctttagtctcttcactttcttatttatgtactgggaaggaaacaaatctcaaacctatgtttgattcgatcccaaaacatttgcttttgcttttgctttatttctcgaaatctgtaaaaatgttttaaatgctcgaacaatgtttttttattactgtccaaa

SEQ ID NO: 766 - DNA, 1844 bp, Hordeum vulgare
tcctctttctcctcctcctcctcatcttcccacctccttcgtcaaaccccagggccaagcaaccgccgccgccgsccccgccgaatccgcggcccccgaccccgccccgcgcgcccccggcccgccccccgcgccgatccgccggaatccgccgcaaaggcggcgcctttccggctctcccccgatgtacagcaacttcaaggagcaggcgatcgagtacgtgaagcaggccgtccaggaggacaatgccggcaactacgtcaaggcgttcccgctctacatgaacgcgctcgagtacttcaagacccacctcaagtacgagaagaaccccaagatcaaggaggccatcaccgccaagttcaccgagtacctccgccgcgccgaggagatccgggccgtcctcgacgagggcggcggcggcccccccggcgcccccaacggcggcgacgcggccgtcgccacccgccccaagaccaagggcaaggacgcgggaggggacggcgccggcggggacgactccgagcagtccaagctcagggctgggctcaactcggccatcatcaccgagaagcccaacatcaagtggaacgacgtcgccgggctcgagagcgccaagcaggcgctgcaggaggccgtcatcttgcccgtcaagttcccccagttcttcacaggcaagcggaggccatggagggcttttcttctgtatggtccaccaggaacaggaaagtcttatttggctaaagctgttgcaaccgaggctgattcaacatttttcagcatatcttcatcagaccttgtttcaaaatggatgggcgagagcgagaaactagttgctaatcttttccaaatggctcgtgaaaatgccccttcaattatcttcattgatgaaattgattctttatgcggtacacgtggagaaggcaatgaaagtgaagcttctaggagaataaaaactgaacttcttgtacagatgcagggtgttggccataatgatgataaagttcttgttcttgctgcgacgaatacgccatatgctctggaccaggctgttcggcggcggtttgacaagcgtatctacattcctctacctgacgcgaaagctaggcagcatatgtttaaggtacatcttggggatacacctcacagcttatcggaaagtgattttgaggtcttgggtcgtcgtacagaggggttctctggttccgatgttgctgtctgtgtgaaagatgtgttgtttgagcctgtgcgcaaaacacaggatgctatgtacttcttcaagacagatggtgacatgtggatgccctgtggatcgaagcaaccaggtgctgtgcagaccacgatgcaggatcttgcatccaaaggccttgcctcacagattctcccacccccaatctcgaagagcgatttcgagaaggtcctcgcgaggcagagaccgactgtcggcaagaaggacctggaggtgcacgagaagttcaccaaggagtttggcgaggagggctgagtggtacgcagccgcgagaactctctcgacccatgcacagccgcaccacagaaatgtatattgtttacaactttgattcgttgcgcttgggagttaaattcgcagatctgtacactctggtagcccttactgtgcttaacgtatggcgacgacggcagccttgttatgctgggctatcactgtgcctctgttgtcaactctatttcatttacactctgttgtgcttggaattttctgcaagtgtattaaggaataattgattattaaggtgggtagtccttgtggtgcagcttgtatagctgttttaattttttctggtaaaaaaaaatttagaaaaaaaaac

SEQ ID NO: 767 - DNA, 1604 bp, Ocimum basilicum
cgtctcgtgccgaatcggcacgagggcaatttcaaggagcccgtgatcgaatacgtgcggcaagccgtcgccgaagacaacgccggaaactatgccaaggctttccccttgtacatgaacgcgctggaatatttcaaaactcacctcaagtacgagaagaaccctaagattaaggaggcgatcacgcagaagttcaccgagtacttgcgccgtgctgaggagatccgcgccgtgctcgatgagggcggatcgggccccgcggcgaacggagatgcggcggtggccacgcggccgaagaccaagccgaaggatgggaatgaaggggaggatggcgataaggagaagcttcggtccggattgaactccgcgattattagggagaagcccaatgttaagtggaatgatgtggctggattggaaagtgcgaagcaggcgcttcaggaggccgtgattctgcccgttaagttcccgcagttctttactggtaagagacggccctggagggcttttcttctgtatggtcctcctggaacaggaaaatcctacttggcgaaggctgttgccaccgaagctgactcaacgtttttcagtgtttcttcttcagatttggtttctaaatggatgggtgaaagtgaaaagcttgtctctaatctcttccagatggcacgtgaaagttctccctctattatatttattgatgaaatagattccctctgtggacagcgtggagaaggaaatgaaagtgaagcgtctcgacgtatcaaaacagaattgcttgtgcaaatgcagggggtgggccacaatgacgataaagtttttgtcctcgttgccaccaacactccttatgctttcgatcaggctataaggcgaagatttgacaagcgaatttatatccctctaccagatgtgaaggcacgtcagcatatgttcaaggtgcatttgggggatactcctcataatttgacggaaagtgactttgaagcccttgctcgtaaaacagaaggcttttctggttcagatatttctgtttgtgttaaagatgttttatttgagcctgtgcgcaaaacacaagatgcaatgtttttcattaaaacttttaatggtccgtggatgccatgtggacccaagcaacaaggtgctgtccaaakmacsakgcaggagctcgctgcaaaaggacttgctgaaaagatcatcccacctccaatatcaaaaacagacttcgacaaggtgcttgcaagacaaagaccgaccgtgagcaaatctgatcttgatgtgcacgagagattcacaaaggaattcggcgaggaaggctgacaaacatgagatggtttagtctgctgcgactttgtagccggtgacctttgtacattatgttttttaccgcattcgaatattagcctcattaaatggggaaggtttagatgactgcattttcctccagtatttggccagaaaatgaaatgacacttctcaactcaaattgctgtatttattcttgtgtacaaacattaaactcctccgagaaacgttgtcaatatgttgtgttcatgcggggcgataaattatgtggcaatttcatgatttttctttgattggcacctatt

SEQ ID NO: 768 - DNA, 1783 bp, Phaseolus coccineus
taccaaaattgggtgaaaatttacgaaactaaagattgagtttttctctactcttttttcccattctgtcctcaaatttccgatcagttccgattctcacagctagggtttggaaatccaccaccacactttctccctataacgtgcgatcgcgatgcagctctagggttcttcctttatccgcactcgctaatctgaagtctcaattatcgtacatgccatcggtggtgactggaagaagatgtatagcaatttcaaggaacaggcgatagagtacgtgaagcaggccgtgcaggaagacaatgccggaaactacgcgaaagcgttccctctctacatgaacgccttggagtacttcaagacgcatctcaagtacgaaaagaaccctaagatcaaggaagccatcacgcagaaattcaccgagtacctgcgccgggccgaagagattcgggccgtcctcgacgacggcggcccaggaccggcttctaacggggacgctgccgtcgctgccaggcccaagaccaagcccaaagatggtgaaggcggcggcgacggggaggaccccgagcaagccaagctcagggcggggctcaactcggccatcgtgagggagaagcctaacgtgaagtggaacgacgtcgcagggttggagagcgccaagcaggccttgcaggaggctgtgattttgcctgtgaagttccctcagttctttactgggaaaagacgaccctggagagcctttttgttgtatggacctcctggaacgggaaaatcttatttagccaaggccgttgcaactgaagctgagtccacttttttcagtgtttcttcgtcagaccttgtttcaaagtggatgggtgaaagtgaaaagctggtttcaaatcttttcgaaatggctcgagaaagtgccccttctatcatattcattgatgaaatagattccctatgtggtcagcgtggggaaggcaatgagagcgaagcctcaagacgaattaaaacagagcttctggttcagatgcagggtgtaggacacaatgatcagaaagttcttgttcttgcagcaacaaatacaccctatgccttggaccaggcaataaggcgacgatttgataagcgcatttatattccactaccagatttgaaggctcgtcaacacatgttcaaggtgcatctaggagatactcctcataacttgactgaaagtgattttgaatacttggcgagcaggacagatgggttttctggttcagatatctctgtctgtgtaaaagatgtgttatttgaacctgttcgcaaaacccaagatgcgatgttcttctttaaaaattccgagggtatgtggatcccgtgtggaccaaagcaacagggtgctgtacaaacctcaatgcaggatcttgctacaaaaggacttgcttctaagatccttccacctcctatcacgaggacagattttgagaaggtactcgcgagacaaaggcctacagtaagcaaatctgaccttgatgttcacgagagattcacgaaggagtttggagaggaaggttaatactgatggaatttcactctgaagggtccacactggtttatattgctataatctgtaatttatttagctgttggatcaaatgaaatgcatctttttcattttgttctgggggatgcaaaggccccttttgtattttgtaccgaggtggatttatatgaagatcgatactcattttacttctaaattgtgtataacagaatttgaaatgatttgaaaaaataacttgtgtgacaaaaa

SEQ ID NO: 769 - DNA, 1783 bp, Brachypodium distachyon
cgttcccctttcctcctcctctcctcgtcctcatctccttcgtcaaacctcaggggccaagcaaccgccgccgtccccgaattcgtcgccccagacccctcccggccgcgccccgatcgaccctcgccgccgatccgccgtaatccgccgcaaaggcggcgcctttagctccccccctccggatccgatgtacagcaacttcaaggagcaggcgatcgagtacgtgaagcaggcggtccaggaggacaatgccggcaactacgtcaaggcgttcccgctctacatgaacgcgctcgagtacttcaagacccacctcaagtacgagaagaaccccaagatcaaggaggccatcaccgccaagttcaccgagtacctccgtcgcgccgaggagatccgcgccgtcctcgatgaggggggcggcggtgggccgggcgcgcccaacggcggagacgcggccgtcgccacgaagcccaagagcaagggcaaggacggcggcggcggcggcgacggcggggatgactcggagcagtccaagctgagggccgggctcaactcggccatcatcaccgagaagcccaacatcaagtggaacgacgtcgccggacttgagagcgctaagcaggcgctgcaggaggccgtcatattgcccgtcaagttcccccagttcttcacaggcaagcggaggccatggagggcttttcttttatatggtccaccaggaacaggaaagtcttatttggctaaagctgttgcaaccgaagctgattcgacattcttcagcatatcttcatcagaccttgtttcaaaatggatgggagaaagcgagaaattagttgctaatcttttccaaatggcccgcgaaaatgctccttccattatctttgttgatgaaattgattccttgtgcggtacacgcggggaaggcaatgaaagtgaagcttctaggagaatcaagactgaacttcttgtacagatgcagggagttggccataatgatgataaagttctcattcttgctgctacgaatacgccatatgctttggaccaggctgtgcggcggcggtttgacaaacgtatttacattcctctacctgacgcgaaagcaaggcagcatatgtttaaggtccatcttggggatacaccacacaacttgactgaaagtgattttgaggtcttgggtcgtcggacagatgggttttctggttctgatattgctgtttgcgtgaaggatgtgttatttgagcccgtgcgcaaaacacaggatgcgatgtacttctttaagacggatggtgacatgtggatgccctgtggatcaaagcaaccaggcgctgtacagaccaccatgcaggagcttgcatccaaaggcctagcctcacagattcttccacccccaatctcgaagactgatttcgagaaagtcctcgcgaggcagagaccgacagtcggcaagaaggacctggaggtgcacgagaggtttacgaaagagttcggcgaggagggttgatacgccgtacgtgaatgcccccatcttatgcacagctgcaccacagaaatgtatattgcttaccaaactttgattgttccgcttgttggggttagattcgcagatctgtacactctggtagccttactgtgcttaacttacggcggctttattatgctgggctatcattgtgcctgtgttgtcaactcatttgatttttacactccgttatacttggaattttccacaagtgtattaaggaataataattcttattgtggggagttcttgtggtgcagc

SEQ ID NO: 770 - DNA, 1755 bp, Theobroma cacao
gacgatcaaaaatccaatctttctctccccttcctctctctccttccttcgagccctctctccaaatctcaaaatctccagaaacccatttgaggaaaaaaaattttaatctttcatcgatcccatgcaaatcaattgagaagataaaatacccagaaaaaagaacccttcgaagaaagaaatgtatagcaatttcaaagaacaagcgatagagtacgttaagcaagcggtacaagaagataatgcaggcaactacagcaaagcctttcctttatacatgaacgcactcgagtatttcaagacccatttgaaatacgagaagaaccccaaaatcagggaagcgattacccagaaattcacagagtatttgcgtcgggccgaggagatccgtgccgttctcgatgaaggtgggcctggaccggcttctaatggggatgctgctgttgccacgcgccctaaaagtaagcccaaggatgttagtggcggtggagaaggcggtgacggggaggatccggaacaggctaagttgcgagctgggcttaattcggctattgttagggaaaagcctaatgtcaagtggaatgatgtagctggattggaaagtgctaagcaggctttgcaagaagctgttattttgcctgtcaagtttcctcagttttttactggaaaaagaagaccatggagagcttttctgttgtatgggccacccggtactggaaagtcatacttggccaaggccgtggcaactgaagcagactctacattttttagtgtttcatcatcagaccttgtgtcgaagtggatgggtgaaagtgaaaagctggtttcaaacctttttcagatggctcgcgatagtgctccttccatcatattcattgatgaaatagattccttgtgtgggcagcgtggagagggcaatgagagtgaagcgtcaagacgtatcaaaaccgaacttcttgtgcagatgcagggtgttggacataatgatcagaaagtcctagttcttgcagcaaccaatactccctatgcacttgatcaggccatccgccggcgttttgataagcgcatttatattcctctcccagatttgaaggctcggcaacatatgttcaaagtgcatttaggtgacactcctcacaacttgactgaaagtgattttgaaaacttagctcgccggacagaggggttttcagggtccgacatatctgtttgtgttaaggatgttctttttgaacctgttcgtaaaacccaagatgccatgtttttctacaagacacctaatgatatgtggatgccatgtggaccaaagcaaccaggtgctgtccaaattactatgcaggagttggcaggcaaaggacttgcggcacagatccttccgcctcctatttccagatcagattttgataaggtgcttgcaagacagaggccaacagtgagcaaagctgatcttgaggtccatgaaagatttacaaaggagtttggagaggaaggctgatggattgctgaaattgtcacattgatctacaccagttgtgagtgcaatcactgtgatttgtattttattaataactgctggatcatccaaagaattgtctctctatttagcttcatcaatcggggaaggtgacttgacttccctttttcctgtaatcagatggacgaacgtttgacacttaattgaattgcttgtcttttacggtgtaaagaagattattaagaaatttggcttaaaaatgcttgattatgagttgtgcc

SEQ ID NO: 771 - DNA, 1645 bp, Brassica napus
gatctcccttcctttaataatacttttccaggaaaattttctgatcatgaatcgtccacgcttctagggcttcctcaaatcatctcaatttttaattcarcaaacgaatttcaattatcgattattttctctgcaaaaccctaaaaaaaaaagagccatgtatagcaatttcaaggagcaagcgatcgagtacgtgaagcaagcggttcaagaagacaacgccgggaactacaacaaggccttccctttgtacatgaacgcgctcgagtacttcaaaacccatctcaagtacgagaagaaccctaagatcagagaagcgatcacgcaaaagttcaccgagtatctccgccgcgctgaggagatccgagctgttttggatgaaggcgggtcgggtcctgggtctaacggggatgctgctgtggctacgaaggcgaagagtaaagggaaggatggagatggggaggataaggagcagtcgaagctacgagctgggttggactctgcgatcgtgagggagaagcctaatgtgaagtggtctgatgttgcggggcttgagagtgctaagcaagcgttgcaggaagctgtgatcttgcctgttaagtttccgcagttcttcacagggaagaggaggccgtggagagcttttctgctgtatgggcctcctgggactgggaagtcgtacttggctaaggctgttgctactgaagcagattctacgttttttagtgtgtcttcatcggayttggtctcgaagtggatgggtgaaagtgaaaagctggtgtcaaaccttttcgagatggcccgggagagtgctccgtcaattatattcgttgatgagatagattctttgtgtggtcaacgtggggaaggtaatgagagcgaagcttcaagacgtatcaaawcagagcttcttgttcagatgcagggtgttggacacaatgatgagaaagtccttgtaytggcagcaacaaayacaccttatgctcttgatcaggctatycggmgacgttttgataagcgtatctatatccctctaccggatgtgaaggctcggcagcacatgttcaaagtgcrcctkggagatactcctcataatttgaatgagtctgattttgaatatttagctcgcaagacagagggattttctggttcagatgttgctgtttgtgtgaaggatgttctgtttgaacctgttaggaaaacccaagatgccaggttctttttcaagtcagctgatgggacgtggatgccatgtggccctaaacaatctggtgccattcagattacgatgcargatttagcagaaaaagggctmgcrgaaaagattatyccmccgcccatctcaagaacagattttgagaaggtattagcaagacagcgaccaacagtgagcaagtctgatcttgaggtccatgagagattcacaaaggaatttggagaggaaggttgatcattgatcatataaatggttcagcatctctctctggtgtcaggggaacctcaagctcctgattattatgtgtgtactaataagaacaaatcgactcttgtttcatccccatcattgaattttctttattttaactgtagaaattatttcagatatgaaattcgctcttggtatatatatattcataatctagca

SEQ ID NO: 772 - DNA, 1488 bp, Brassica napus
agcgatgtacagcaatttcaaggaacaagcgatcgagtacgtgaagcaagccgtacaagaagacaatgctgggaactacaacaaggccttccctctctacatgaacgcgctcgagtacttcaaaacgcatctcaagtacgagaagaaccctaagatcagagaagccatcacccagaaattcaccgagtacctccgccgcgcggaggagatccgcgccgttctcgacgaaggaggatcggggcccggatctaacggcgacgcggcggtggcgacgaggccgaagagtaagccgaaagatggaggaggagaaggtggggaggacgcggagcagtcgaagctcagagctgggttgaactctgcgattgtgagggagaagcctaacattaagtggacggatgttgctgggctcgaaagcgctaagcaggctttgcaggaagctgtgattttgcctgtcaagttcccacagttcttcaccggaaagaggaggccatggagagcttttctgctgtatggcccgcctgggacagggaagtcctacttggctaaagctgttgctactgaagctgactccaccttctttagcgtgtcttcatcagacctggtctccaagtggatgggtgaaagtgagaagctagtatcaaaccttttcgagatggcccgtgaaagttctccctcgattattttcgttgatgagatagattcgttgtgtggtcaacgtggagaagggaacgagagtgaagcttcaagacgtatcaaaacagagcttcttgtgcagatgcagggtgttggacatagtgatgataaagtacttgtgctygcagcaaccaatacaccttatgctcttgatcaggctattaggcgacgttttgataagcgtatctatattcctctcccagaagccaaggctaggcagcacatgttcaaagtgcatttgggagacacacctcataatttaactgaatctgattttgaatatttggggctcaagacagaagggttttctggttcagatgtttccgtttgtgtaaaagatgtcctttttgagcctgttcgcaaaactcaagatgcaatgttctttttcaagtcacctgatggtacatggatgccatgtggaccgaggcagcctggagctattcaaaccacaatgcaagatttagcagctaaaggccttgccgaaaagattattccaccaccgatcacaagaaccgatttcgagaaggtacttgccagacagaggccaacagtgagcaaatccgaccttgacgtccatgagagattcacacaggagtttggagaagaaggttaatagatttgtcattccatcaaatacctctcagtatcattagtctcttcactttctccttatgtatgtactgagaagtaaacaaatctcaaacccatgtttgatttgattccaaaacatttcatttgctttatttctcgaaatgtgtaaaaaatgttctaaatgcttaaacaatgattttctta

SEQ ID NO: 773 - DNA, 1733 bp, Ricinus communis
ggttctctccattggagtcaatcaaaatcaattttattttccaattcaagatctacaaatatccatcatcatcgtatcaaaatcaatagcccaatcagtaaaagaagaaattcaaattttagggtttctgatttcatctcaatcttctccaatctatcctcaagacttcacatgcgctcttctgtcaattgatcgaaagaaataatgtatagcaatttcaaagagcaagccatcgagtatgttcggcaagcagtacaagaggacaacgctggtaattatgcaaaagcatttcctttatatatgaacgcacttgaatacttcaaaactcatttgaaatatgaaaagaaccctaagattcgcgaagctataacccaaaaatttactgagtatcttcggcgagcggaggagatccgtgcagttctggatgaaggtgggcctgggcctgcttcgaatggagatgcggctgttgctacacggcctaagactaaacctaaagatggagaagatggggaggatcccgagcaaacgaaattgagagctggattaaattctgcgattattagagagaagcctaatgttaattggaatgatgtggcggggcttgaaagtgctaaacaggctttgcaggaagctgtgattttgcctgttaagtttcctcagttttttacagggaagagacgaccatggagggcttttcttttgtatgggccacctggaactgggaaatcttacttagccaaggcagttgcaactgaagcagactctacatttttcagtatttcttcatcagatctggtttcaaagtggatgggggagagtgaaaagcttgtttcaaatcttttccaaatggcacgtgaaagtcagccttcaattatttttatcgatgaaatagattccttgtgtggccaacgcggagaaggtaatgagagtgaagcttcaagacgtatcaagacagaacttcttgttcagatgcagggtgtagggaacaatgaccagaaagttcttgttcttgcagcaacaaacactccatatgctctagatcaggccatcaggcgacgttttgacaagcgtatatatattcccctcccagatttgaaggctcggcagcatatgttcaaagtgcatcttggagacacccctcataacttgactgaaagtgattttgaaagcttagctcgcaggactgaaggcttttcgggttcagatatttcagtttgtgtgaaggatgtcctctttgagccggttcgtaaaacccaggatgccatgttttttatcaagactccaaatgatatgtgggtaccttgtggaccaaagcaaccaggcgctgtccaaatttccatgcaggagctagcagcacaagggcttgccgccaagatccttccgccccccatcacaaaaacagattttgataaggtccttgcacgacagaggccaactgtcagcaaatctgatctcgaggttcatgagagattcacaaaggagtttggagaggaaggttaatcaatcaatgttgtgaaatgatcaatccacacccgtgagttcacctgctatgatttgtattttagttattgctgctggatccaatgagttattttacttcatcaaaaaggggaagctgacttgactttccctttgtattgagctggaaaaactgaagttggatactcattaaattacttgcttgaaattgtgtaaagaagagttcttagaaatatcattgcagaattgccaac

SEQ ID NO: 774 - DNA, 1891 bp, Castanea mollissima
gtccattgacagaccgaagaaagaaaaaaaagaaggttccttcctctcctctctttttcgtttcgcttctcttctctccttcaacaaaatccgatcacataaaaagaataagttatcccaataaaactttcaaaatcaaatcccgatcctccaatttccaaaccctaccttcaaatccaagcttcttatgtacaaatcaaaaatgatcctctcaaaattctagggtttcctatttcttcttcttcgtttttttttttcatcgaatttcaatcccggcctatgcgatttgcgaaagagtccaaaacatgtacagcaatttcaaagagcaagcaatagagtacgtgaagcaagccgtacaggaagacaatgccggaaactacgccaaggctttccctctttacatgaacgctttggagtatttcaagactcatctcaagtacgagaagaaccctaagatcaaggaagccattactcagaagttcaccgagtacctccgccgcgccgaggagatccgcgccgtgctcgacgacggcggccccggaccggcctctaacggggacgctgcggtcgctaccaggcccaagaccaagcccaaggacggcggcgaaggcggcggagacggagaggaccccgagcagtccaagctgagagctggcttgaattcggctattgtgagggagaagcctaacgtcaaatggactgacgtcgccggactcgagagcgcgaaacaagctctccaggaggctgtcattttgcctgtcaagtttccccaattcttcactggcaagagacgaccgtggagagcctttttattgtatggaccacctggaactggaaagtcttacttggccaaggctgttgcaactgaagccgattctacctttttcagtgtctcttcatcggacctggtttctaagtggatgggtgaaagtgaaaagctagtttcaaaccttttccaaatggctcgtgaaagtgagccttctattatcttcattgatgaaatcgattctttatgcggcacacgtggagaaggcaatgaaagtgaagcgtctagacgtatcaagactgaactgcttgtgcagatgcagggggtagggcacaatgatcagaaagttcttgttcttgcagctacgaatactccttatgctctggaccaggccatccggcggcgttttgataagcgtatatacattcctctaccagaagcaaaggcccgtcagcacatgttcaaagtgcatttaggcgatactcctcacaatttaactgaaagtgattttgaaagcttaggttacaagacagagggcttttcaggttcagatattgctgtttgtgttaaggatgtcctttttgaacctgttcgtaaaacacaagatgcaatgttcttttataagaattctaatgatatgtgggttccatgtggaccaaaacagccaggctctgtccaaattaccatgcaggagctggcagcacaagggcttgcttcaaagatccttccgcctcctatttcaaaagcagattttgacaaggtgcttgcaagacagaggcctacagtgagtaaatctgaccttgatgtccatgagagattcacaaaggaatttggagaggaaggttgaataatttgataaaatgttatcacgttgatccacacactagttgtgagaacattggtatgatttgtatttatgtatcagtgctggatccagtgaattatatcccttatattaagcttcttcacatggggaaggtgacttgacttccccgtttctgtattcagatggaatactgaggtttgatacttttgaaattacttgtcccaaattgtgtaaagtgcagtttcagaattatgaccgtagaatgtggacatgaggcatatgtgatgctgattgccttt

SEQ ID NO: 775 - DNA, 1811 bp, Citrus sinensis
tccccaaaacaaaaccaaataaccaatccaaataggaatccgtggacacggctgcttcactttgacatttaatcaaacacaaaacaaacaggaaactcaaattcgaaatcgaaatctttcaattcacccaaaaatcaaaattagtaatttcacatgcgatccgatcataaaccctaaccaataaatttataatttgaagatgtacagcaacttcaaggaacaggcaatcgagtacgtgaaacaagccgtgcaagaagacaatgctggaaattacgcaaaagccttccctctttacatgaacgccttggagtatttcaaaacccacttgaagtacgagaagaatcccaagattaaggaggcgatcactcagaaattcaccgagtatttgcgccgggccgaggagatccgtgccgttctggatgacggcgggcccggccccgctcacaacggggacgctgcggtggcgacccggcctaagacgaagccgaaggatggtggtgatggtggcggcggtgatggggaggatccggagcaggcgaagctgagggctggattgaattcggcgattattagggagaagcctaatgttaagtggaatgacgtggcgggtttagaaagcgctaagcaagctttgcaggaggctgtgattttgccggttaagtttccccagtttttcaccggtaagagacaaccgtggagagcttttctattgtatggaccacctggaactggaaagtcatacctggccaaggctgttgcaactgaagccgactctacatttttcagtatttcttcatcagacctggtttcaaagtggatgggtgaaagtgaaaagcttgtctcaagccttttccagatggctcgtgaaagtgctccttccattatttttattgatgaaatagattccttatgtggtcagcgtggagaaggcaatgagagcgaagcttctcggcgcatcaaaactgaacttcttgtacagatgcagggtgttggacacaacgatcagaaagttcttgttcttgctgcaacaaatactccctatgctctagatcaggccatccggcgacgttttgacaagcgtatatacatccctcttccagatttgaaggcaagacagcacatgttcaaggtgcatttaggagatacaccccacaacttgactgaaagtgattttgaaagtttagctcgcaagaccgaggggttttctggttctgatatttccgtttgtgtaaaggatgtcttgttcgaacctgtacggaaaactcaggatgccatgtttttctttaagacctctaatggtatgtggatgccatgtggaccgaagcaatcaggtgctgttcagatttcgatgcaggagcttgcagcaaaagggcttgcagaacagatccttccaccccctatttcgaaaacagattttgataaagttcttgcaagacagaggccaacagtgagcaaaagtgaccttgaagttcaagagagattcacaaaggagtttggagaggaaggttaatgggtctattatgcacataacgctgaatcatgctagtgagtgcaagcatatgatttgtatgttatttatcacttctggatccaatcatttcttcttcaagaagggaaggtgacttgacttccctttatctgtattcagatggaaaaactggggtttgatacttgttaattatttgtttcaaattgtgtaaagaacagttcccaaattactgcctcactttgttgaacatgatgcgaatattgctgattccataaattggtcagttttgtgtttatgctaactaattatctggtagatagga

SEQ ID NO: 776 - DNA, 2004 bp, Gossypium hirsutum
ggatagtgaaattaaggaaaataaaacaactcttatttcacacggttacttttgagctctgtttctacgatcaaatatccaaattttctctgtttgtcttcggatccctctttctacatctcaacatctccaataaccagtttgggaaaagagaacaaaaaaaaaaaaccggagagatctttaatctatctcatgagatttcattgaagaaataaaagtacccagaaaaagaaaaaaaaaacgatatgtatagcaatttcaaagaacaagcgatagagtatgtgaagcaagcggtacaagaagataatgcagggaactacagcaaagcctttcctttatacatgaacgcacttgagtatttcaagacccatttgaaatacgagaagaaccccaaaattagggaagctattacccagaaattcaccgagtatttacgccgtgccgaggagatccgtgccgttctcgatgaaggagggcctgggccggcttctaatggggatgctgctgttgccacccgccccaaaagtaagcccaagagtggtggtggagaaggcggtgatggggaggatccagagcaggctaagttgagagctgggcttaattcggctattattagagaaaagcctaacgttaagtggaatgatgtggctggtttagaaagtgctaagcaggctttgcaagaagctgttattttgcctgtcaagtttcctcagttttttactggaaagagaaggccatggagagcttttctgttgtatgggccacctggaactgggaagtcatacttggccaaggctgttgcaactgaagctgactctacgttttttagtgtttcttcctcagaccttgtatcaaagtggatgggggaaagtgaaaagcttgtctcgaaccttttcgagatggcgcgtgatagtgctccttccatcatattcattgatgaaatagattccttgtgcggccagcgtggagagggcaatgagagtgaagcttcaagacgtatcaaaactgaacttcttgtgcagatgcagggtgttggacataatgatcagaaagtcctagttcttgcggcaacaaatactccctatgctcttgatcaggccatccgccggcgttttgataagcgcatttacattcctctcccagacgtgaaggctcggcaacatatgttcaaagtgcacctaggtgatactcctcacaacttgactgaaagtgattttgaaaacttagctcgccggacagagggattttcagggtcagacatatctgtttgtgttaaggatgttctttttgaacctgttcgtaaaacccaagatgccatgtttttcttcaagacacctaataatatgtggatgccatgtggaccaaagcaaccaggtgctgtccaaattaccatgcaggaattggcagccaaaggacttgcagcacagatccttccaccacctatttcaagatcagatttcgataaggtgcttgcaagacagaggccaacagtgagcaaagctgatcttgaggtccatgaaagatttacgaaggagtttggagaggaaggttgatggattggatgaaattgtcacattgatatactcttgttgtgaggtgctatcactgtgatttgtattttattcataaccagcttgtcgtccaatgaaatgtgggtttagcttaatcaagtggggaaggtggcttgacttcccatttcctgtattcagaatggaattgcatttttttttatccttttacagtgtaaagaagataaccaagtaatttggcatataatgtttgaatatgagttgtgcccttttatgcctatattttttgaccaattttcaaaaaaaaaaaaaaaaaacttccaaaataatttctaaaaggggccgcggggccccatccaattttcccccccgggggggggaaacacaggtaaggttgtaccccatattcccccccattaaaggtggagttaaatataacaaattcacggtggggccgtcgcttttttaaaaaacg

SEQ ID NO: 777 - DNA, 1544 bp, Gossypium hirsutum
gcctcctcatatgatcgatcgcaaagagaaagaggtgcagaataaactttccctaattcattgcaattagcatcagccaaatccctaccttacatccttccctgtcctcccatccaatccctaaatttcacaatgaacaaagaaaaaattgattaatttttcatcgatcccatgcaatttctttgagaaaatatatctaatacccagaacaaaagaagaagaaatgtatagcaatttcaaagaacaagcgatagagtatgtgaagcaagcggtccaagaagacaatgctgggaactatagcaaagctttccctttatacatgaacgcgctcgagtatttcaagacccatttgaaatacgagaagaaccccaaaattagggaggctattacccagaaattcaccgagtatttacgccgtgccgaggagatccgtaccgttctcgatgaaggtgggcctggaccggctactaatgggggcgctgctgttgccactcgccccaaaagtaagcccaaggatggtagcggcggaggggaaggaggtgatggggaggatcccgatcaggctaagttgagagctgggcttgattcggctattattagggaaaagcctaatattaagtggaatgatgtggctgggttagaaagtgctaagcaggctttgcaagaagctgttattttgccagtcaaatttcctcaattttttactggaaagagaaggccatggagagcttttctgttgtatgggccacccgggactggtaagtcatacttggccaaggctgttgcaactgaagcagactctacattttttagtgtttcytcatcrgaccttgtctcaaagtggatgggggaaagcgaaaagctagtttcaaaccttttycagatggctcgtgacagtgcaccatccatcatattcattgatgaaatagattccttgtgtggacagcgtggtgagggcaatgagagtgaagcatcaagacgtatcaaaactgaacttttggtgcagatgcagggcgttggaaataatgatcagaaagtcctagtgcttgcagcaacaaatactccttacgcgcttgatcaggccatccgccggcgttttgataagcgtatttacatacctcttccagatttgaaggctcggcaacatatgttcaaagtgcatctgggtgatactcctcacaacttgactgaaaatgattttgaaagcttagctcataggacggatgggttttcagggtcagacatatctgtttgtgttaaggatgttctttttgaacctgttcgtaaaacccaagatgccatgtttttcttcaagacacctgatgatatgtggatgccatgtggaccaaagcaaccaggtgctgtccaaattactatgcaggaattggctgccaaaggacttgcgkcacagatycttccacctcctatttcaagatcagattttgacaaggtgcttgcaagacagaggccaacagtgagcaaagctgatcttgaggtccatgaaagatttacaaatgagttcggagaggaaggttgatagattt

SEQ ID NO: 778 - DNA, 1646 bp, Gossypium hirsutum
  misc_feature (755)..(755): n is a, c, g, or t
agaaatgtatagcaatttcaaagaacaagcgatagagtacgtgaagcaagctgtacatgaagacaatgaagggaattacagtaaagctttccctttatacatgaacgccctcgagtatttcaagacccatctgaaatacgagaagaaccctaagatcagggaagcgattacccagaggctcatcgagtatttgcgtcgcgctgaggagatccgtgccgttcttgatgaaggtgggccaggaccggcttctaatggggatgctgctgttgctacgcgtccgaaaagtaagcccaagaacggtggtggcggaggtgaaggcggtgatggaggggaggatccggaccaggctaagttgagatctgggcttaattcggcaattattagggaaaaacctaatgttaagtggaatgatgtggctgggttagaaagtgctaaacaggctttgcaagaagctgttattttgcctgtcaagtttcctcagttttttactggaaagagaaggccatggagagcttttctgttgtacggaccaccggggactgggaagtcatacttggccaaggctgttgcaactgaatcagactctacgttctttagtatttcttcatctgacctygtgtcgaagtggatgggggaaagtgaaaagctggtttcaaacctttttcagatggctcgtgatagtgctccatccatcatattcattgatgaaatagattccttgtgtggtcaacgtggtgagggcaatgagagtgaancatctaaacgtatcaaaaccgaacttctcgtgcagatgcagggtgtcggacatactgatcagaaagtcttagtgcttgcggcaacgaatactccctatgcactcgatcaggctattcgccggcgttttgataagcgtatttacattcctctcccagatttgaaggctcgacaacatatgttcaaagtgcatttaggtgatactcctcataacttgaccgaaagtgattttgagaacttagctcgccgaacagaggggttttcaggttcagacatatcagtttgtgttaaggatgttcttttcgaacccgttcgtaaaacccaggatgccatgtttttctacaagacacctgaggatatgtggatgccttgtggacctaggcaaccgtctgctgtccaaattaccatgcaggaattggcagccaaaggacacgcagcacagattcttccaccacctatttcgagatcagatttcgacaaggtgcttgcaagacagaggccgacagtgagcaaaggcgatctcgaggtccatgagagatttacaaaagagtttggagaggaaggttgatggatttgtatgcaactgtgacattgacctacacagttgtgagtgcattcactgtgatttgtaattttattkatttaactgctggggtcatcactggaaattgtctctattyttttwacttsaccaggctgtattcatataggatgaacasattacrtttcattgaattgatgttttttttcttggtttaaataagaccctcttcttccttcttgcttagtcggggggtcgatgtctcggagaggcatcctttatttatagaccgcccgcccccgggagggacctccttcttttgtttcattgagggatggttagctgcccgctt

SEQ ID NO: 779 - DNA, 1777 bp, Gossypium hirsutum
gaattcactagtgattcgcggatccgaacactgcgtttgctggctttgatgaaatgttttgacgataaaaaatcgaatctttctttatctttcttccatctcaaaagctacaaaaacccgtttgcagaaaaattaaaaaagaagagttcaatctgtaattggtcccatgcaattctattgaaaaataaattccaggaaaaggataaaagtatgtatagcaatttcaaagaacaagcgatagagtacgtgaagcaagcggtacaagaagataatgcagggaattacagcaaagcgttccctttatacatgaacgcgctcgagtatttcaagacccatttgaaatacgagaagaaccccaaaatcagggaagcaattacccagaaattcaccgagtatttacgacgtgccgaggagatccgtgcagttctcgatgaaggtgggccagggccggcttctaacggggatgctgctgttgccacgcgccccaaaagtaagcccaagaatggtggtggcggaggagaaggcggtgacggggaggatccggaacaggccaagttgagagctgggcttgattcggctattattagggaaaaacctaatgttaagtggaatgatgtggccgggttagaaagcgctaagcaggctttacaagaagctgttattttgcctgtcaagtttcctcagttttttactggaaagagaaggccatggagagcttttcttttgtatggaccacctgggaccgggaagtcatacttagccaaggctgttgctactgaagcagactctacattttttagtgtttcttcatcagaccttgtctcaaagtggatgggtgaaagtgaaaaactggtttcaaacctttttcagatggctcgtgatagtgctccttccatcatattcattgatgaaatagattccttgtgtggtcagcgaggtgagggcaacgagagtgaagcatcaagacgtatcaaaactgaacttcttgtgcagatgcagggtgttggacatagtgatcagaaagtcttagtgcttgcagcaacgaatactccctatgctcttgatcaggccatccgccgccgttttgataagcgtatttacattcctctccctgatttgaaggctcgacaacatatgttcaaagtgcatttaggtgatactcctcacaacttgactgaaagtgactttgaaagcttagctcggcggacggaggggttttctgggtcagatatatctgtttgtgttaaggatgttctttttgaacctgttcgtaaaacccaagatgcaatgtttttctacaagacgcctaatgacatgtggatgccatgtggacccaagcaagcaggtgttgtccaaatcactatgcaggaattggcagccaaaggacttgcagcacaggttcttccgcctcctatttcaagatcagattttgataaggtgcttgcgagacagaggccaacagtgagcaaagctgatcttgaggtccatgagagatttacaaatgagtttggagaagaaggctgacggctttgatgaaaccgtcacattgatctactctccagttgtgagtgcaatcactgtaatttgtatttttattaataaccgcttgatcatccaaggaatcatctcaatttagcttcgtcaagcggggaaggtgacttgacttcccttttcctgtattcagacgcaatgaagttaattgcttgtcttttttactgtgtaaagaagattaccaagaaaactttggcttcaaatacttgaatttatgctgtgccct

SEQ ID NO: 780 - DNA, 1597 bp, Vigna unguiculata
aagaaccttctctgactcgcccaaccattccaaacgctttctctttccacgcgcatccttttcttcgtcttcttcttcttcttcttcacaatcagatccttcacaaaatcacagaacaagaagaaaaagatgtatagcaatttcaaagaacaagcaatagagtacgtgaagcaagcggtggatgaagacaacaaaggtaattacgcgaaagcgtttcaactttacatgaacgcgttggagtacttcaaaacgcacctcaagtatgagaagaaccctaagatcaaggaggccatcacgcagaaattcacggagtacctgcgtcgggccgaggagatccgggccgtcctagatgatgggcccagcggcccaccttcctccggggatgctgctgtcgctaccaggcccaagactaagcccaaggacggcgccggcggtgacggggaggatcctgaacaggccaagctccgggccgggctcaactctgccatcgttagagaaaagcccgacgtgaagtggaacgacgtggcggggctggagagtgccaaacaggctctgcaggaagcggttatcttgcccgtgaagtttcctcagtttttcaccggtaaacgacgaccttggagagcgtttttgttgtacggaccacctgggacgggtaaatcgtatttggccaaggctgttgcaacagaagctgattcgacattcttcagtgtttcttcatcagacctagtttcaaagtggatgggtgaaagtgaaaagttggtttcaaatctttttgaaatggctcgtgaaagtgcaccttctatcatattcattgatgaaatagattctctgtgtggtcagcgtggagagggtaacgagagtgaggcttcaagacgaattaaaactgaagttctggtgcagatgcagggtgtaggacacaatgatcagaaagttctggttctagcggctacaaatacaccttatgctctagaccaggcaataaggcgacgttttgataagcgaatatacatacccctaccagatttgaaggctcgccagcacatgttcaaggtgcacctaggagatactccccatagtttgacagaaagtgattttgaacatttggctcgccggacagaggggttttcaggttcagatatatctgtctgtgtcaaagatgttttatttgaacctgttcgcaaaacccaagatgccatgtttttctttaagaatcctgagggcatgtggattccatgtggaccaaagcaacagagtgcaatacaaattacaatgcaggagcttgctgcgaaaggacttgcttcacagatcctgccaccacctatatcgaggacagattttgacaaagtacttgctagacaaagacccactgtaagcaagaccgacctcgatgttcatgagagattcacaaaggagttcggagaggaaggataattctgacggaatttttcttcgactatatgcactagttcaaacatgttattatttgtaatttacagaactattggatcaagtgaagtgcataattttacttctcataaattgtgtataaaaacagtctgaaattctcagaaaaataaatttcatgtgatatatggta

SEQ ID NO: 781 - DNA, 1530 bp, Mesembryanthemum crystallinum
atgtacagtaatttcaaggagcaggcgatcgagtacgtgaagcaagcggtacaagaggacaatgccggaaactatagcaaagctttccctctttatatgaacgctttggagtacttcaagacccacctcaagtacgagaagaaccctaaaattcgcgaggcgatcactcagaaattcactgagtatctccgccgtgccgaggagattcgggctgtgcttgatgagggcggcggtgccggtcctgctgcgaatggtggcgatgctgcagttgcggcgcggccgaaagggaagccgaaggatggtggtggtgatggggaggatgccgagcaggctaagttgcgttccgggcttaattcggcgatcatcagggagaagccgaatgtgaagtggaatgatgtggctgggttggagagtgccaaacaagctttgcaggaggctgttatcttgcccgttaagtttcctcagttcttcactggtaagaggcgaccgtggagagcttttcttttgtacggaccaccaggaacaggaaagtcatacttggccaaggctgttgcaacagaagcagactccaccttctttagtgtttcctcatcagatttggtctcaaagtggatgggtgaaagtgaaaaattagtttccaaccttttccaaatggctcgtgaaagtgctccttcaattatttttgttgatgagatagactcgttatgtggtcagcgaggagaaggaaatgaaagcgaagcttctaggcgtatcaagacagagctcctagtgcagatgcagggtgttggacacaatgatgaaaaagttcttgttcttgcggcaacaaacactccgtatgctctagatcaggctattcgacgacgttttgataagcgtatttatattcctctaccagatctcaaggcccggcagcatatgttcaaggttcatcttggtgatacaccacacaacttaactgagagtgattttgaattcttagcccgtaaaacagagggtttctctggttcagatattgctgtttgtgtcaaggatgtactttttgaacctgttcgtaaaacccaagatgccatgttcttctataagacaagtgatgatgtgtgggtgccctgtggaccaaggcaaccaggtgctgtccaaataaccatgcaggatcttgcagcaaagggactggctgctaagatagttccacccccgattgcaagaacagattttgagaaagtacttgcaaggcagaggccaactgtaagtaaatcagaccttgaggtacatgagagattcacacaagagttcggggaagaaggctgataatttcgatggaagactgccctttcgtctcaatcaggttgcgtgttgcaaccaaactttgtaatttaattttattattgctactggatacagcagagtaaatcatccctcgccctgcttgtgtaaaagggatttgacgtgatgtgtcgatgtgtaatttttttctggaatacagaagtttggtattcgaaaattaattgttttgttagttatttggttgaacat

SEQ ID NO: 782 - DNA, 1692 bp, Lactuca sativa
cggccgggggaattgaggagcatttgactccattccttcgtcacctgatcaycrtcgtcttctcccttttcctccaatcraacccccaaattagtcgatttcagttcccgatccaccttaatttctagggtttcattccctttttcctatttatactaccacaatcattcgatctcaaaaacccttgattacacatatgccatgtatagcaatttcaaagaacaagcaatagagtacgtgaagcaagctgtacaagaggacaatgctggaaattacgcaaaagcttttcccttgtacatgaacgctttggagtacttcaagactcacttaaagtacgaaaaaaaccctaagattcgtgaagcgattacgcagaaattcaccgagtatttgcgtcgcgcggaggagattagggctgttctggatgaaggtggtacgggcccggcggctagcggaggtgatgcggcggtggcggcacggccaaagacgaaacccaaggatggggaagggggaggtggagatggggaagatcctgagcagtcaaagcttagggctggattgaactctgcgattgttcgggagaaacctaatgttaagtggaatgatgttgctggacttgagagtgctaagcaggctttacaagaagcggttattctaccggtgaagtttcctcagttttttactggtaaaaggagaccttggagagcttttcttttatatggtccacctggcacaggaaagtcatacttagcaaaagctgttgcaactgaagcagactctacatttttcagtgtatcttcttcagatcttgtttcaaagtggatgggtgaaagtgaaaaactagtctcaaatcttttccaaatggcacgtgaaagtgcaccttccatcattttcattgatgaaattgactccttaagtggtcaacgtggtgagggcaatgaaagtgaagcttcaagacgtatcaaaaccgaaattcttgttcaaatgcagggtgtaggacacaatgatgacaaagtcytagttctygcagccacaaacacaccctactctctygatcaggctataaggaggcgatttgataagcgtatatacattccactcccagatatgaaagcaagacagcacatgttcaaagtgcatttaggggatacgcctaataacttaactgatagtgactttgaagctttgggtcgtaagactgaagggttttctggttctgatattgctgtttgtgttaaggatgttttatttgaacckgtccgtaaaactcaagacgccatgtttttcgttaacacaaacgacggcttgtgggtcccgtgtggacctaaacaacccggggctgtccagatcaccatgcaagagcttgcagcaaaaggactcgcttcaaagattagtccgccrccaatcatacgggcggattttgataaggttttggtgaggcagaggccaactgtgagtaaaagtgatcttgagcttcatgagagattcacaaaagaatttggggaagaaggttaatgaacagtgactcggtgagttgagctgagttgaactcatttatgtcaaatgtattttaaaatacttggtgttggatttttatacaagtttgagcatgttcaagcttttcttctgaaccaacaaggatatatactatgtttttccttctgaaccaatttgaaaatccaagtgtgattaatt

SEQ ID NO: 783 - DNA, 1576 bp, Lactuca sativa
cgggggaaacccaatcacacgacccgcgaaaaaacaggattacgcggtttatacctcgcccttcaagataacttccatctctcttgatcccaaagcttcgttgacccgaaatcttccatcctcgttcttgatttcccacttttttcatatcagtcggacaaaattcaaaagatgtatagcaattttaaggaacaagcaattgtgtatgtaaagcaagcagttgaagaagacacagctggtaattatgcaaaggcctttacactttacatgaatgcattagaatacttcaagacccatttgaagtatgaaaagaatccaaagcttaaagaagcaatcacccaaaaattcaccgattatttgaggagggctgaggaaattagggctgttctcgaggatggaggaggcaataaaccctcatcaaatggaggagatacaggggtcgctacaaggcctaaatcaaataaaaagaacggagatggagatggtggtgaagattctgaacaatctaaacttagatcagggcttaattctgcaattataagagagaaaccgaatgttaaatggaatgatgttgcgggtcttcagagtgctaaacaagctttgcaggaagctgtgattctacctgtgaagttcccacaattctttgttgggaagagacggccatggagagcttttttattatacggaccaccaggaacaggaaaatcctacttggctaaagctgtggcaacggaagcggattcaactttcttcagtatatcttcttcggatttggtttcaaaatggatgggagaaagtgaaaagttggtttcaaatctattccaaatggctcgagaaagcgccccttcaattattttcattgatgaaatagactcgttggtgggccaacgtggtgaaggaaacgaaagtgaagcatctcgacgtattaaaaccgaacttcttgttcaaatgcagggtgttggaaataatgatgacaaagttctggttcttgcagctacaaatactccgtattcattagatcaggctattaggagaagattcgacaagcggatttatattcctctacccgatgtaaaggcaaggcagcacatgtttaaggtacaccttggagatacgcctcacaacctgactgatcgtgactttgagcaactggggtataggacagaagggttttctggttcggatattgctgtttgtgttaatgaggtcctgtttgaacctgtgcgtaaaacgcaagatgctatgttttttattaaaacatctgatgacacctgggtgccttgtggaccaagacacccaggtgccattgagatcactatgcaggatctcgctgcacaagggcaagcagaaaagatccttccaccgccaatatcgagaacagattttgacaaagttttagcaagacagaaacctactgtaagcaaatcggatctagaattgcatgacagatttacgagagagtttggagaagaaagatgatgattgattgattctttgaatgaaatgtttatatttgaattattaatggatgattttctacaaatgtggcatcaagaatattttgtgcagttgaatg

SEQ ID NO: 784 - DNA, 1855 bp, Zea mays
aatgaatgccacctattcttttttctccgcagccaaaacacgcttctcccttcccatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggccgatcccccctcctatccgccgcagaggcggcgcctctgggcctaccccgatgtatagcaacttcaaggagcaggcgatcgagtacgtcaagcaggcggtccaggaggacaatgccggcaactacgtcaaggcgttccctctctacatgaacgcgctcgagtacttcaagacccatctcaagtacgagaagaaccccaagatcaaggaggccatcaccgccaagttcaccgagtacctccgccgcgccgaggagatccgggccgtcctcgacgagggcggcgcggggccgggggccaacggaggtgacgcagccgtcgccacgcgccccaagaccaagggcaaggacggcgacgggggcaacggaggggatgactccgagcagtccaagctcagggcggggctcaactctgccatcatcaccgagaagcccaacgtcaagtggaacgacgttgctggcctcgagagcgccaagcaagctctgcaggaggccgtcatattgccggtcaagttcccacagttcttcacgggcaagcggaggccttggagggcgtttcttttatatggccctcctggaacaggaaagtcttacttggcaaaagccgtcgcaaccgaggctgattcaacatttttcagtatatcttcttcagatctggtttcaaagtggatgggtgaaagcgagaaattagtcgcaaatcttttccaaatggctcgtgaaaatgccccttccattatctttattgatgaaattgattctttatgcggtcaacgtggagaaggtaatgaaagtgaagcatctaggaggattaagactgaacttcttgtgcaaatgcagggtgttggtcataatgatgataaagttcttgttcttgctgccacgaatacgccatatgctctggaccaggctgtgcggcgaagatttgacaagcgtatctacattccgctacctgacacgaaagcaaggcagcatatgtttaaggtccatctcggggatacaccacacagcttaactgaaagcgatttcgagagcttggcccgtcgaacagatggattttctggttctgatgttgctgtttgtgttaaggatgtcttatttgaacctgtgcgcaaaacacaggatgccatgttcttcttcaaggcagacggtgacatgtggatgccatgtggaccaaaacaaccggggtctgtacagaccacaatgcaggagcttgcatccaagggcctcgctgcaaagattcttccaccacctatctcaaggacggattttgagaaggtcttgtcgaggcagaggccgacagttagcaagaaggatctggaggtgcatgagaggttcactaaggagttcggcgaggagggctgatacaccgcgcgcggacacacacccatgcacagctgcaccacagaaatgtatattgtttatcacttcgattgttctgcttggaagttgcattcacaggattgtacatttggtagcccaactatgagtaatcatggcagctgctttaccgtgttgggctaccgatgggcctctgttgtcaacttatttcaatttttatttatgcacatgaaaattttccgcaggtgtattattgaataataattcttaacgtggagcccttgtggttgctagtttctttttct

SEQ ID NO: 785 - DNA, 1846 bp, Zea mays
aaaaaataaaaatcgcagccaaaacacgcttctcccttcccatcttttcctttcccctcctccctcctcggctcgtctctgttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagatccgggcggtcctcgatgagggcggcgcagggcctggggccaacggtggcgacgcagctgtcgccacgcgccccaagaccaagggcaaggacggggacggaggcaacggaggggatgactccgagcagtccaagctgagggcggggctcaactccgccatcatcaccgagaagcccaacattaagtggaacgacgttgccggcctcgagagcgccaagcaggcactgcaggaggccgttatattgcccgtcaagttcccgcagttcttcacgggcaagcggaggccttggagggcgtttcttttgtatggccccccaggaacaggaaagtcttatttggcaaaagctgttgcaaccgaggctgattcaacgtttttcagtatatcttcttcagatctggtttcaaagtggatgggtgaaagtgagaaattagttgcaaatctgttccaaatggctcgggaaaatgccccttccattatcttcattgatgaaattgattctttatgcggtcaacgtggagaaggcaatgaaagtgaagcatctaggagaattaagactgaacttcttgtgcaaatgcagggtgttggtcacaatgatgataaagttcttgttcttgctgccacgaatacgccatatgctctggaccaggctgtgcggcgaagatttgacaagcgtatctacattccgctacctgacatgaaagcaaggcaacacatgtttaaggtccatctcggggatacaccacacagtttaactgaaagtgatttcgagagcttggcccgtcggacagacgggttttctggttctgacgttgctgtctgtgttaaggacgtgttatttgaacccgtgcgcaaaacgcaggacgccatgttcttcttcaaggcggacggtgacatgtggatgccatgtggaccgaagcaaccgggcgccgtgcagaccaccatgcaggagcttgcatccaaaggcctcgctgcgaagattcttccgccccctatctcgagggcggacttcgagaaggtcctgtcgaggcagaggccgacggttagcaagaaggacctggaggtgcacgagaggttcacgaaggagttcggcgaggagggctgacagacgcgggcacccacccatgcacgggctgctgcaccacacaaatgtatattgcttcttatgacttggattgttctgcttcgaagtggaagttgcgttacattacaatttggtgtcccaactacggctaatcatgccagctggtttctcgtgttgggctaccaatgggcctctgttgtcagcctatttcatttttattgttgcacatggaatttttccacgggtgtattattatggaataataattgttagcgtggtggagtccttgtggttgca

SEQ ID NO: 786 - DNA, 1817 bp, Medicago truncatula
ctttctttctacacactccaaaacacaacctagtttgggtttacaattcccaaacaaaaaacaaatcaaccccaagcaaaattccccaaatcatgtttttatcacagctctagggtttcatcaatttcccccaattctcaatcaattcatgcaataatcgattcatctcaaaccctaagaagaacacgatgtatagcaatttcaaggaacaagcaatagaattcgtgaaacaagcagtaacagaagacaattctggaaactatgcaaaagcctttcctttatacatgaacgcgttagagtatttcaaaactcatctcaagtacgagaaaaaccctaaaattaaggaagcaattacgcagaaattcaccgagtatcttcgtcgtgcggaggagatccgtgctgtgcttgatgatggtgggccgggtccagcttctaatggagatgctgctgttgctactaagccgaaaacgaaggggaagggtggtggggagggtgaagggggagggatgcttaccagagtaagcttagggcggggttgaattccgcgattgtgagggagaagccgaatgtgaagtggaatgatgttgctgggttggagagtgctaagcagtcgttgcaggaagcagttatcttgcctgttaagtttcctcagttttttactggtaaaagacgaccttggagagcatttttgttgtacggaccacctggaacaggtaaatcatacttggccaaggctgttgctaccgaggctgattctacatttttcagtgtttcttcatcagacctcgtttcgaaatggatgggtgaaagtgaaaagctggtttcaaatctttttgaaatggctcgcgaaagtgcaccttccatcatatttgttgatgaaatagattctctatgtggtacgcgtggagaaggcaatgagagtgaagcttcaagacgaattaaaactgaacttctggtgcagatgcagggtgtcggacacaatgatcagaaagttcttgttcttgcagcaacaaatacaccttatgctctagaccaggcaataaggcggcgttttgataagcgtatatacattccactgccagatttaaaggctcgccaacacatgttcaaggtgcatctaggagatactccccataacttgactgaaagtgattttgaacacttggctcgcaagacagaggggttttcaggttcagatatagctgtctgtgtgaaggatgttttatttgaacctgttcgtaaaacccaagatgccatgtttttctttaagagtccggaaggtatgtggataccgtgtggacagaagcaacaaaatgcagtacaagttacaatgcaggatcttgccacacagggactagcttcaaagatcctaccaccgcctatatcaagaatcgattttgacaaagtacttgctagacaaaggcccacagtaagcaaatctgaccttgatgttcacgagagattcacaaaggagttcggagaggaaggttaatgctgatggattttatctcagatccacacttgtttaaacatgttcatgagagattcacaaaggagttcggagaggaaggttattgctgatggattttatctcagatccacacttgtttaaacatattgttataatttgtataattgtaagttactgagctattggatcaagtgaaatacatcttttttatttatggtggatgtgaattccccccacttgtatggagccggatactgattttacttctcctaaattgtgtataaaaacagaatctgaaataatcataaaaataatttctgtgaaaaaaaaaaccaataaaaaactc

SEQ ID NO: 787 - DNA, 2084 bp, Pinus taeda
atattggatgattcccgatcgcttgtgggtttcctcatgggtgctttaaggatcatcacaggagattgcgcggaaatttcagtattttgacatccggggatgctaattgcctctaatttccctggatacgactcatagattggtctgataaaagtgcagggtccgatttgaggagggcattggagggcttttgattaatcaggatccaggagggcattggagggcttttgattaatcaggatccaggatgtatagcaatttcaaggagcaggccatagagtatgttcggcaggcagtgcaggaggacaacgcaggcaattatgccaaggcatttcccctctacatgaatgccctcgaatacttcagaacccatctcaaatatgagaaaaaccctaagatcaaggaggccatcacccagaaattcacagagtacctgaggagagcggaggagatccgagttgtgttggatgaggggacgaattctaggcctactgccaatggggatgcggccgtggccaccaagcccaaatcgaagccgggagccaaaggggatggagatggggatggggaggatccggagcaggccaagctccgatcaggtctcaattcggccataattcgagagaaaccgaacatcaagtggactgacgtggcaggcctggaaagtgccaagcaggccttgcaggaggctgtcatcctacccgtcaagtttccccagttcttcacagggaaacgaaagccctggagagcttttcttttgtatgggcctcctggtacagggaagtcatatttggcaaaggctgttgcaactgaagcagattcaacattttatagtatttcttcttcggaccttgtttcaaaatggatgggtgaaagtgagaagcttgtttctaatctatttcaaatggctcgggactgtgctccatcaatcatatttattgatgaaatagactctttatgtgggcaacgtggagaaggtaatgagagtgaagcttctcgacgaataaagacagaacttttagtacaaatgcagggtgtaggaaacaatgatcagaaagttcttgtattggcggctacaaatactccttatgctctggaccaggctattaggaggcgttttgacaaacgaatctatattcctctacctgatctgaaggcaaggcagcatatgttcaaggttcacctgggtgacacacctaacaacctgacagagggtgactttgaggatctagcacggagaacagatggtttctctgggtctgatatttctgtttgtgtgaaagatgtattatttgaacctgtacgtaaaactcaagatgctatgttcttcagcaaagtgtctaccgaagacggtgagatgtgggtgccatgtggtccccgacaacctggggctgtgcaaaccactatgcaggaacttgcagttaagggtctggcttcaaagattctgcccccgccgatttcaaaggcagattttgacaaagtccttgcaaggcagagaccaactgttagcaagcacgacctagaagtccatgagcgattcacaaaggaatttggtgaagagggctgacaaattttctttctcaaggtcttccaattgtattatttccattattctccgaccagattagtggcttgtaacatctgtcggttgttctagattcttataaaattaatgggctttcgttgaccacgggatacatcatttatatgatctggtggtatgtttatcttttgtggaggctatcttctgattttaatgatccccttttcgcggtttgctcttattcaaatctcaaaattgttacgaggtatttgtatatgagaatttgggctgaaactaatcaagttagctagctcttaagttatccatctcatgggtataaaaatatggatcctgtattagtagcacgcaaattaattaaaacggtgctgtggctccttgaaagactttaggctcgaaatcatatatattggtaggaatcaaattgcgtcgtcatgataaccgtggttaaatcctttattgatgtgattgggaaaagataactgtatatataatgctaatccagcgtctgcatttgttacat

SEQ ID NO: 788 - DNA, 1792 bp, Pinus taeda
ggcgatcgagtacagaggaaatcctttcttatgcatagaagctccatgcagtcaagtcttttgttgcattcaaagaaattcagagtatagctgagatgggtatctcagggctttgatttcatagagttacaggcctcgtgggcactttggtttcataggattatgcagtgaaaacccagtagggataattgtttgattgggatatccctgttcttcatgtattctgctccaccagacgaaacacccagtgcttatacacataggaattagtagcagcaatgtatagcaatttcaaggaacaggccatagagtatgttagacaggcagtgaaagaagataatgccgggaattatgccaaggcctttcctctttacatgaatgcccttgaatacttcaaaactcatctgaagtatgagaagaaccccaagattaaagaggccattacacagaagtttactgagtatttgcgaagggcggaggaaatccgtgttgtgttagacgatggagctagtgcagggcctactgcaaatggtgatgcagctgttgtgaccagaccgaagaccaagcccggcaacaaggacggggatggagatggagaggatcctgagcaaacgaaattgcgtgcgggcctcaattcggcgattattcgcgagaagcctaacgtgaaatggagtgatgtgtcagggcttgaaagtgccaaacaggctttgcaagaggcagttatccttcctgtaaaatttccccaatttttcacagggagacgaaagccctggaaagcttttcttttatatggacctcctgggactggaaagtcatacttggcaaaagctgttgcgaccgaagcagattcaacgtttttcagtatttcttcttcagaccttgtttcaaaatggatgggtgaaagtgagaaacttgttgcaaatttatttcagatggcccgtgattctgcacctgctattatattcattgatgaaatagattctttatgtggtacacgtggagaaagtaatgagagtgaggcttctcgacgaataaaaacagaagttcttgtacagatgcagggtgtaggaaacaatgatgataaagttcttgttctggctgccaccaacactccatatgcattggatcaggcaattcggcgtcggtttgacaaaagaatttacatcccactaccagaggtcaaggcaaggcagcatatgttcaaggtccatttaggtgacacaccccacaacttaactgagagcgattttgaggaactggcatgcaggacagagggcttttctggatctgatgtagctgtctgtgttaaagatgtactctttgaacctgttcgtaaaactcaagatgccatgttcttcagaaaggtttccactgaggaaggggagatgtggatgccatgtggtcccaggcaagctggtgctgtgcagacaaccatgcaagaacttgcagcagaaggcttagcggccaagattctgccaccaccaattgcaaaagcagattttgataaagttattgcaaggcaaaggccaactgttagcaaaagcgaccttgaggtgcatgagagattcacgaaggagtttggagaagacggctgacaaatttcagtcatgattgtatatgaatggtatttgtaatttcatgatttgcatattagtcacgcttaaaaatatgcgccaagcttcactattgataagacaatagtagcagattatgatttttataatctcttgcttgtatggtctgcagaatttgttgttcgatcgagttttactaatatttatgcgacacacat

SEQ ID NO: 789 - DNA, 1826 bp, Populus trichocarpa
aagatttagatcataacccactttccttaatcctcccctccttccttcccaacccctccctcctctcaaatatcccatccccggtctctcctatcaacaaaatccctaatttccagggttaaaactttttctccaaaattggaatctctcatgcaatcgccatcatcaatcctctcataaatcgaatcaaaatcaaaccctagctatgtacagcaatttcaaagaacaagcaatagagtacgtgaaacaagcggtacaagaagacaatgcagggaattactcgaaggcgtttcctttatacatgaacgcacttgaatacttcaagacccacttgaaatacgagaagaaccctaaaattcgtgaagctattactcaaaaattcaccgagtatcttcgtcgggcggaggagatcaggactgttcttgatgaaggaggtcctggccctaattctaatggggatgctgctgttgcgacgagggcaaagactaagcctaaagatggcgaggatggggatgatccggagaaagataagttgagagctggattgaattcggcgattgtgagggaaaagcctaatgtgaagtggaatgatgtggctgggcttgagagtgctaaacaggctttgcaagaagctgttattttgcctgtgaagttccctcagttttttacaggtaagagacgaccttggagggcttttcttttgtatgggccacctggaactggaaagtcatacttggccaaggctgttgcaactgaagcagagtccacttttttcagtgtttcttcatcagatctggtttcaaagtggatgggtgagagtgaaaagcttgtttcaaaccttttccaaatggcccgtgaaagtgctccttcaatcattttcgttgatgaaatagattccttgtgtggtcaacgtggagagggcaatgagagtgaagcttcgagacgtatcaagactgaacttctcgtgcagatgcagggggtaggaaccactgaccagaaggttcttgttcttgcagcaacaaatactccatatgctctagatcaggccatccgacgacgttttgacaagcgcatatatatcccgctgcctgatttgaaggctcgtcaacatatgttcaaggtgcatctaggagatactcctcacaacttgactgaaagtgattttgaaagcttggcacgaaggacagagggcttttcaggttcagatatttctgtttgtgtcaaagatgtcctctttgaaccagttcgtaaaacccaagatgctatgtttttcatacatacttctgatgatatgtgggtgccttgtggaccgaagcaacctggtgctgtccaaatttccatgcaggaccttgcagcacaagggcttgcagaaaagatccttccaccccctatcatgaaaacagattttgacaaggtcctagcaagacaaaagccaacagtgagcaaagctgatctagatgtccatgagagattcacaaaggagtttggggaggaaggttaatgaagatgatgacagagacacactggccaatgcctgtgagtgcaacctatgtgattagttattgctgctggatccaccgaaatatttaactttggggaaggtgacttgaccttccctttgtattgggatggaatgactgaaaacgcttgtttgaaattgtgtgaaaagaagagtttcagaaatattgtcccaggatcgtggacatgatgcatatattatgcttcttgccaacttatgtttgtggtgtaatattgcttactaactatgtttttttgccagttggttcgagtttcagggatatcttggagccatagggtattgtgtg

SEQ ID NO: 790 - DNA, 1870 bp, Populus trichocarpa
tcaaagggttaatacacaagaaatatcattttaattgtttttgtttttaattttttgccatttcaatgtcagtaacaatttcttaagagctttcctcgatccttcttgtttctttttttcttccacacgcgcttccttcctttcacaggcttcttctcccctctcccctttcttccctttccaatccccccttctctcaaaatcccattcccaatctctctgattaacaaaatccaacccaataaatccctaatttcttgggtttcaaaaatctgtccaaaaaatcaaattttttctcatgcaatcatcatcaatcctctcataaatcaaaacgaaatcaaaccctagctatgtacagcaatttcaaagaacaagcaatagagtacgtgaaacaagcggtacaggaagacaatgcggggaattactcaaaggcgtttcctttatacacgaacgcgcttgaatacttcaggacccacttgaaatacgagaagaaccctaaaattcgtgaagctatcactcagaaattcaacgagtatcttcgccgggccgaggagatcaagactgttcttgatgaaggaggtcccgggcctaattctaatggggatgctgcagttgcgacgaggccgaagactaagccgaaagatggtgaggatggggatgatccggagaaggataagttgagagctggattgaattcggcgattgtgagagaaaagcctaatgtgaagtggaatgatgtggctggtcttgagagtgctaagcaggctttgcaagaagctgttattttgcccgtgaagttccctcagttttttacaggtaagagacggccttggagggcttttcttttgtatgggccacctggaactggaaagtcatacttggccaaggctgttgcaactgaagcagactccacttttttcagcatttcttcctcagatctggtttcaaagtggatgggtgagagtgaaaagcttgtctcaaaccttttccaaatggcccgtgaaagtgctccttcaatcattttcgttgatgaaatagattccttgtgtggccaacgtggagagggcaatgagagtgaagcttcaagacgtataaagactgaacttcttgtgcagatgcagggtgtagggaacaacgatcagaaggttcttgttcttgcagcaacaaatactccatatgctctagatcaggccatccggagacgttttgataagcgcatatatatcccactacctgatatgaaggctcggcagcatatgttcaaggtgcatctaggggatactcctcacaacttgaatgaaagtgattttgaaagtttgggtcgaaggacagagggtttttcaggttcagatatttctgtttgtgtcaaagatgtcctctttgaaccagttcgtaaaacccaagatgctatgtttttcataaacaatcctgatgatatgtgggtgccttgtggaccgaagcaacctggtgctgtccaaatctcgatgcaggagcttgcagcaaaaggacttgcaaaaaagctccttccaccccccataatgaaaacagattttgacaaggtcctagcaagacaaaggccaacagtgagcaaagctgatctaggcgtccatgaaagattcacaaaggagtttggggaggaaggttaatgtagatgatgacatagagacacaatggcccatgctgttatttgtattttagttattgctactggatccacataattattttaactttggggaaggtgacttgaccttctctttgtattgggatggaatagcagaaattgcttgtttgaaactgtgtaaaaagaagagtttcagaaatattgccacagatttgtggacggaatataccatgctacttgccaact

SEQ ID NO: 791 - DNA, 1578 bp, Populus trichocarpa
atgtacagcaattttatggagcatggtatagagtacgcaaaacaggcagttaaagaggacgatactggaaactatagtaaagcttttcaactttatatgaatgcgttggagtactttcaagcacaattgaagtatgagaagaatcaacagattgagaaaacaattagggaaagatgtttgggatatctgaagagggcggaggagattcgagctgttcttgataatggtgggagtgtgcctgcctcaaatggtgatgcgtcggttgctgcacagccaaagagtagtccaaaaccaaaggatggaggtgggaaggacaaggaggatcctgagaaagcgaagcttaaggcagggcttgattctgttatcatcagggagaagccaaatgtgaaatggagtgatgtggcaggtcttgagaatgccaaactggcgttgcaagaggctgtcatattgcctgttaagttcccacagtttttcactgggaagagaaaaccatggagggcttttttgttatatggtccacctggaacagggaagtcatacttggcaaaggctgttgcaacagaagctgactcaactttcttcagtgtctcttcctcggacctggtttccaaatggatgggtgaaagtgagaagctagtttcaaatcttttccaaatggctcgtgatagtgcaccttccatcattttcgttgacgaaatagattcactgtgtggccaaaggggtgaaggtaatgagagtgaagcatctcggcgcatcaaaacagaacttcttgtacagatgcagggtgtagggagtgatgatcacaaagttcttgttcttgcagccacaaatactccctatgcactggatcaggctatccgacggcgttttgacaagagaatatacattcctctcccagatttgaaggcaaggcaacacatgtttaaggtgcatcttggtgatactcctcacaatttaactgaaagtgattttgagaagttggctcaaaaaacagaaggattttctggttcagatatttcagtttgtgtcaaagatgtactctttgaacctgttcgtaaaatccaggatgctgaatatttcatgaagtcctctgatggcatgtgggttccttgtgaaccaaaacaacgaggagctgtcaagaccacattacaagaacttgatgcacaagaccttgcttcaaaggtccttctgccacccattacaagagcagattttgataaagtgcttgcacggcagaagccaacagttagtaaagctgatctcgaggtgcatgagagattcacgaaggagttttgagaggagggctgatgaccttaattaagtggaagcaagtctttgattaatcgataaacacatgttatacatagtgcaaattacccatctctggtggctcatgttgggaaaaccatgtcccttgtaggcttatgaagtctagtgtttcctttctgctctcccccaattagttgggcaatattttgaaaaagaaaaaatggggctacaaggcgaaccagacagaatgacagatcaatgtatgcaatggtagatggtaaatgtatatacaatattagcattatttgc

SEQ ID NO: 792 - DNA, 1305 bp, Populus trichocarpa
atgtattgcaattttatggagcatggtatagagtacgcgaaacaggcagtcaaggaggatgatgctggaaactataggaaagctttccagctttatatgaatgcattggagtattttcaagcacaactgaagtatgagaagaatccacagattgagaaaacaattaggcaaaaatgtatggggtatctaagaagggcggaggagatccgatctgttcttgataatggtaggagtatgccagcgtcaaatggtgatgcatcggttgctgcacggcccaagactagtccaaaaccaaaggatggaggtaggaagggcaaggaggatccagagctagcgaagcttaaggaagggcttgattctgttatcatcagggagaagccaaatgtgaagtggagtgatgtggcaggtcttgagaatgccaaactggcattgcaggaagctgttatattgcctgttaagttcccacagtttttcactgggaagagaaaaccatggagggcatttttgttatatggtccacctggtacagggaagtcatacttggcaaaggctgttgcaacagaagctgactcaactttcttcagtgtttcttcctcagacctggtttccaaatggatgggtgaaagtgagaagctagtttcaaatcttttccaaatggctcgtgataatgcaccttccatcattttcattgacgaaatagattcactttgtggccaacggggtgaatgtaacgagagtgaagcatctcgtcgcatcaaaacagaacttcttgtacagatgcagggtatagggaatgatgatcagaaggttcttgttcttgcagccacaaatactccctatgcactggatcaggctatccggcggcgttttgacaagagaatatacattcctctcccagatttgaaggcaaggcaacacatgtttaaggtgcatcttggagatactcctcatgatttaactgaaagagattttgaaaagttggctcgaaaaacagaaggtttttcaggttcagatatttctgtttgtgttaaagatgtgctctttgaacctgttcgtaaaacccgggatgcggaatatttcattaaatcctctgatggcatgtgggttccttgtgaactacaacgagtagctgtcaagactacactacaagaacttgatgcacaaggacttgcttcaaaggtccttccaccacacatcacaagagcagatttcaacaaagtgcttgcacggcagaagccaacagtgagtaaagctgatcttgaggtgcatgagagattcacaaaggagtttggagaagagggctga

SEQ ID NO: 793 - DNA, 1942 bp, Solanum tuberosum
ggaaaggaggaggaattgccagtctgatttttctggaatttgtgatttggaagttgacaccaccaaattccaactccaaactaatcaaatctcaaatttttaactaaaattccttctccaaattttccaaaattttgcagattctataacgcgttcgttgaaaaagttgaatttcccggattttttttattttcattagagctttgatttttgctgatttacaggaaatcgtaagaaaagtaagacttgaggaggattgaggtatagtttgttgaacgtgggttcggtttgcttgttaaaagtttcaagctttgaattttgcatgtggtttgtgattataagatgtatagcaatttcaaggagcaggcagtagcttatgtgaagcaagcagttgaggaagataatgctggaaattatgcaaaggctttctctctatatatgaatgctttggagtattttaaaactcatctgaaatatgagaagaatcccaagattaaggaagcaattacccagaagtttgtggagtatttgaggagggctgaggagattcgttctgttctagatgagggaggtggtgggccgacgtccaatggagatgctgctgttgcgtcgcgcgcaaagtcaaagccaaagaatggaggaggaggaggagagggtgatgattcagagaatgtaaagttaagagctgggcttaattccgctattgtaagggaaaaacctaatgtgaagtggaatgatgtagcagggcttgagagtgccaagcaggcattgcaagaggctgttatcctgccggttaagtttcctcagtttttcactggcaagcgtcgaccgtggagagcctttctgttatacggtccacctggaacaggaaagtcatacctagcaaaagctgttgctacagaagcagattcaacctttttcagtgtttcttcatcagaccttgtttcaaagtggatgggtgaaagtgaaaaacttgtgtcaaatctattccaaatggcccgagaaagttctccttcaatagtatttatagacgaaattgactccctgtgtggccaaagaggtgagggtagtgaaagtgaagcatcgagacgtatcaaaactgagcttcttgtacagatgcagggtgtagggcacgatgacgacaaaaaagttctggttcttgcagcgacaaacactccctactcattagaccaggctattagacggagatttgacaaaagaatatacattcccctaccagatttgaaggcaaggcagcacatgttcaaggtacatttaggagatacccctcacaacttgacagaaagtgattttgagcaactagctcggaaaacagaaggtttttcaggttcagacatttctgtgtgtgtaaatgaagtcttgtttgaacctgtacgtaaaactcaagatgctgagtttttcattaaaactagtgatgggttgtgggtgccttgtggacctagacaaccaggtgctattcagactaatatgcaggagcttgcagcaaaaggccttgcttcaaagattacaccaccaccaatcagcataagggattttgacagagtgctatggaaacagaagccaacagtaagcaaagcagatcttgaggtgcatgagagattcacgaaggagttcggtgaggaaggatgaaggatctttggtttgctatataattatgtaactactatagccgtgaaatatttcagatttagtcatcacttcaataaaacccaacagtgtgtgataaagagtaataatcagtcttggtccttaatttaaggaccattgagctgatgtttagtgattactgtttttgctttgtacagctcgatgatagtttctcaaaaagcattttatgaaattttacatgttaagaccatcgtacactggtaaagtattatcaaaatctctgatggaatgaaagaaatgttgtttttgtgtc

SEQ ID NO: 794 - DNA, 2146 bp, Solanum tuberosum
ggttacattccatcagtttcaaactccatgataaaagaacatatgtttccttaataggcagccctacgtgtagctcacgcgccgtatgacaacatttctccttgtaaattcaactttcaaattctcaaatttcgattctttcaaatgttttccgatctccttattaccttcgatctctaatcaatttttcattgaattaaccaaaaatccccaatttctagggttcatatctactgtcaaactcacctaatccaccaaaaaaaatgctcaaaagcttcagaaagatccattacttaggacactgttcatacgattttttctaaaatcagctttttttctgaacactcttttgagttctgagcaaaacccagaaagtttattggctagttttgtggtttttcggaacacccttttgagttctgatcaaaacccataaatttgtttggttaattgtgtgatttttcggacacccttttgagttctgatcagaacccagaaattttcttgttttttttttctataggattgaagatgtatagcaattttaaggagcaagcaattgagtttgtaaggcaagcagtgcaagaggacaatggtggaaactatgccaaggcatttccgttgtatatgaatgcattggagtactttaagacccatttgaagtacgagaagaatcctaagattaaggaggcaattacccagaaatttacagagtatttacgccgtgcggaggagattagggctgtgttggatgagggtgggagtgggcctggtccaaatggaggagatgcagctgtgattgctaagcctaagactaagcctaaggatggtgaagatggggaggatcctgagcagtctaaactaagggctgggcttaattcagcaattgttagagagaaacctaatgtgaagtggaatgatgttgctggattggagagtgccaaacaggcgttgcaggaagctgtcattttgcctgtgaaattccctcagttcttcacaggcaagagacgaccatggagagcttttcttctttatggtcctcctgggacagggaagtcttacttggccaaagctgttgctactgaagcagaatccaccttttttagcgtctcgtcatcagaccttgtatccaagtggatgggtgaaagtgaaaagctagtttcaaaccttttccaaatggctcgtgaaagcgctccctccattatattcgttgatgaaattgattccttgtgtgggcagcgaggagaaggaaacgaaagtgaagcttctcgacgtattaaaacagaactccttgtgcagatgcagggtgttggtcacaatgatgataaagttcttgtacttgcagcaacaaatacaccctatgccctagatcaggctatacggcgaagatttgataagcgtatctacattccgctcccagatttgaaggcacggcaacacatgttcaaagttcatttaggtgataccccccataacttgagcgagagtgactttgaagacctggcccgtaagacagaaggtttttctggttcagatgtttctgtttgtgtcaaggatgtgctatttgaacccgtacgtaagacacaagatgctgtgttctttactcagacttctaatggtacctggataccatgcggaccaaagcaacagggtgctgtgcagacaactatgcaggagcttgatgctaaaggacttgcatcccagatcataccgccccccattacaaagacagactttgataaggttcttgctcgtcaaaggccaacagttagtaaatccgaccttgaagtgcatgacagattcacaaaggagtttggagaagaaggttgatgagattgatgtatactgctacacctggagttgccatgatttgtgttctttctcccctctacttgtctgaaaaatttgcgttattcaaaggctcttcaaatgggagattgtcattgtttaccttcttggattgtattagttttagctttgcatgtatttatcaatgtcaagacagaacattttgctagtctctttgttgtattccttttacaattctatttgcaggcagttaattcacaatttgtcagcaagtgctgctaatagtaacaaagctggtaacctctcttttcttgtggccaacttatgttagagtgta

SEQ ID NO: 795 - DNA, 1798 bp, Oryza sativa
acgcttctcccttctcctcttttccctttttttcccctctacatcttccttcccctttcctcctcctcctcgtcttctcctcctccccaccgcgtcaaaccccaccccgaagcaaccgccgccgccgccgaatccgccaccggcgaccccaatccgcgccgccggggcccgatccccactccgatccgccgtaatccggccggcccccccgcgcgcgcgcggccggcggcggcgccgccttcgcccccgatgtacagcaacttcaaggagcaggcgatcgagtacgtgaagcaggcggtgcaggaggacaatgccggcaactacgtcaaggcgttcccgctctacatgaacgcgctcgagtacttcaagacccacctcaagtacgagaagaaccctaagatcaaggaggccatcaccgccaagttcaccgagtacctccgccgcgccgaggagatccgcgcggtcctcgatgaggggggtgggggtggtggcgccaacggcggcgacgcggccgtcgccacgcggcccaagaccaagggtaaggatggggaggggggtggggatgattccgagcagtccaagctgagggctggactcaactccgccatcatcaccgagaagcccaacatcaagtggaacgatgtcgccggcctcgagagcgccaagcaagcgctgcaggaggccgtcatattgcctgtcaagttcccgcagttctttacgggtaaacggagaccatggagggcttttcttttgtatggtccaccaggaacaggaaagtcttatttggctaaagctgttgcaactgaggctgattctacatttttcagtatatcttcatcagaccttgtttcaaaatggatgggagagagtgaaaaacttgttgcaaaccttttccaaatggctcgagaaaacgctccttccattatcttcattgatgaaattgattcattgtgtggtcaacgaggagaaggaaatgagagtgaagcttctaggagaatcaaaactgaacttcttgtgcaaatgcagggtgttggccataatgatgacaaagtactggttcttgctgctacaaacacgccatatgctctagaccaggctgtgcgccggcgctttgataaacgtatttacattccactacccgacctgaaagcaaggcaacatatgtttaaggtccatctcggggatacaccacacaacttaaatgaaagtgattttgagaacttggctcgtcgaacagacgggttttctggttcggatattgctgtttgtgtaaaggatgtgttatttgaacctgtccgcaaaacacaggatgccatgttcttctttaaggctgatggtgatatgtggatgccttgtggaccaaagcaatctggtgccgtacaaacaaccatgcaggagctcgcatccaagggccttgcagcaaagatccttccaccaccaatctcaaggacagatttcgagaaagtcctcgccaggcagagaccgacagtgagcaagaaagacttggaggtgcacgaaaggtttacaaaagaatttggcgaggagggttgacaagattatgcgcactcacttatgcatagctgctccacagaaatgtatattttatgacttcgattgttctggttggaagttggattcacagatttgtacaattgatagcctaactatgattaattacaacctgtttattgcgttaggctatcattgctcctctgtcgtcaacttatttcatttttactgtcacttatacttgaaattttccacaagtgtattaattaaggaataatacttaacgtgg

SEQ ID NO: 796 - DNA, 1831 bp, Sorghum bicolor
gcagccaaaacacgcttctcccttcccatcgtttcctttcctctccctcctcgtctcgtcttcgttcccctttcctcctgcgcatcccccccgtcttctcctcaccgcgtcaaaccccagcaccaagcaaccgcccgccgcccctccgctcccatcccgaatcagccgccgcggtgcccaatccggccgatcccccctccgatccgcgggtgcccgccgcagaggcggcgcctctgggcctaccccgatgtatagcaacttcaaggagcaggcgatcgagtacgtcaagcaggcggtccaggaggacaatgccggcaattacgtcaaggcgttccctctctacatgaacgcgctcgagtacttcaagacccacctcaagtacgagaagaaccccaagatcaaggaggccatcaccgccaagttcaccgagtacctccgccgcgccgaggagatccgggcggtcctcgatgagggcggcgcggggccggggtccaacggcggcgacgcggccgtcgccacgcgccccaagaccaagggcaaggacaacggggacgggggcaacggaggggatgactccgagcagtccaagctgagggcggggctcaactccgccatcatcaccgagaagcccaacgtcaagtggaacgacgttgccggtctcgagagcgccaagcaggcgctgcaggaggcagtcatattgcccgtcaagttcccgcagttcttcacgggcaagcggaggccttggagggcgtttcttttgtatggcccccctggaacaggaaagtcttatttggcaaaagccgtcgcaaccgaggctgattcaacatttttcagtatatcttcttcagatctggtttcaaagtggatgggtgaaagtgagaaattagttgcgaatcttttccaaatggctcgtgaaaatgccccttccattatcttcattgatgaaattgattctttatgcggtcaacgtggagaaggcaatgaaagtgaagcatctaggagaatcaagactgaacttcttgtgcaaatgcagggtgttggtcataatgatgataaagttcttgttcttgctgccacgaatacgccatatgctctggaccaggctgtgcggcgaagatttgacaagcgtatctacattccgctacctgacttgaaagcaaggcagcatatgtttaaggtccatctcggggatacaccacatagcttaactgaaagtgatttcgagagcttggcccgtcgaacagatgggttttctggttctgatattgctgtttgtgttaaggacgtgttatttgaacctgtgcgcaaaacacaggatgccatgttcttcttcaaggcggacggtgacatgtggatgccatgtggaccaaagcaacccggcgctgtacagaccaccatgcaggagcttgcatccaaaggccttgctgcaaagattcttccaccacctatctcaaggacggattttgagaaggtcctgtcgaggcagaggccgacagttagcaagaaggacctggaggtgcacgagaggttcacaaaggagttcggcgaggagggctgatacatcgctcgaggacgcacacccatgcacagctgcaccacacaaatgtatattgtttatgacgactttgattgttctgcttggaagttgcattcacaggattgtacatttggtagcccaactacgactaatcatgtcagctgctttctcgtgttgggctatcgatgggcctctgttgtcaacttatttcatttttattattacacatggaaattttccacaggtgtattatggaataataattcttaacgtggagtccttgtggtgcatccc

SEQ ID NO: 797 - DNA, 1619 bp, Glycine max
gactcgcccaaaccaaacgcttttctctttccacgcgcaaacaaaacaccctttccttcttcttcttcttcttcgttctgatcagattcttcgaattctgaatcaaaattcatcgaagaagaaggagaaggagatgtatagcaatttcaaagagcaagcaatagagtacgtgaaacaagcggtagatgaagacaataagggaaactacgcgaaagcgtttcaactttacatgaacgcgttggagtatttcaaaacgcacctcaagtacgagaagaaccctaagatcaaggaggccatcactcagaaattcaccgagtatctccgccgggccgaggagatccgggccgtcctcgacgatgggcccagcggcccggcctccagcggggacgccgcggtcgccacaaggcccaagacgaagcccaaggacggaggcaaagatggagacggcgaggatcccgagcaggccaagctacgggccgggctcaactccgctatcgttagggaaaagcccaacgtgaagtggaacgacgtcgcggggcttgagagcgccaagcaggctttgcaggaagcggttatcttgcccgtgaagtttccgcagttcttcactggtaaacgacgaccttggagagcgtttttgttgtacggaccgccggggacgggtaaatcgtatttggccaaggccgttgccacagaagctgattctacgtttttcagtgtttcttcgtcagacctggtttcaaagtggatgggagaaagtgaaaagctggtctcaaatcttttccaaatggcacgcgaaagtgcaccttctatcatattcgttgatgaaatagactctctatgtggtcagcgtggagaagggaatgagagtgaagcttcaaggcgtattaaaactgagcttctggtgcagatgcagggtgttggacacaatgatcagaaagttcttgttctagcagctacaaatacaccttatgctctagaccaggcaataaggcggcgtttcgataagcgtatatacatacccctacctgatttaaaggctcgccaacacatgttcaaggtgcacctaggagatactccccataacttggctgaaagtgatttcgaacatttggctcgcaagacagaggggttttcaggttcagatatatctgtctgtgtgaaggatgttttatttgaacctgttcgcaaaacccaagatgccatgtttttctttaggaatcctgaggatatgtggatcccatgtggaccaaagcaacagagtgcagtacaaactacaatgcaggatcttgctgcgaaaggacttgcttctaagatcctgccaccacctatatcgagaacagattttgacaaagtacttgctagacaaagacccactgtaagcaagtctgaccttgatgttcacgagcgattcacaaaggaattcggagaggaaggataattctgacagaatttttcttcaaccatcttcactagtttaaacatgttatgatttgtaatttacagagctattggatcaagtgaaatgcatatttttactaatcataatttgtgtataaaaacagactgatgaaatgatcagaaaaataaattttatgtgaatatgtgattccagttactca

SEQ ID NO: 798 - DNA, 1645 bp, Glycine max
gaaggaaggttcgacggaagaatcttctctgactcgcccaaaccaaacgctttttttttctttccacgcgcagactaacaccctttccttcttcttcgttcggatcagattcttggaattctgaatcaaaattctcagaagaaggagatgtatagcaatttcaaagagcaagcaatagagtacgtgaaacaagcggtagatgaagacaataagggaaactatgcgaaagcgtttcagctttacatgaacgcgttggagtatttcaaaacgcatctcaagtacgagaagaaccctaagatcaaggaggccatcacgcagaaattcaccgagtatctccgccgggccgaggagatccgggcggtcctcgacgacgggcccagcggcccggcctccagcggggacgccgcggtcgccacacggcccaagacgaagcccaaggacggagggaaagacggagacggcgaggatcccgagcaggccaagctccgggccgggctcaactccgcgatcgttagggaaaagcccaacgtgaagtggaacgacgtcgcggggttagagagcgcgaagcaggcgctgcaggaagcggttatcttgcccgtgaagtttccgcagttcttcactggtaagcgacgaccttggagagcgttcttgttgtacggaccgccggggacggggaaatcgtatttggccaaggccgttgccacagaagctgattctacgtttttcagtgtttcttcatcagacctggtttcaaagtggatgggagaaagtgaaaagctggtctcaaatcttttccaaatggctcgcgaaagtgcaccttctataatattcgttgatgaaatagattctctatgtggtcaacgtggagaagggaatgagagtgaagcttcaaggcgtattaaaactgagcttctggtgcagatgcagggtgtgggacacaatgatcagaaagttcttgttcttgcagctacaaatacaccttatgctctagaccaggcaataaggcggcgtttcgataagcgtatatacatacccctacctgatttaaaggctcgccaacacatgttcaaggtgcacctaggagatactccccataacttggctgaaagtgattttgaacatttggctcgcaagacagaggggttttcaggttcagatatatctgtctgtgtgaaggatgttttatttgaacctgttcgcaaaacccaagatgccatgtttttctttaggaatcctgagggtatgtggatcccatgtgggccaaagcaacagggttcagtgcaaactacaatgcaggatattgctgcgaaaggacttgcttctaagatcctcccacctcctatatcgagaacagattttgacaaagtacttgctagacaaagacccaccgtaagcaagtctgaccttgatgttcatgagagattcacaaaggagttcggagaggaaggataattctgacggaatttttcttcaatcatctgcactagcttaaacatgttatgatttgtaatttacagtgctattggatcaagtgaaatgcatatttttactaatcataatttgtgtataagaacagactgatgaaataatcagaaaaataaatttgatgtgaatatgtgattctggttactcatgttggtcttca

SEQ ID NO: 799 - DNA, 1746 bp, Glycine max
ctcgaatttccgatcaattccgattccaacaactagggtttcgaaatcgatcacaccttctccctctttccccaacacacacgatcgcgatgcatctctagggtttctccctctccctggttcgaaatttcgattctcgtacatgccatcggtggtgaccggaggagcaagacgatgtatagcaatttcaaggagcaagccatagagtacgtgaagcaggccgtgcaggaagacaatgcgggaaactacgcgaaagcgttccctctctacatgaacgccttggagtacttcaagacgcatctcaagtacgagaagaaccctaagatcaaggaagccatcacgcagaaattcaccgagtacctgcgccgggccgaggagattcgggccgtgctcgacgatggcggccccggcccagcctccaacggggacgcggcggtggctgcaaggcccaagaccaagccgaaggacggggaaagcggtggcggtggtgacggcgaggaccccgagcaggccaagctccgggccgggctcaactcggccatcataagggaaaagcccaacgtgaagtggaacgacgtcgcagggttggagagcgccaaacaggccttgcaggaggctgtgattttgcctgtgaagttccctcagttctttactgggaaaagacgaccctggagagctttcttgttgtatggacctcctggaacgggaaaatcatatttagccaaggcagttgcaacagaagctgagtccacgtttttcagtgtttcttcatcagaccttgtttcaaagtggatgggtgaaagtgaaaagctggtttcaaaccttttcgaaatggctcgagaaagtgccccttctatcatatttattgacgaaattgattccctgtgtggtcagcgtggagaaggcaatgagagtgaagcttcaagacggattaaaacagagcttctggtgcagatgcagggtgtaggacacaatgatcagaaagttcttgttcttgcagcaacaaatacgccctatgctttagaccaggcaataaggcgtcgttttgataagcgcatatatattccactaccagatttgaaggctcgccaacacatgttcaaggcaaggacaatatacttgattgtgcatctaggagatactccccataacttgactgaaagcgattttgaatacttggctagcaggacagaggggttttctggttcagacatatctgtctgtgtaaaggatgtgttatttgaacctgttcgcaaaacccaagatgcaatgttcttcttgaagaatcccgagggtatgtggatcccgtgtggaccaaagcaacagggtgcagtacaaacctcaatgcaagagcttgctgcaaaaggacttgcttctaagatccttccgccccctattacgaggacagattttgagaaggtactcgctagacaaaggcctacagtaagcaaagccgaccttgatgttcacgagagattcacaaaggaatttggagaggaaggttaaatactgatggaattttcactttgaaggtccacactggtttcaaatatattgttataatttgtaatttatttagctgttggatcaaatgaaatgcatctttttcattttgttttggggatgcaaaggccccttttgtatcgaggtggatttataaaggtcgatactcattttacttctaaattgtgtataacagaatctgaaatgatttgaaaaaataacttgtgtgattctgggttctta

SEQ ID NO: 800 - DNA, 1572 bp, Selaginella moellendorffii
gcggggcgctgggccgggaagaaagggggattttcagccatgtacagcaatttcaaggagcaggcgatcgagtatgtgaagcaggcagtggtggaggacaatgcgggcaactacgccaaggccttcccgctctacatgaacgcgctcgagtacttcaagacccatctcaagtacgagaagaaccctaagatcaaggaggccatcacgcagaaattcacagagtacctgcggcgcgccgaggagatccgggccgtgatcgacgacggcgggccgggcggcggcggcgcggcgcccaatggcggcgatgccgggctcgcgaccaaggccaagtcgtccaagaaagggggcgaggatggggatggggaggatcccgagcaggccaagctccgatcgggcctcaattccgcgataatccgggagaagccggatgtcaagtggagcgatgtggctggattggagagcgccaagcaggctttgcaagaggcggtcatactgcccgttaagttcccccagttcttcacagggaagcgacgaccatggcgtgcttttctcctctatggccctccgggaactggaaagtcttatctcgccaaagccgtggccacggaggccgactccaccttttacagtatttcttcgtcagatctcgtttccaagtggatgggggagagcgagaagctcgtagccaacctcttccaaatggccagagacagtgcgccctccatcatctttatcgacgagattgattcgctgtgtggacaacgcggtgaaggcaacgagagcgaggcgtcgagacgaatcaaaacggagcttctcgtccagatgcagggcgttggaaacaacgatcaaaaagttctcgttctcgcggcaacaaacactccatattctttggatcatgctgttcgcaggcgatttgataagcgcatttacattcctctacccgacttgaaagcaaggcaacatatgttcaaggttcatctaggagacacgccgagcaacttgtcggaacgcgactttgaggaccttgcaaagagaacggaggggttctcgggctcggacatcgcagtttgtgttaaggatgtcctgtttgagccggtccggaagacgcaagacgcgatgcacttcaagagattgaaaaccaaagaaggagagttcctggtgccttgcgctccactgacaccgggtgccatccagacgacgatgcaagagcttgccaccaaggggctcgcagctcagattttgccacctccaatcagcaaggcagactttgacaaggtgctggccagacagagaccaacggtgagcaaagacgaccttgaaatacatgagaagtttacgaaggagtttggggaggaaggatgattcgtcgcccttgtgcgtggtctcttatatgaatccataagatttactctctgacgtctccttggtttgtcccgttcgttcccatgcgattagaaattgactgtattcttttgcaagtatgttcgaagtcacaaattgagcagttttgtggcattaaagagcttttatttgttgatgaaactattggtgaaagttataggacactcccac

SEQ ID NO: 801 - DNA, 2121 bp, Picea glauca
aaagagacttggccccatgttttccggagaagctatgtattgtattattccccattacttcttggtttccttatgggtgctttaaggatcgtcacgggcaatttccggggcaatttcagtattttgacgtccggggatcctaattgcctctcatttccctgaatagaattcatagttttttctgataaactgcggggatccgatttgattgaggagggcattgcaaggctcttaatcagccagaatgtatagcaatttcaaggagcaggccatagagtatgttcggcaggcagtgcaggaggacaacgcgggcaattatgccaaggcatttcccctctacatgaatgccctcgaatacttcagaacccatctcaagtatgagaaaaaccccaagatcaaagaggccatcacccagaaattcacagagtacctgaggagggcggaggagatacgagttgtgttggacgaaggggtgggttcgaggccttctgccaacggggatgccgccgtggccaccaaacccaaatcgaagccgggagccaaaggggatggagatggggatggggaggatccagagcaagccaagctccgatcagggctcaattcggccataattcgggagaagccgaacgtcaagtggactgacgtggcaggcctagagagtgccaagcaggccttgcaggaggctgtcatcctacctgtcaagttcccccagttcttcacagggaaacgaaagccctggagagcttttcttttgtatgggcctcctggtacagggaagtcatacttggcaaaggccgttgcaactgaagcagattcaacattttatagtatttcttcctcggaccttgtttcaaaatggatgggtgaaagtgagaagcttgtttccaatctatttcaaatggctcgggactgtgctccatcaatcatatttattgatgaaatagattccttatgtggacaacgtggagaaggtaatgagagtgaagcttcacgacgaataaagacagaacttttagtacaaatgcagggtgtaggaaacaatgatcagaaagttcttgtattggcagctacaaatactccttatgctctggatcaggctattaggaggcgttttgacaaacgaatctatattcctctacctgatctgaaggcaaggcagcatatgttcaaggttcacctaggtgatacacctaacaacctgacagagggtgactttgaggatctagcacggagaacagatggcttctctgggtccgatatttctgtttgcgtgaaagatgtattatttgaacctgtacgtaagactcaagatgctatgttcttcagtaaagtttctaccaaagatggggagatgtggatgccatgtggtccccgacaacctggggctgtgcaaaccactatgcaggaacttgcagttaagggtctggcttcacagattttgcccccgccgatttcaaaggcagattttgacaaagtcctggcaaggcagagaccaactgtcagcaagcacgatctagaagtccaagagcgattcacaaaggaatttggtgaagagggctgacaaattttctttgtcaaggtcttccatttgtattattttccatttttctccgaccagattagtggcttataacatctatcggttgttccagattcttataaaaattaatgggtgttcatttgaccacgggatacatcatttatatgatctggtggtatgtttatttggtgtggagtctatcttctgaatttaatgatctccttttcacggtttgctcttcttcaaatctcaaaattgttattaagtgtttgtatatgaaaatttgagctgaaactaaccaagtcagctggttcttaatttatccatctcaggggtatataaatatatatcctgtattagtagcacgcaaattaattaaaacggtgcaatggctcccttgaaagattttagactcgaaattatatagtattggtaggtatcaaattggattgtcatgattactgtagtttaatcctttattaatgtgattgtgaaaagatacaactgtatatataatggtaaacctgcgtttgcattgtgacattctatgatgcagagctgttgcattttgcaattca

SEQ ID NO: 802 - DNA, 1732 bp, Fragaria vesca
cttattgactcctcctccccttcttatctctctctcgatgcaattcctctcagacccaatccaacccgctctctagggtttctcccacttcaatttcacacctccgatcctcgattcccaatcacccaaaccctagaatttccgattatatgtgatcgcagctccggcgagatgtatagcaatttcaaggagcaagccatagagtacgtgaagcaagccgtgcacgaagacaataatgggaactacgcaaaggcgttccctttgtacatgaacgctctcgagtacttcaagacccacctcaagtacgagaagaaccctaagatcaaggaggccatcacccagaaattcaccgagtacttacgccgcgccgaggagattcgcgccgttctcgacgacggcggccccggccctgcctccaacggcgacgcagccgtcgccaccaggcccaagaccaagcccaaggacggcgaaggcggcgacggcgaggatcccgagcaggctaagctccgggccgggcttaattcggcgattattagggagaagcccaatgtcaagtggaatgatgtcgccgggcttgagagcgccaagcaggccttgcaggaggccgtgattttaccggtcaagttccctcagttctttactggcaagagacgaccatggagggcttttctattgtatggtcctcctggaactggaaagtcatacctggccaaggctgttgcaactgaagctgactcgacatttttcagtatttcctcttcagatctggtttcaaagtggatgggtgagagtgagaagctagtttcgaaccttttccaaatggctcgagatagtgccccatccatcatcttcgttgatgaaatagattccttatgtgggcagcgtggagaaggcaatgagagtgaagcttctagacgaatcaagacagaacttcttgtgcagatgcagggtgtgggaaccactgaccaaaaggttcttgttctcgcagcgacgaatactccgtatgcattagaccaggccattcgaagacgttttgacaagcgtatatacattccccttccagatgtaaaggctcgacaacatatgttcaaagtccacctgggagatactcctaacaacttgacagaaagtgattttgaaagcttagctcgcaaaactgagggattttcgggttctgatgtagctgtttgtgtcaaggatgttctctttgaaccggtacgcaaaactcaagatgccatgttcttttacaagaattctgataatatgttcataccttgtggaccaaagcaaccaggtgccgtccaaatcaccatgcaggagttggcagctcaaggactagcttcacagatccttccacctcctattacaaaaacagattttgataaggtacttgctagacagaggcctactgtgagcaaaggtgaccttgaagtccatgaaaggttcacgaaagaatttggagaggaaggttgatcaatcatctgtatcaatatcacattgatccacactagccagcagtgcaattgccgtgatttgtatgtattagtgttggatctaatggactaaatactctacattagtttcttcaatgaggaaggtgatatgacttccctttttctgtattgaaatggaaatactggtgtttgatatcgagttgcttctttcaacttgtgtaaagtacagtttaacatatattttatttttattcaagtgttgatacattaaaaaaaaa

SEQ ID NO: 803 - DNA, 1783 bp, Saccharum officinarum
tcctttcctctccctcctcgtctcgtcttcgttcccctttcctcctgcgcatcccgtcttctcctcaccgcgtcaaaccccagcaccaagcaaccgcccgccgccccctccgctcccctcccgaatcagccgccgcggtgcccaatccgtccgatcccccctccgatccgcgggtgcccgccgcagaggcggcgcctctgggcctaccccgatgtatagcaacttcaaggagcaggcgatcgagtacgtgaagcaggcggtccaggaggacaatgccggcaactacgtcaaggcgttcccgctctacatgaacgcgctcgagtacttcaagacccacctcaagtacgagaagaaccccaagatcaaggaggccatcaccgccaagttcaccgagtacctccgccgcgccgaggagatccgggcggtcctcgatgagggcggcgcggggccggggcccaacggcggcgacgcggccgtcgccacgcgccccaagaccaagggcaaggacggggacgggggcaacggaggggatgactccgagcagtccaagctgagggcggggctcaactccgccatcatcacagagaagcccaacgtcaagtggaacgacgttgccggccttgagagcgccaagcaggcgctgcaggaggccgtcatattgcccgtcaagttcccgcagttcttcacgggcaagcggaggccttggagggcgtttcttttgtatggcccccctggaacaggaaagtcttatttggcaaaagccgtcgcaaccgaggctgattcaacgtttttcagtatatcttcttcagatctggtttcaaagtggatgggtgaaagtgagaaattagttgcgaatcttttccaaatggctcgtgaaaatgccccttccattatcttcattgatgaaattgattctttatgtggtcaacgtggagaaggcaatgaaagtgaagcatctaggagaatcaagactgaacttcttgtacaaatgcagggtgttggtcataatgatgataaagttctcgttcttgctgccacaaatacgccatatgctctggaccaggctgtgcggcgaagatttgacaagcgtatctacattccgctacctgacttgaaagcaaggcagcatatgtttaaggtccatctcggggatacaccacacagcttaactgaaagtgattttgagagcttggcccgtcgaacagatgggttttctggttctgatattgctgtttgtgttaaggatgtgttatttgaacctgtgcgcaaaacacaggatgccatgttcttcttcaaggcggacggtgacatgtggatgccatgtggaccaaagcaaccgggcgctgtacagaccaccatgcaggagcttgcatccaaaggcctcgctgccaagattcttccaccacctatctcaaggacggattttgagaaggtcctgtcgaggcagaggccgacagttagcaagaargacctggaggtgcatgagaggttcacaaaggagttcggcgaggagggctgatacaccccgcacggacgcacacccatgcacagctgcaccacacaaatgtatattgkttattatgatgactttgattgttctgcttggaagttgcattcacaggattgtacatttggtagcccaamtacgactaatcatgtccactgctttctcggttgggctatcgatgggccttgtgtcmacttawttcatttttawtacmcatggaawtttycacaggtgtrttatggaataawaattcttaacgkggagtcttgtggtgcc

SEQ ID NO: 804 - DNA, 1619 bp, Helianthus annuus
  misc_feature (21)..(21): n is a, c, g, or t
cccatcgtcatcatcatcccnctttttccccaaaatcaaaaccctaaatccacccatcgatccaccaaattgacttagggtttcactccacaaccaccccaatttcatcaccatgtacagcaacttcaaagaacaagcaatcgagtacgtaaagcaagccgtacaagaagacaacgccggaaattacgctaaagctttccctctttacatgaacgccttggagtatttcaaaactcacttgaaatacgagaaaaaccctaagattcgagaggccattacgcagaaattcaccgagtatttgcgccgtgcggaggagattagggctgttctcgatgacggtggcgctggacccgcggccaacggcggcgatgcggccgtggcggccaggccgaagacgaaacctaaggatggggaaggyggrgggggagatgtgaggagattcsaaacttagggctggattgaactctgcgattgttagggagaaacctaatgtgaagtggagtgatgttgcbggacttgagagtgcgaaacaggcgttgcaggaagcggttattctgcccgttaaatttccgcagttctttactggtaaaaggcggccttggagagcttttcttttatatggtccacctgggacaggaaagtcatacttggcaaaggctgttgccactgaagcagactctacatttttcagtgtatcttcatcagatctcgtttcaaagtggatgggagaaagtgaaaagctggtgtcaaatcttttccaaatggctcgtgaaagcgcaccctccattatatttatcgatgagattgactctctaagcggtcaacgtggagaaggcaacgagagtgaagcttcaaggcgtattaaaaccgaaattcttgttcagatgcagggtgtaggacacaatgatgataaagttctagtacttgcagcaacaaatacaccctactctctggatcaggctatccgccggcgttttgataagcgtatatacattccacttccggatttgaaggcccgacaacacatgttcaaggtgcatttaggagatacaccaaataacttaactgaaagtgactttgaggccttggctcgtaagaccgaaggattttctggttctgatattgccgtttgtgttaaggatgttttatttgaacccgtacgtaaaactcaggatgccatgtttttcgttaacacaaatgatggtttgtgggtaccatgtggtccaaaacaacccggggctgtccaaaccaccatgcaggagcttgcagcaaaaggattggcggcgaagattagtccaccaccgatcatgcgagcagattttgacaaggtgcttgcgaggcagaagccgactgtgagcaaaagcgaccttgaggttcacgagcgattcacaaaagagtttggggaagaaggctaaaagaatggtgagttgcaccaaattattgtcaattgtattttgctactttgttcttttggatttttattattgtataagatatttctacaaaaaaataccatgtttttcttcggtactaatgaaggtgtaattaactttttacttttttattgtgtcttgaccatgtaataakactttwtgtgatatattgtgtcttgacmatgt

SEQ ID NO: 805 - DNA, 1556 bp, Helianthus annuus
taatccmcytttcacgatcyttacratcctctgtttgatcaatcaatygaatcgartcraaycaatymgtaatttgcacagrcaccatgtayagcaatttyaaagaacaagcaatwatctacgtaaagcaagcggtagaagaagacacagctgggaattacgcaaaagctttaactctttacatgaaygctttagaatatttcaagacccatttgaaatatgagaagaatccgaagctaaaagaggcaattacacaraagtttactgattatttgaggagggctgaggagattagggatgtgttggaaggtgggggaggggggraacctggatctaatggtggagaaacaggggttgcgacgaaaccgaaatcgggtaagaagggtgatggggatggtggggaagatgctgaggtgagtaagcttagatcggggcttgattcggcgattattagggagaaaccgaatgttaagtggaatgatgtggctgggcttcaaggtgctaagcaggcgttgcaggaagcggttattttacccgtgaagttcccgcagtttttcgttgggaagagaaggccatggagagcctttttattatacggaccacccggaaccggaaagtcctacttggctaaagctgtcgcaactgaagctgactcaacgttcttcagcatttcttcttcagatttggtttcaaaatggatgggagaaagtgaaaaattagtttcgaatttattccaaatggctcgagaaagcgcaccttctattattttcattgatgaaattgactcgttggttggtcaacgtggtgaaggcaacgagagtgaagcatctcgtcgtatcaaaaccgaacttcttgtccaaatgcagggtgtcgggaatgatgataagaaagttcttgttcttgcagctacaaacacaccatactcattagatcaggccattaggcgaagatttgacaagcggatttatattcctctaccagatcttaaggcaagacaacacatgtttaaggtacaccttggagatacgcctcacagcctaactgatcgtgattttgagcaattggcatataaaaccgaaggattctctggttcggatattgctgtttgtgtaaacgaggtcctgtttgaaccggtacgtaaaacccaagacgcaatgttcttcataaaaaaaycggatracacytgggtgccatgtggaccccgccatccgggcgctattgagatcactatgcaggatctagcaactcgtggcgaggcatcaaagatcattccgccaccgatatcaagaaccgattttgataaagtgttggcacgacagaaaccgactgtaagcaaatcagaccttgaagtacatgacagatttacaagagagtttggagaagaaggctgatgattgaataaaagtaaatactaaaaaatgtttatattttataaaagttgataaatratttatgtttttgggtgattttaaacttacattccttgcttcaagggatrttgggtgtatttcggtatatatgatttttctacaaatrcatacatcaaagttagtacc

SEQ ID NO: 806 - DNA, 1802 bp, Panicum virgatum
ctttcctcctccgcatcccgtcttctcctcaccgcgtcaaaccccagcaccaagcaaccgccccgccgccccttccctcccctcccgaatctgccgccgcggtgcctaatccggccgatcccccctccgatccgcgggtgcccgccgcaaaggcggcgcctttgggcctcccccgatgtatagcaacttcaaggagcaggcgatcgagtacgtcaagcaggcggtccaggaggacaatgccggcaactatgtcaaggcgttcccgctctacatgaacgcgctcgagtacttcaagacccacctcaagtacgagaagaaccccaagatcaaggaggcaatcaccgccaagttcaccgagtacctccgccgcgccgaggagatccgggccgtcctcgatgacggcggcgcggggcccggggccaacggcggcgacgcagccgtcgccacgcgccccaagaccaagggcaaggacggggacggcggcaacggcggggacgactccgagcagtccaagctgagggcggggctcaattccgccatcatcaccgagaagccgaacatcaagtggaacgacgtcgccggcctcgagagcgccaagcaggccctgcaggaggccgtcatattgcctgtcaagtttccgcagttcttcacgggcaagcggaagccttggagggcttttcttttgtatggcccccctggaacaggaaagtcttatttggcaaaagctgttgcaaccgaggctgattcaacatttttcagtatatcttcatcagatctggtttcaaagtggatgggtgaaagtgagaaattagttgcgaaccttttccaaatggctcgtgaaaatgccccttcaattatctttatcgatgaaattgattctttatgtggtcaacgtggagaaggcaatgaaagcgaagcttcaaggagaatcaagactgaactacttgtgcaaatgcagggtgttggccataatgatgataaagttctcgttcttgctgctacaaatacaccatatgctctggaccaggctgtgcggcgaagatttgacaagcgtatctacattccgctacctgacttgaaagcaaggcagcatatgtttaaggtccatcttggggatacaccccacagcttaacagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagcagggtgccatccagaccaccatgcaggagctcgcatccaagggccttgctgcaaagattcttccaccaccgatctccaggacagattttgaaaaggtcctgtcaaggcagaggccgacagttagcaagaaggacctggaggtgcacgagaggttcaccaaggagtttggcgaggagggctgatacaccgctcgaggacactcacccatgcacagctgcgccacagaaatgtatattgtttatgactttgattgttctgcatgcaagttggattcacaggattgtacattcggtagcccaactaaagttgatcatggctgcggctttatcatgtgttgggctatcgatgtgcgtctgttgtcatcttatttcgattttacacatacttggaatttttccacaggtgtattaatgaataataattcttaacgtggagtccttgtggtgcagtctgtatgtacagatgttttcttaatggtcggatattttccgcaagtttctt

SEQ ID NO: 807 - DNA, 2043 bp, Solanum lycopersicum
acgcagccttacgtgtatctcacgcstatggcaaaacatttctcctgtaggatactttcaaacttgtaatcctcttctcctgtaaattggatactttcaaacttgtaatcctcttctcccctgtaaattcaactttcaaattctcaaatttcgattttttcaagtattttccgatctccttaatttgatctctaatcaatctttcaattgaattagccaaaaatcccctatttctagggttcatatctatcacctaatccacaaaaaaaaaaaatgctcaaaagtttcaaaaagatccattacttaggacactgttcacacgattttttctaaaatcagcttcctttctgaacacccttttgagttctgagcaaaacccaaaaagttttttggctagttttgtggtttctcggaacaccctgttgagttctgatcaaaacccataaatttgtttggttaattgtgtggtttttcagacacccttttgagttctgatcaaaccctgaaatttgcttggttagtattgtggtttattttattttatatgatcgaagatgtatagcaatttcaaggagcaagcaattgagtacgtaaggcaagcagtgcaagaggacaatagtggaaactatgcaaaggcatttccgttgtatatgaatgcattggagtacttcaagacccatttgaagtacgagaagaatcctaagattaaggaggcaattacccagaaatttacagagtatttacgccgggcggaggagattagggctgtgttggatgagggtgggagtgggcctggtccaaatggaggagatgctgctgtaattgctaagcctaagactaagcctaaggatggtgaggatggtgaggatcctgagcagtctaagctaagggctgggcttaattcagcaattgttagagaaaaacctaatgtgaagtggaatgatgttgctggattggagagtgctaaacaggcgttgcaggaagctgtcattttgcctgtgaaattccctcagttcttcacaggaaagaggcgaccatggagagcttttcttctttatggtcctcctgggacaggaaagtcttacttggcgaaagctgttgctactgaagcggaatccactttttttagtgtctcgtcatcagaccttgtatccaagtggatgggtgaaagtgaaaagctagtttcgaacctcttccaaatggctcgagaaagcgctccatccattatatttgttgatgaaattgattccttgtgtgggcagcgaggagaaggaaatgaaagtgaagcttctcgacgtattaaaacagaactccttgtgcagatgcagggtgttggtcacaatgatgataaagttcttgtacttgcggcaacaaatacaccctattccctagatcaggctatacggcgaagatttgataagcgtatctacattccgctccctgatttgaaggcacggcaacacatgttcaaagttcatttaggtgataccccccataacttgaacgagtgtgactttgaagacctggcccgtaagacagaaggtttttctggttcagatgtttctgtttgtgtcaaggacgtgctatttgaacctgtacgtaagacacaagatgctgtgttctttactcaaacttctaatggtacctggattccatgcggaccgaagcaacggggtgctgtgcagacaactatgcaggaacttgctgctaaaggactcgcgtcccagatcatcccgccacccattacaaagactgattttgataaggttcttgctcgtcaaaggccaacagttagtaaatccgaccttgaagtgcatgacagattcacgaaggaatttggagaagaaggttgaagagattgatgtgtactrctacrcctggagttkccrtgatytgyrttytttctcccytctacttgtctgaaaaattygcattttcaaaggytcttcaaatgggagattgacattgtttmccttcttggrttgtatcagttttagctttgcatgtatttaycaatgtcaagacagwacattttgctagtwt

SEQ ID NO: 808 - DNA, 2009 bp, Solanum lycopersicum
gttatatttttttattttattgggaaaaaaagttcaaaggagaaaaaaagaaaaagggaaaggaggaggaattgccagtctgatttttctggaatttgtgatttggaagttgccaccaccaaattccaactccaaactaatcaaatctcaaatttttaactaaaattccttctccaaattttccaaaattttgcatattctgtaacgcgttcgttgaaaaagttgaatttcccggaatttttttttgattttcgttagagctttgatttttgctgatttacaggaaatcgtaagaaaagtaagacttgaggaggatcgaggtatagtttgttgaacgtgggttcagtttgcttgttaaaagtttcaagactttgaattttgcatgtggtttgtgattataagatgtatagtaatttcaaggagcaggcagtagcttatgtgaagcaagcagttgaggaagataatgctggaaattatgcaaaggctttctctctatatatgaatgctttggagtattttaaaactcatctgaaatatgagaagaatcccaagattaaggaagcaattacccagaagtttgtggagtatttgaggagggctgaagagattcgttctgttctagatgagggaggtggtgggccgacgtccaatggagatgctgctgttgcgtcgcgcgcaaagtcaaagccaaagaatggaggaggaggaggaggagagggtgatgattcagagaatgtaaagttaagagctgggcttaattccgctattgtaagggaaaaacctaatgtgaagtggaatgatgtagcagggcttgagagtgccaagcaggcattgcaagaggctgttatcctgccggttaagtttcctcagttttttactggcaagcgtcgaccatggagagcctttctgttatatggtccacctggaacaggaaagtcatacctagcaaaagctgttgctacagaagcagattcaacctttttcagtgtttcttcatcagaccttgtttcaaagtggatgggtgaaagtgaaaaacttgtgtcaaatctattccaaatggcccgagaaagttctccttcaatagtatttatagacgaaattgactccctatgtggccaaagaggtgagggtagtgaaagtgaagcatcgagacgtatcaaaactgagcttcttgtacagatgcagggtgtagggcatgatgatgacaaaaaagttctggttcttgcagcaacaaacactccctactcattagaccaggctattagacggagatttgacaaaagaatatacattcccctaccagatttgaaggcaaggcaacacatgttcaaggtacatttaggagatacccctcacaacttgacagaaagtgattttgagcaactagctcggaaaacagaaggtttttcaggttcagacatttctgtgtgtgtaaatgaagtgttgtttgaaccagtacgtaaaactcaagatgctgagttttttattaagactagtgatgggttgtgggtgccttgtggacctagacaaccaggtgccattcagactaatatgcaggagcttgcagcaaaaggcctagcttcaaagattacaccaccaccaatcagcataagggattttgacagagttctatggaaacagaagccaacagtaagcaaagcagatcttgaggtgcatgagagattcacgaaggagttcggtgaggaaggatgaaggatctttggtttgctatacaactatgtaactattatagccatgaaatatttcagatttagtcatcacttcaataaaacctatcagtgtgtgataatgggtaataatcagtcttggtccttaatttaaggaccattgagctgatgtttagtgattactgtttttgctttgtacagctcgatattagtttctacgaaagcattttatgaaattttacatgttaaaaccatcttacactggtaaagtattatcaatatctatgatggaatgaaagaaatgttgtttttgcgttaacg

SEQ ID NO: 809 - DNA, 1783 bp, Triphysaria pusilla
gaaccttcaatcggaaaatatcaaatccccaattttcctctcttcgtctccgatccaccaatccaaacaaagatatcacacacaaacgagctcgaaattaacaaatctatttatccgccctaacaaatccattatttcatttaatgatccccgaaaatgtatagcaatttcaaagaacaagcaatcgagtacgtacgacaagctgtatcggaggayaatgccggaaattacgccaaagcctttcctctgtacatgaacgccttggagtactttagaacccacctcaagtatgaaaagaaccctaaaatcaaagaagcaatcacgcagaaattccaggagtacctgcgccgggccgaggagatccgggccgtgctcgatgatggcggttcgggacctgcatctaatggggatgcggctgtggcggcccggcccaagaccaaacccaaggatggcggcggcaatgatggggaggatggcgataaggagaagcttcgggccggtttgaattctgcgatcgttagggaaaagcccaacgttaaatggaacgatgtagccggattagagagtgcgaagcaggcgctgcaggaggctgtgatactgcctgtgaagttcccacagttctttactggcaagagacgtccatggagggcttttcttttgtacggtccacccggtacaggaaaatcatatttagcaaaggctgttgctactgaagctgactcaacatttttcagtatttcttcgtcagacttggtctcaaaatggatgggggaaagtgaaaagctagtctctaatctcttccaaatggcacgagaaagttctccctccatcatatttattgacgaaatagattccctctgtggacagcgtggagaaggaaatgagagtgaagcttcaagacgcattaaaacagagctgctggtgcagatgcagggggtgggccacaatgatgataaagttcttgtacttgctgctacaaatactccttatgctctcgatcaggctattaggcggcggtttgacaagcgtatatatatccctcttccagatccgaaggcacgtcagcatatgttcaaagtgcatttaggagacactcctcataacttgactgaaagtgactttgaagtcctaggtcgtaaaaccgaaggcttttctggttcagatgtttctgtttgcgtcaaagatgtgttatttgaacctgtgcgcaagacgcaagatgcaatgttctttgttaatacttctaatggtgtgtggatgccatgtgggcccaagcaaccaggtgctatccagataaccatgcaggagctcgctgcacaaggacttgctgctcagattactccacctccaatctcaaaaacggacttcgataaggtgctcgcaagacagagaccgacagtaagcaaaactgatctggatgtgcacgagcggtttacaaaggagttcggtgaggaaggttgaagggaaacgtgagaatgcgtggacttgtcgatgcccccttgaagtgatatgtatattgtactttatcttttaccagtttcaaacatcttttttttcattaaagcatttggaagggaaggaaaatgaatcgacactttctcgaaactgcatgcactttatttgttcctgaacaaacataaattcatttcctcaagaaacattgttgttatggtgtcttgtgcggctctagttgcaatggatttataaatgtgtattaaaaatagagctcgtcgaggctygtcaatmaagaytcttagcattaccaacaaaatttgcgtttttagca

SEQ ID NO: 810 - DNA, 1908 bp, Triticum aestivum
gcctctttctcctcccccctctcctcctcatcttcccacctccttcgtcaaaccccagggccaagcaaccgccgccgccgccccgccccgcccctccccacgccgaatccgccgcccccgcgctcccccggcctgccccccgcgccgatccgccggaatccgccgcaaaggcggcgcctttccagctctcccccgatgtacagcaacttcaaggagcaggcgatcgagtacgtgaagcaggccgtccaggaggacaatgccggcaactacgtcaaggcgttcccgctctacatgaacgcgctcgagtacttcaagacccacctcaagtacgagaagaaccccaagatcaaggaggccatcaccgccaagttcaccgagtacctccgccgcgcggaggagatccgggccgtcctcgacgagggcgggggcggcccccccggcgcgcccaacggcggcgacgcggccgtcgccacccggcccaagaccaaggggaaggacggcggaggcgacggcgccggcggggatgactccgagcagtccaagctgagggccggcctcaactccgccatcatcaccgagaagcccaacatcaagtggaacgacgtcgccgggctcgagagcgccaagcaggcgctgcaggaggccgtcatattgcccgtcaagttcccccagttcttcacaggtaagcggaggccatggagggcttttcttctgtacggtccaccaggaacaggaaagtcttatttggctaaagctgttgcaactgaggctgattcgacattcttcagcatatcttcatcagaccttgtttcgaaatggatgggagagagcgagaaactagttgctaatcttttccaaatggctcgcgaaaatgccccgtcaattatcttcattgatgaaattgattccttgtgcggtacacgtggagaaggcaatgaaagtgaagcttccaggagaataaaaaccgaacttcttgtacagatgcagggtgttggccataatgatgataaagttcttgttcttgctgcgacgaatacgccatatgctctggaccaggctgtgcggcggcggtttgacaagcgtatctacattccgctacctgacgcgaaagctaggcagcatatgtttaaggtgcatcttggggatacaccgcacagcttatcggaaagtgattttgaggtcttgggtcgtcgtacagaaggattctctggttccgatgttgctgtctgtgtgaaagatgtgttgtttgagcctgtgcgcaaaacacaggatgctatgtacttcttcaagatagatggtgacatgtggatgccctgtggaccgaagcagccaggcgctgtgcagaccacgatgcaggatcttgcatccaaaggccttgcctcacagattcttccacccccgatctcgaagaatgatttcgagaaggtccttgcgagacagagaccaaccgttggcaagaaggacctggaagtgcacgagaagttcaccaaggagttcggcgaggagggttgagtggtacgccgccgcgaaaactctctcgacccatgcacagccgcaccacagaaatgtatattgtttacaactttgatttgttgcgcttgggacttagatttgcagatctgtacactctggtagcccttactgtgcttaacttatggcgacgacggcagccttgttatgccgggctatcattgtgcctctgttgtcaactctatttcatttttacactgtcatgcttggagtttaatgcaagtgtattaaggaataatgatgattattgagctgggtagtccttgtggtgcagcttgtatagttctaaaaatttctggtatctattttagactcattttcttttcttttgtttttgtagtgtttactagatcctatatttttgtttttgttccaact

SEQ ID NO: 811 - DNA, 4463 bp, Zea mays
atggtgcggcttctcgggctgcggagcctgagcttcggcccggaggactcgccgcgggagatcccctccactgccgacgtggccccgcccgttggcagcagcggctggctcgtgcgcttcttcgactccgccttcttctgcgagtggattgccgtcagctatctctacaagcacgaccatgctggagtgcgcgactacctctgcaaccgcatgtacacgctcccgctgccggggctcgaggcctacctcttccaggtctgctacatgctcgtccacaagcccagcccttccctcgaccgcttcgtcatcgacacctgcgccaagtcgctccgcatcgcgctcaaggtgcactggctcctcgctgcagagcttgagctggaggatgctgacgatctcgacgggatcgataaggtgcaggagcagtgccaggttgcagcgaccgtgcagggcgagtggccaccgcttgtccggccttcacctccatcccctgctgccagtccgcgaggtaaccccatgctcagcagaatacgatcgtccaagcagcggctactgtcccttgcatcgtcaccttcgcttggactgagccccccagcaggtggtggggtcaatgtcgctgaggatgctatgggtactggagggaagcagccagccacaccgtcatcagaggataacaagttactcaagaggctgagcattggtccaaaaatgcgcgatgcactgctcttcagacgatcaggagagaaggatgaagaacaagaccgggatggtttttttaaaaggcttcttagggacagcagagacaaggaggaggaggatggtgacagagaaggatttttcaaaagattacttagcagggagaaggataatgaggaggaagaaagtgatagagatggtttcttccgcagattactcagggatagcaaagaggaggacatggaactgacaccaagctcagatggtttgttgaagcgactttttcgtgataaggaggacaggcaaggtgaggatgatgagaaggaaggattttttcgcaggatgttcaaggataagaacgaggagaggagagatagtagtcatgcaagacatgggaatgaggaaagactgggcaagagtgtggaagatgatgacagagaaggtttcttccgcaaaattttcaaagataagaatgaggagaggaaagatgaagggcatcaaaagccagatgagagggaaaaggttggtgcgaacatagaagatgataagagagatggttttttcaggcaactctttaaggagaaaaacgatgagaaaaaggaaggcagcacaccaagcaagaaagaggaagatgataaaggccataaaaatgcagatgatgataatttctttcgcaggcttttcaaggataagaatgaagaaaagaaagggattgttcatgacaggaatgaagatgacaagtgtgaggaaggtgataaagaaaacttcttccgcaaattatttaaggataaacatgaggagaggagaactgagggacctgataaaaatgatgattatggtaagggaagtagtggtatcgaagaggaagataatccagagtttttgtcattccgtaggttgtttagagtgcacccagaagattctaagagtgggcacatagaaagcagtcaatctaacaatctttctgaggggagcccaggatcagaaagcttttttaagaggctattccgtgatagagaccgctcacttgaagattctgagatttttgggtcaaaaatggcaaaagaggcaaggatctggtctcataaacaccctggtactacaggaatcaatgagaagcaaagtggaaaaccaccattaccaattaatgcagtagcagagcttcgaaaaggttcttactatgcttcgttggaacttgttcaggctttatgtgatacatcgtatggcctggtagacatatttcctattgaggatcgtaagattgccctccgggagtctcttacagagatcaatagccagattgcttctgctgaaaaaaacggaggagtatgctttccgatgggaaagggcatatatcgagtggttcatatacctgaagacgagtctgttcttctgaattctagggagaaagctccttaccttatatgtgttgaagttttaaaagcagaagctcctagccactctaaaggatcatcagatgggcacaaattatcaaaaggtgggataccattggctaatggagatgtgcaactaccaaaaccacctccatgggcctatcctttgtggagcagacacgaaacacaaaactatgaaacagacagaatgctgaagtctacttctcaggttattgaccaagcaatggctcaactctgggagactaaagtaaaatttgtaaatgttagtttctctattgagaaacttggtcgctcaaggagcattgtactttctgaaacgggtcgtaggctgcgacatgatgctacggattctcatgatccacctggagattcgcaaacagttgctgatcagcctattgaatgggtgaaggttacgttgtctgcagttccaggagttaacatggaagatgtagatgataatgaaccaacacgaaagaaggaccatcgccgtgttcctagtacaattgccattgaggaagtaaaggctgcagcattaaaaggagaagctccacctggtcttcctctgaaaggagttgcgcagagcacccaaaatttagatcctaaggctactgatggtggggatccaaaaccaaccgatgctttggctggtgagctttgggctgtcaaacgcgaaagaattcgacggtcttcggttcatggaaaatcacctggttgggacttgcgttctattattgtcaagagtggtgatgattgccgacaggaacacttggccgtacagcttgttgcacacttctatgatatatatcaagaagctggtttaccactatggctgcggccttatgaagtaattgttacttcagcttatacagcactaattgagaccatccctgatacggcatcaatccattccgtcaaaagtaggtttcccaatatttcaagtctccgagactactatgtagccaagtatgaagagaattctccaaattttaaactcgcacagagaaactttgttgaaagtatggctggatattcaattctgtgctacctacttcaggtgaaagatcgccacaatgggaatcttctaattgatgaggaaggacatattattcatattgattttggtttcatactgtcgaactctcctggaggtgtaaacttcgagagtgcaccatttaagctaacgagggaactccttgaagtgatggattctgatgcagagggaactcccagtgagttctttgattactttaaggtgctatgcattcaaggtttccttacttgccggaagcatgcagaacgtattatacttcttgtggaaatgttgcaggattctggctttccatgtttcaaaggtggccctcgcacaatacaaaacttgaggaagaggttccacttgagtctaactgaagagcaatgtgtatccctggtgctctcactgatcagtagcagcatggatgcttggcgcactcggcaatatgattactaccagagagtattgaatggaattttatgattttccccacaggagcaacgaattcatccagaaaccaattttcttgtatccttggagcaaaccatgggattgcataggtcagttttgggctgatctatgctggcaccccatatcagatttccaggagaggactaggttattgatcactgtgttttcatgtggcattgcacatttgtggtcaactagggaaacagattggtgccgcattgtactttcatgggaccccccctctgaaagagttgagaagtgtacagtcatcggcagtcatctagttagcgctttgtgctaggaggttgtgaccagtggagctctatttggcatattggaatttggaatccgagctacattgttgtacagacctttgattgacgtagcttggagaggatgtaggagtgaacagggccatgctttgaagcgaacaagttataggcatatgggagctggggatcatccgagacagatgccgctcgaagtgtcactgtacttgttgtgtggtatccctatagcaccaaagtagatggagatgtgctttgctaaaaaaaaggtctgaaaggaaattggccgctaatttgcgcgaggcctgtccttcagagaggtgctttgctgcatttgtaaattatcattactgtacagggaccatactatcttagcattccgtttttaagttgttaagattttaattccttctttgtgggtgtcttggtcttcgaagatctaggtgatagcttgtttgactagcactatgatcagtgttcgaaagtacagttccatgtgtcatgaagaaaaacactgcaagatttttaatacatttttgatgtactatgagagcaaatttctatttc

SEQ ID NO: 812 - DNA, 4912 bp, Oryza sativa
gagaacccaagcgaaaaaaccgtacgaatctttcccattttcacacgaatttcaaaccaaagtctcctccgacgacgccgcgacatttcaaatctcaaccaaatcctcccccaattcgttcgaatctctcccccccttccccccacccgcttgcttccgtgttctacccccctttcttcccaattcgatctgcgaatatcgctgcctcgattcccaggctagggctcgcgcggcggccccggatcgagctgccccggtgagttctccccccccctcgccggcgaggctagggtttgggcggcggcggcggcggtggagcgcgtgctgttccgtttctctggatcctagggtttgctgcgctggatcgagcttgttcgttgtgatggtggtgaggggaggaggaggaggtgagtgacggtttgattggcgtgttgaggggtcgccggccatggtgcggcttctcgggctgcggagcctgagcttcgggccggaggagtcgccgcgggagatcacggtggcggggggcggcggcggcgacgcggcggcgcaccccgtggggagcagcggctggctcgtccgcttcttcgactccgccttcttctgcgagtggatcgccgtcagctacctctacaagcatgaccaccagggggtgcgcgactacctctgcaaccgcatgtacacgctgccgctgccggggctcgaggcctacctcttccaggtctgctacatgatggtgcacaagcccagcccgtcgctcgaccgcttcgtgatcgacacctgctccaagtcgctgcgcatcgccctcaaggtgcactggctgctagccgccgagctcgagctcgaggacaccgacgatttggatgggatcgacagggtgcaggagcagtgccaggctgcggcgaccgttcagggagagtggccacccctcgtccggcctgcgccgccgtcgccaattgccagcccacgcgggaaccccatgcttagcaggatacgctcatcgaagcagcgccttctgtcccttgcatcatcaccctcactcggcttgagtccccccgcaggtgcgagcaatgcagctgctgcagaggatgttgggggcagtggagtgaagcagccagcgacaccctcgtcagaggataacaagctactcaagagactaagcattggacctaaggtgcgtgatgcagcatcgttctttaggcgatccgtggagaaggatgatgagcaggacaaggaagggttctttaaaaggctgcttagagacagcaaggacaaggaggaagaggatggtgataaggaaggatttttcaagaggctgcttagtaaggagaaagagaacgaggaggaagaaggagatagagatggtttcttccgcaggttgcttagggacagcaaggacgaggacatggaattgacaccaagctcagagggtttattgaagcgactgttccgtgataaggaagataggcagggtgatgatgaagaaaaggaaggctttttccgcaggatatttaaggataagaatgaggagaggagagagagcctgcatggaaggcatggggatgaggaaagagtgggcaagagcttagaggatgatgataaagaagggttcttccgcaaaattttcaaagataaaaatgaggagaggaaagacggagggcatagtaagcaacaagatgataaggaaaagactgctgggaacatcgaagatgacaagagggatggttttttccggcaacttttcaaggagaaaaacgaagagaaaaaggaaggcaccacaccaaacaagaaagaggaggacgacaaaggacacaggaccatggatgatgaaaatttctttcgtaggcttttcaaggataagaatgaagagaaaaagggagctgctcatgacaggaatgatgatgataagtgtgaggaaggtgataaggaaaatttcttccgcaaattgtttaaagacaagcatgaggagaggagaagcgatgggctggataaacatgatgatgatggtaaggggactagtggtattgatgacgaggaaaattcagagtttttgtcgttccgcaggttgtttagagtgcaccctgaagatgctaagagtgggcatattgaaagttgtcagcctaacggtatttctgagggtagcccaggatcagagagctttttcaagcgactattccgagacagagatcgctcacttgaagactctgagctttttggttcaaagttattgaaagaggcaagacatcagctccctgaaaaaaactctgttcccactggaaacggtgataagcaaagtggcaaaccacctttaccaaacaacgcaatagcagagcttcggaaaggatgttactatgcttcattggagcttgtgcaatctttgtgtgatacatcttatggccttgtagacatatttcctatggaagatcgtaagattgcccttcgagagtctcttacagagatcaattcacagattgcttctactgagaaaaatggaggagtatgctttccgatgggaaagggcatatatcgagtggttcatatacctgaagatgaagctgttcttcttaactccagggaaaaagctccttatcttatatgtgttgaagttttgaaagcagaagcaccaagtcactccaaagggtcatcagatgttaacaaattgtcaaaaggtgggatacccttggctaatggagatgtgcagttgccaaagccacctccatgggcatatcctttgtggagtcggcatgaaacacaaaattatgaaacagacagaatgctgaagtctacctctcaggttattgaccaagctatggctcaattgtgggaggccaaagtaaaatttgtaaacgttagtttctcggttgagaaacttggtcgttcaaggagtgttgcaatttctgattcgggacataggtcacgacaatctacagcagattcaaatgagccttcaggagattcccaaccaattgctgatcagcctattgagtgggtaaaggttactttatctgcggttccaggagttaacatggatgatgttgatgacaatgaaccaacgcggaagaaggaccatcgccgcgttccaagtacaattgccatagaggaagtcaaggctgcagcattaaaaggagaagctccacctggtcttccactgaaaggagttggccagaatgctcaaaatatagaatctaaggcaactgatggtggagatcctaaaccaactgatgctttggctggtgaactctgggctgtcaagagagagagaatacgacggtcttctgttcatggaaaattacctggctgggatctgcgttctgttattgtcaagagtggagatgattgccgacaagaacacctagctgtacagcttgttgcacacttatatgatatatatcaagaagctggtttaccactttggttgcgaccctatgaagttatcgtcacatctgcatatacagcgctaattgagactattcctgatacggcgtcaattcattccatcaagagtcggttccccgatatcacaagtctccgtgactactatgtagccaagtatgaagaaaattctccgaacttcaaacttgcccagagaaactttgtggaaagcatggctggatactcaatcctgtgctacctgctccaggtcaaggatcgtcacaatggaaatctcttgatagatgaggaagggcatataattcatattgattttggctttatgctttccaactctcctggaggggttaattttgaaagtgcaccatttaaactgacaagggagcttcttgaagtgatggattctgatgcagagggaacacccagtgagttctttgactacttcaaggttctatgcattcaagggttccttacttgccggaagcatgcagagcgtattatactactagtagaaatgttgcaggattccggcttcccttgctttaaaggtggtcctcgcactattcagaacttgaggaagaggtttcacttgagtcttactgaagagcaatgcgtgtctctggtgctttcacttatcagtagcagcatggatgcatggcgtactcggcagtatgattactaccagagagtattgaatgggattttatgatatacccttcaggagcttctggctccttccaaaaatcaatttgcttatatcatcgtgaaaatctccgggatagcgcaggtcagtctggggctgactagccaggtacagccaccatgatttctacgagcgaaacacgcctttgtgttttgcatttcgcatacctggagtcccctgtgaaacacacaggctattggcgcctgcaatgcaacttgcatagcatttctcccatttgatgaggttgagaattgtatagtcgtcggcagttatctagttgaggtcatactaggaggtttgctactggtgaagcttttcagcccattttactggaattcgggacccccgagctgcattgctgtacagacaattgattgacgtagcttggacaggatctaggagaggatggagccatacaagccgcaaagtaagtgtaaattatagatgtatctgtctatgtgagttggggagtcacctgggacagcaaaaaggctgggtttgcgcgattgttgtcttggtaatcctgtgatatcccaaattagcatcaaaagtagaagatgatgtttgtacattaccattactgtacagtgcccatactataggagcttgttgccctgctgcatttggcccttccgattttgttttgtagtactcctttcatgttggtggtgtcaaaatttgctttacaggtgatagcatatgtttgggaattttctcccagctttgtcaacattacaccgcttgaaaactggaaatatttgagagtgcttccatctggtaatgtatctggacatatttctgaatctgtggagattgtaagcc

SEQ ID NO: 813 - DNA, 1323 bp, Aquilegia formosa
gttccatcgaatttcgaatccaatccaatataaaccctaaataaatatataatcgcgatctttctcctacgattaagattacgaagaagaacagtaggtagtggactgactatatgagatactcaagcatcttaggcctattatttgctgctgctatttggtgctctgcatacgcagctgttgcccttatttctgtctttcaaatcttcaaccaaatcacctcttccattctttagtctttactaattactaattactaattacattcaaataaaatataaaatgggtttcgctcagcttgttattggcccagcaggcagtggaaagtccacttattgttccagtttgcatcaacattgtgaaaccgttggaagaactatccatattgtcaatcttgatcctgcagctgagaattttgattatcctgtagcaatggatattagagaactaatatctttggatgacgtcatggaggaacttagcctaggtccaaatggcggcctcatgtactgcatggaacaccttgaggaaaatttggatgactggttgactgaagaattggataattacttggacgacgactatcttgtttttgactgcccaggccagatagaacttctatcacatgttccagtgctacgcaactttgtggaacatttaaagcgcaaaaattttaacgtttgtgttgtttacctgcttgattcacagttcattacagatgttactaagtttattagcggctgcatggcatctctttctgcaatgattcaacttgaactacctcatgtcaatattctctccaagatggaccttgtcacaaataaaaaggatatcgacgactacctaaatcctgtgtcaagtatcctactttcagagttgaatcaacgcatggcacctcagtatgaaaagttaaataaagctctaatggaactgctcgacgactttaacatggtgagctttttgccgcttgatttgaggaaagaaagcagcatccagtatgttctgtcacaaattgacttctgcattcagtatggagaagatgcagatgtaaaggtcaaggattttgatgttgatggagaagatgacgactagcattgtgctgtattaattgtgtcctgcttgaagcacaactcccttttattgtctgaaatagtttacgatttagtggtcaatgaatatgcattgccccaacttatacaagagtgtgataattttacaaatgttggactctaaaacgaagttttgcatatatgcccatgcttaaaacagatttgtggagtgatctgtatatggctgtgatgtggttgagatagccttgactgt

SEQ ID NO: 814 - DNA, 891 bp, Persea americana
accattcacaattctctcctcttcgggagtctcatctcatctaccgtttctccctgatctttctttggcaaagcaaaggtctactgttaactggtgaaactattgttgattgcaatcatcatggggtatgcacaacttgttattggtcctgcaggtagtggcaagtctacttactgctctagtttgtaccgacattgtgaaaccattcggagaacagtgcatattgtgaacctagatcctgcagcagagagctttgactatcctgtagcaatggatattagagaactcatttgcttggatgatgtcatggaggaactcggcttaggtccaaatggaggccttatttactgcatggagcaccttgaagaaaatttagatgattggttggcagatgaattagagaattatttagatgatgactatcttgtttttgattgcccaggccagatagaactcttttctcatgttccagttctgcgcaactttgtggaccatctgaagcgcaagagtttcaatgtctgtgcggtgtatatgctcgactcacagttcatgaccgatgtaaccaagtacataagtgggtgcatggcatcactttcagcaatgattcaacttgaactgccccatatcaatatcctttccaagatggaccttgtgagaaacaaaaggcatctcgaagattttttaaatccagaggcgcagctcttattgtcaaatttgaatcaacatatggctcctcaatttgccaagctaaataaagctctggcggaattggtggatgaatttagcatggtgagtttcttgcctttggacctcagaaaggagaccagtatccaatatgtgttgtcacacatagacagctgcattcaatatggggaagatgctgacgtgaag

SEQ ID NO: 815 - DNA, 804 bp, Brachypodium distachyon
agtcgacttactgctccggtttgtatcaacattgtgagacggtgggcaggaggattcatatggtcaatctggatccagctgcagagcacttcagctatcctgtagctactgatattagggagctcatatcgttggatgatgtcatggaggagcttgggatgggaccaaacggcgggctcatctattgcatggagcaccttgaagataatttggacgattggttggatgagcaattagagaactatttggatgatgactatcttgtgtttgattgcccaggccagattgaactctttacccatgttccagttcttcgtaactttgttgagcatctgaaacggaaaaatttcactgtttgcgctgtgtaccttctcgattcgcagtttgtcagtgatgtaacaaaatacattagcggctgcatggcttctctttcagccatgattcagcttgaacttcctcatatcaacatcctttcaaagatggacctggtttccaacaaaaaagatgtggaagagtatctaaatcctgaggcacaggttcttctttcacagctgaatcgacatatggcacctcggttcggcaagttaaacaaggctttagctgaactggtcgacgattacagcatggtgaatttcataccacttgacttgagaaaggagagcagcattcaatatgtgctgtcatgcatcgacaactgcatacagtatggggaagacgccgatgtgagggttagggacttcattcctgaggaagactgatcatttgatcatgcagaaaccgcgaactggttggtatcatgtagtg

SEQ ID NO: 816 - DNA, 1180 bp, Ricinus communis
taaaaaaaaactctagctgccttagcactcaatcttcttttttaaggtaaaactcttaactcaaaccttaaactataatcgtcctttatcttacttgccagtttctttttctaccggttcatcgtttaaagtgtgctttttgtaaaatcaatttttgttcttcttcttttctttttttaataaaattatagggtaatacctgaaatagtgatgtttatggcctcaagttatgccctgaatttattgttttcctttggtgtttggtgtactgcttatattaccgttgcaatcatctcctatctccgcatcttcagttctctctgtcctttctgattaattcccttaccatttaatttcatccaaaaaaaagctacaaatgggttatgctcaacttgtaattggccctgctggtagtggaaagtccacttattgctctagtttgtatcaacactgtgaaacggttggccggtcaatacacattgtgaacctagaccctgctgctgagaattttgactatcctgtatcaatggatatcagggaacttatttctttggatgatgttatggaggagcttggtcttggtccgaatggtgcccttatgtattgcatggatgaacttgaggacaatttggatgactggttgtcagaagagctggacaattacatggatgacgactacctagtttttgactgtccaggccagatagaacttttttcacatgtgtcagtacttcggaactttgtggagcatttgaagcgtaaaaatttcaatgtttgtgctgtgtacttgctcgattcacagttcatcactgatgtaaccaagtttatcagtgggtgtatggcatctctttcagcaatgattcaacttgaattgcctcatgttaacatcctctccaaaatggatcttgtaaccaacaaaaaagatattgaagactacttgaatccagagtctcgagttttgttgtcagaactgaataaacgcatggctcctcagtttgtaaagctaaataaggctttgattgaactggtggatgagtatagcatggtcagttttgtgccacttgacttgaggaaggaaagcagtatacaatatgtgttggctcaaatcgacaactgcatccaatttggagaagatgcagatgtgaagatcaaagattttgatccggaggatgatgagtag

SEQ ID NO: 817 - DNA, 1142 bp, Centaurea maculosa
cgcgggggctctgaccctgcaaacccttccaatttagggttccttttttccggcgactgtttttactgaacgacggtggttctccgccgtgataactaactatttcaggggaaaaaactgaaaggatagagttaaacttaagaggtgttgattatgggttatgctcagcttgtaatcggtcctgccggaagtggaaagtctacttattgctcaagcttgtatcaacactgtgaagctactcggcgaacaattcatattgtgaacctagatcctgctgctgaaaattttgattatcctgtggccatcgatattcgggaacttatatctttggatgatgttatggaggagcttggacttggtccaaatggtgctcttatgtactgcatggaacatcttgaagaaaatttggatgagtggttaagcgaagagttggaaaattacatggaagatgactacctagtatttgactgcccaggtcagatagaactcttttcgcatgttccggttcttaagaactttgtggagcatttgcagcgcaagaatttcaacgtttgttgtgtgtacttgcttgactcccagttcatcacggatgtgaccaaatttattagtggttgcatggcttcactctccgcaatggttcaacttgaactacctcatgttaacatcctttcaaaaatggacctcgtgactagaaaaagagacattgaagattacttgaacccggagcctcaggttctgctgtctgaactgaatgagcgcatggctcctcaatttcaaaagcttaataaggcgttaattgacttggttgatcagtatagcatggtgagctttgtgccacttgatttaaggaaagaaagcagcatacaatatgttctttcacaaatcgacaactgtattcaattcggagaagatgctgatgtgaagattcgagattttgaccaagatgaagatcaggactagaattcttgaatgtaatttatgttggtggaatccctgcaaatagccgttgcatctcgagatgtgtgtgatcgatctttctcaaatattaaaactggttttcttggcatataattgatgatgatattctgaacaaaaagtatatttttttaggaagaaatgtgtgcgtttgcctttagtttaag

SEQ ID NO: 818 - DNA, 1314 bp, Castanea mollissima
tttgttttacctcttcaagggattgtcgattgctgagggggctgtttgtataaaaggacaaaaataaccctcactgacctcgccgcctcgttcttgcgttagttagagcagagcagagcagagcagaacagccaagtcgaaacccctctcactccctcagccgcctcagcgtcagcctcccttcgcctgatgaaatcccgccgttaaattccttttataaaccgaagcgtcactttttaagttctcgcatcttttcgcttcttcaactccctgtgcccaaatttgaactaaacactcgttatcatgggctatgcacagcttgttattggccctgctggcagtggcaagtcaacttattgttctagtttataccgacattgtgaaaccatgcaacggtcgatacatattgtgaacttggatcctgctgcagagaatttcgactatcctgttgcaatggatataagggaactcattaacttggatgatgtcatggaggaacttggattgggtcccaatgggggccttatgtactgcatggaacacctcgaagataatctcgatgattggttgacggaagaattggacaattttttagatgatgactacttggtttttgactgcccaggccagatagaactcttttcacatgtgccagtgctacggaattttgtggaacatttgaagcgtaaaaattttaatgtttgtggtgtatacttgcttgattcacagttcatgacagatgtgaccaagttcatcagtggttgcatggcatcactttctgcaatgatccaacttgaattgccccatgttaatatcctctccaaaatggacctcgtgactaacaaaaaggatgttgaagattttctgaatccagagcctcagtttttgttatcagagttgaatcaacgcatggctcctcaatttgctaagctgaataaagctttgattgaactagtggatgggtttagcatggtgagttttgtgccccttgacttgaggaaggagcgcagtatacaatatgtattggctcaaatcgacaactgcattcagtatggagaagatgctgaagtgaagattaaggattttgatcctgaggatgatgactagatttatcatatccgttgaccacatgaaaaatatgttgctggtgtgtcgatatgtaggatcaactaggcatcacctaattgtgtcttgtggaaatggcatttgagatgggttgaaacaaacggttttctttttaccgggtgcaaacaagtaatgcattttgatagttaacaatgaaatcatgcattacggagctaaaatgacctaggt

SEQ ID NO: 819 - DNA, 1233 bp, Citrus sinensis
ggcctttcttaaagagcaaaagcctctccctcgtctctcacttcatcgcttctcttttcccgttctcaatttcccctctgcagctggctgaccagcctaaccggccaacgtaacgccggcccccgcctgtaccacgagctgtttgccaccagttccctctcaccattttgaattactgcagcaacttgagaagcagtaatgggctacgcacagctcgttataggccccgcgggctctggaaagtcaacttactgctctagtttgtaccgacactgtgaaactgttcggcggacaatgcatattgtgaacctggatcctgctgcagaaaattttgactatcctgtggccatggatattagggaacttatttctctcgaagacgttatggaggaacttggattgggtcccaatggtggtctaatctattgcatggaacatttagaagataatctggatgattggctggcagaggagttggataactacttggatgatgactatcttgtttttgattgcccaggccagattgaactttttacgcatgtgccagttcttcggaactttgtggaccatttgaagagtagaaattttaatgtctgcgctgtgtacttgctcgattcacagttcatcacagatgtcaccaagtttataagtgggtgcatggcatctctttctgcaatggtccagctcgaattaccccatgttaatatcctctctaaaatggaccttgtgacaaacaaaaaggaaattgaagactacttgaatccagaatcacaatttctattgtcagagttgaatcaacacatggctcctcagtttgcaaagctaaataagtctctgattgagctggtggacgagtatagcatggtcagttttatgcctcttgacttgaggaaggagagcagtataaggtatgtgttgtctcaaattgacaactgcatccagtggggagaagacgcggatttgaaaattaaggattttgatccagaagatgacgatgaatagcctcattcgcggctctaaaaaagttctaagtgtttaaacgtctatgctccctttggattaaaacaatgactcgtgtagatatcttatagaaaaatgatgggaaatttttatcaacacttggatgaacttttgactactaatatcttcactcatacatttgggtaactttaagactgaaattatgatataaaagcaatgaagcatggaaattaattgtattgagacaaa

SEQ ID NO: 820 - DNA, 1248 bp, Gossypium hirsutum
ggcacgaragtcttctcctttctttcartrtccattgtagaaaattagcattcacgatttcaggttaygtgatgttgtgtttctctatcaccactgcttatgggccattctgatttcttgattttkttgtttgctgttggtgtgtggtgtactgcatatrttactgtcgckattcttgcwtcgttccggatagtcaattccttgtgttcgttctgagttagtgaagaaggttgataagtgggaaaagctataatgggttatgcacaattggttattggtcctgcaggcagtggaaagtcaacctactgctctagcctgtaccagcattgcgaaacccttggacggtcaatacatattgtgaacctagatcctgctgcagaaaatttcgactatcctgtagccatggatatacgagaactcattagtttggatgatgtgatggaggagcttggcttgggtccaaatggtggccttatatactgcatggaacatcttgaagataatctcgatgattggctgaatgaagaattggacaattacttggatgatgactatctggtgtttgattgtccaggccaaatagaactcttttcacatgtaccagtgctccgtaactttgtagagcacttgaagcgcaagaactttaatgtgtgtgctgtatacttgcttgattcccagtttatcacagatgttactaagtacgtaagtggatgtatggcatcactttctgcaatggtccagcttgaagtaccacatattaatatcctctccwwgtmtsgwcctctgcctrayrwacaagagggatgtcraaaactacttggatccagagcctcatcatttactgtcagagttgaatgaacggatggctcctcggtttaaaaagctaaacaaatytttgattgaactggtggatgaatatagcatggtgagctttattcccctcgacttgaggaaggaaagcagcatccaatatgtattggctcaaattgacaactgcattcaatatggcgaagatgctgatgtgaagattagagatttcgatcccgacggtgatggcgacaacgagtaggcctgttaatgctgtggaaaaacattacctgtgttccgaatttccatatgtagataactttccaaaaaagaaactaagatgagaaccttttgaaaactggaatttggatgatgaacaagtactggactaatattattttggtgtaatgaatgcatcacaatccggatttcttgtgctta

SEQ ID NO: 821 - DNA, 1226 bp, Actinidia deliciosa
aagccaaacatatttgtgtgtcattcacggcggaagcagagtagccgaagccagcaccgccaaggaacgttgcgtaaacctcaacattcttgaggttttcagatattcaatattgtcaggacctctaccttgaaccagtaaagaactttaaagagctataatgggttacgcgcagctagttattgctcctgcaggcagtggcaagtctacttactgctctagtttgtatcaacactgtgaaactatgaggcgcacaattcatattgtgaacttagatcctgccgccgaaaattttgattatcccgttgccatggatatcagggaactcatttctttggacgatgttatggaagagcttggcttgggtccaaatggtggtcttatgtattgcatggagcaccttgaagaaaatctggatgaatggctaacagaggaattggataactacatggacgatgactatttggtttttgactgcccaggtcagatagaactcttttcgcatgttcctgtacttaagaactttgtggagcatttaaagcggaagaacttcaacgtttgtgttgtgtacttgctggattcacagttcatgactgatgttaccaagtttataagcggttgcatggcttcactttctgccatggttcaacttgaactaccccatgttaacattctttccaaaatggaccttgtggcaaacaaaagagacattgaagaatacttgaatccagagcctcaatttttactgtcagagctgaatcagcgcatggctcctcaatttgaaaagcttaacaaagctttgatcgacgtagtagatcagtacagcatggtaagctttgtgcctctggacttgaggaaagagagcagtattcagtatatcttatcacaaattgacgttagcattcagtacggagaagatgcagatgtgaaggtcaaggattttgatccagaggatgatgattaggggatttattgtatctttggggtgctctattggagtgaagtcctggtgaaggccgactcttgaggtttggacatcgggcgttaaatgtgtgtagatcttctggtagaattgctcggacctcctgtaactattttaaagtagtcttgacatttattggggtgtttcactgtaatcacttttgacttttgcgtgtcaaaatcatttcccctttgttttaaatcagattctgcttcccctttgttttaaatcagattctgctcaa

SEQ ID NO: 822 - DNA, 1308 bp, Leymus cinereus x Leymus triticoides
ccgttgctgtcgctccgcagcccatcccgcaacttcaggatctccccagcgtacctcagccagtctgcaggacgccgatgaccctagtcgggattttcctygcagccctcatctggtgcgccgcctacktcgtcgccgccatctcctcagtcttctagtcctctctttctcctctccccccaagccccctctgtaaaccctaccccgcccctcctccccaatccttcggtaacccaacgccgaccatgggtttcgcgcagctcgtcatcggccccgccggcagcggcaagtcgacctactgctctggtctgtatcaacattgcgagacggtgggcaggaggattcatayggtcaacctggatccagctgcagagcacttcagctatcctgtatctactgatattagagagctcatatcactggatgatgtcatggaggagcttgggatgggaccaaatggcggcctcatctattgcatggagcaccttgaagacaatttggatgattggttggatgaacaattggaaaactacttggatgatgattatcttgtgtttgattgtccaggccagattgaactcttcactcatgttccagttctgcgtaactttgttgagtatctgaaacggaaaaatttcactgtttgcgctgtgtaccttttggattcgcagtttgtcagtgatgtcacaaaatacattagcggttgcatggcttctctttctgctatgattcaacttgagcttcctcatatcaacatcctttcaaagatggacctggtttccaataaaaaagatgtagaagactatctgaaccccgaggcacaggttcttctgtcacagctgaatcggcagatggcacctcggtttcacaagttaaacaaggctttagctgaacttgttgatgattacaacatggtgaatttcataccacttgatttgaggaaggagagcagcattcagtatgtgctgtcaaacatcgacaactgcatccagtacggggaagacgccgatgtgaaggttagggacttcattcctgaggaggaggattaaccgttttgatcaagcagaagcaacaaattagtcagtatcatgtagtgtgggtccatgggaggaggaaggcagaagcgctatttatctgtttcaatcgttggtcgaaaaaacaacacagaatgcatctgcaaagagtgtgtgggtcaccttcttatgcttgtaaacaaatcatcctcatccggatctcttgaacggcatcagacatgagtggtaatactacctaaaatagtgcatgcgycaatgcaccaattctgctcca

SEQ ID NO: 823 - DNA, 1472 bp, Carica papaya
agacaaagtcgcctttgattctctcacacgttcgcttctcatcatctttcctttttcccctccaacacccaaccactaatccacttgattattaaaggtgaccttcagcaaaactcatttcatctagagctttaaggatcttcaattctctctgtccattttaaatttgtgaagcggctgcataaaaaatcatgggctatgcacagcttgttattggccctgcaggcagtggcaagtcgacatactgctcttctttgtaccagcattgtgaaactgttggtcgaacgatccatgttgttaacctggatcctgcggcagagaactttgactatcctgtggccatggatattagggaactcatttctttagatgatgttatggaggaacttggcttgggtccaaatggtggtcttatgtactgcatggaacatctcgaagacagtctggacgattggttgacagaagaattagacaattatatggatgatgactatttagtttttgactgcccaggccagatagaacttttttcacatgtgcctgtgctcaagaactttgcagagcacttgaagcgtaggaatttcaatgtttgtgctgtttacttgcttgattcacagttcatcacagatgtgacaaaatttataagtgggtgtatggcatcgctttcggcaatgatccaacttgagttgccccatgttaacatcctcacgaaaatggaccttgtgacaaacaaaagagatctcgaagactacttgaatccggactctcaaattttgttgtcacagttgaatcaacaaatggctccacagtttgccaagcttaataaatctttaattgatttggtggacgaatataacatggtgagttttgtgccactagatttgaggaaggaaagcagtataaaatatgtgctggctcaaatagacaattgcattcagtttggcgaagacgcagatgtgaaggttaaagactttgatccggaggatgatgaataaccaaaatttttataaattgtgacgtttctccatctatatggtgttgcatccccagatggatggagaatatatgtcatcatgtagatatcctactagagcaagacctagagtgaacttattgactttaaaaggctaatttcagaagggtgttactccaacgcaaaagaaaaatatgtcggagttgtgtgaagagaagtcgagtttgcaatatagacaagggtttggactggagttttttgtactaatttgctttggctgttactcaatccccatcatttgcataggcatttttaggggtttccataattccatttctttgtaaaacaagacagctaccgtttgtttatgcggaatttgcacaagcagaaaaccagtttttgtcatgttatggtgagaaggataagaacatggagatacatttctggcagccgatattgctttcagtttaagggaaaaatctaaaatgattcctctcca

SEQ ID NO: 824 - DNA, 1230 bp, Solanum tuberosum
gaaaaggtggaagacgaagaagacttcctatttctctctgcaatttctgttgcagttcttggcgtctttcagattttcagttttctcagaacctgtgtcttcagttgatctcttggccacgtgtagaaggaacataaaagggagtgatcatgggctatgcacagttggttattggccctgccggcagtggaaagtccacttactgctcgagtttgtatcaacattgtgagaccacacgacgcactatccatattgtgaacctagatcctgctgcagagaattttgactatccagtggctatggacatcagagagctcatctcgctggatgatgttatggaagaacttggtttgggaccaaatggtggccttatgtattgcatggaacatcttgaagaaaatttggacgagtggctaacagaagagttggaaaactacttggatgatgactacctagtctttgactgcccaggccagattgagcttttctcacatgttcctgtgctgaagaacttcgtggaacacctaaggcgtaaaaattttaatgtttgtgttgtatatttacttgattctcagtttattacagatgtgaccaaattcataagtggttgtatggcttcactctctgctatggttcaacttgaactaccccatgttaacatactctcaaaaatggatcttgtgacaaacaaaaaggaagttgagaattacttgaatccagagccgcatctgttactggcagaattgaatcagcgaatggctccacaatttcaaaagcttaacaaatcattgattgaagtggtggaccagtacagcatggtgagctttatccctcttgacctgagaaaagagagcagcatacagtacatcttatctcagattgacaactgcatccagtatggagaggacgctgatgtaaaggttaaagattttgacccagaggaggacgattaaaagttatttttcttgactcattctaaaatcaacaagttctattgaactgttgctttggcaggtggtgaaaatgtattaacaagtgtcttttatgagacttaccttttttgagcttctgctcattaattttcttctgcattataacatgtttcgaggtaaaaagactgctgttcgctggaaattttcccagtttcaaatcacagcttgttggacattacgttttagtaaaatttctcttctttcctttaaaaaagaaaaaacaaaaagagaagaaaaa

SEQ ID NO: 825 - DNA, 1268 bp, Pseudoroegneria spicata
gctagtctgcgatgaccctagtcgggattttcctcgcagccctcatctggtgcgccgcctacgtcgccgccgccatctcctcagtcttctagtcccccctttctccggcaacccgccccccacaaccactctctctaaaccccacccccttccctcccttatcctttggtagcccgacgccgaccatgggattcgcgcagctcgtcatcggccccgccggcagcggcaagtcgacctactgctctggtctgtatcaacattgtgagacggtgggcaggaggattcatatggtcaacctggatccagctgcagagcacttcagctatcctgtatctactgacattagagagctcatatcgctggacgatgtcatggaggagcttgggatgggaccaaatggcgggctcatctattgcatggagcaccttgaagacaatttggatgattggttggatgaacaattggaaaactacttggatgatgactatcttgtgtttgattgtccaggccagattgaactcttcactcatgttccagttttgcgtaactttgttgagtatctgaaacgaaaaaatttcactgtttgcgctgtgtaccttttggattcacagtttgtcagtgatgtcacaaaatacattagtggttgcatggcttctctttctgctatgattcaactagagcttcctcatatcaacatcctttctaagatggaccttgtttccaataaaaaggatgtagaagactatctgaaccccgaggcacaggttcttctgtcacagctgaatcgacagatggcgcctcggtttcacaagttaaacaaggctttagctgaactggttgatgattacaacatggtgaatttcataccacttgatttgaggaaggagagcagcattcagtatgtgctgtcaaacatcgacaactgcatccagtacggggaagacgccgatgtgaaggttagggacttcattcctgaggaggatgattaaccatttgatcaagcagaagcaacaaattagtccgtagcatgtagtgtgggttcatggtaggaggaattcgccgcacacggtagcgctgaacaggcagaagcgttgtttatctgtttcaatcgttggtcgagaaaacaacacagaatgcatctgcaaagagtgtgtgggtcaccttcttatgcttgtgtggttggtaactagcaattgcttgtaaacaaatcatcctcttccggagctmtkgaacggcaccagacatgagtggtaatacctaaaaaaaaa

SEQ ID NO: 826 - DNA, 1295 bp, Oryza sativa
atcacaaggccgccgcaagcaccaaaacccagatgacgctgtgctcgccgccgccatctcctccgccttctaacccgcgccgcgcgcttcctcctcctcctcctccagagcaactacctcctcccccgcctctcccctctctaaaaccctagtccttctcgcccgccatggggtacgcgcagctcgtcatcggccccgccgggagcggcaagtcgacatattgctccagtttgtatcaacattgtgagactgtgggtaggacaattcatatggtcaatctcgatcctgctgcagagcacttcagctatcctgtatctacggatattagggagctcatatcattggatgatgtcatggaggaacttgggatgggaccaaatggcgggcttatctattgcatggagcaccttgaagacaatttggatgattggttggatgagcaactggatggttatttggatgatgactatcttgtgtttgattgcccaggccagattgaactcttcactcatgtcccagttctgcgtaactttgttgaacatttgaaacgaaaaaatttcaacgtttgtgccgtgtactttcttgattcacagtttgttagtgatgtgacaaaatacatcagtggttgcatggcttctctttctgccatgattcagcttgaacttcctcatatcaacattctttcaaagatggacctggtcgccaacaaaaaggatgtggaagagtatctgaatccagaggcgcaggttctcttgtcacagctgaaccgacagatggcacccaagtttggcaagttaaacaaatcgttagctgaactggttgatgattacagcatggtgaatttcatcccacttgatttaagaaaagagagcagcattcagtatgtgctgtcgcacatcgacaactgcatccagtatggggtagacgcagatgtgaaggttagggacttcgatcccgaggactaatcatttgatcgcgtatgaactagtgaaaaatactatagcagcattatgtagtgaacagtagtgataggactacatagtattcaagtaggagtatgcagaaagcatcgcaggattacaatgctgtttccgtatgagtcctatcggttgatcaacaagatagaatatctgcaacctcctgtatatcaagccgtacgttttctgtgtaatcggttgactggttggcattaacaagctgctgcttgccaaaaaaaaaaatctgaatgatttcatacacggtacccggatgtctgttttctctgcccggggataaaacggataatatgccacttc

SEQ ID NO: 827 - DNA, 1557 bp, Oryza sativa
aaaaaaaaaagaagaaaaaatgccgctggccacgctaatcggggccctgctcgccgccgtcgtctggtgcgccgcctacctcgccgccgccatctcctccgccttctgacccgccgccgcgcgctccggggaactcctcctcctccagccaaactacctccccccgcttctcccctctctaaaaccctagttcttctcggtcgctccgccgccgccatggggtacgcgcagctcgtcatcggccccgccgggagcggcaagtcgacctattgctccagtttgtatcagcattgtgagactgtgggtaggacaattcatatggtcaatctcgatcctgctgcagagcacttcagctaccctgtttctacggatattagggagctcatatcattggatgatgtcatggaggaacttgggatgggaccaaatggcgggcttatctattgcatggagctacttaagttattaactgacccttctgaaaaccataggcaccttgaagacaatttggatgattggttggatgagcaactggagggttatttggatgatgactatcttgtgtttgattgcccaggccagattgaactcttcactcatgtcccagttctgcgtaactttgttgaacatttgaaacggaaaaatttcaacgtttgtgctgtgtaccttcttgattcacagtttgttagtgatgtgacaaaatacatcagtggttgcatggcttctctttctgccatgattcagcttgaacttcctcatatcaacattctttcaaagatggacctggtctccaacaaaaaagatgtggaagagtatctgaatccagaggcgcaggttctcttgtcacagctgaaccgacagatggcacccaattttggcaagctaaacaaatcattagctgaactggttgatgattacagcatggtgaatttcatcccacttgacttaagaaaagagagcagcattcagtatgtgctgtcgcacatcgacaactgcatccagtatggggaagacgcagatgtgaaggttagggacttcgatcccgaggaggactaatcatttgatcgcgtaggagctaaaaaaaattactatcgcagcattggtactacatagtactacctccgttctattataagtgcagcatgtttttccgcgttcaactttgaccatccgtcttatttaaaatttttttgaaaaaatttaaaaacataagtcacgagtaaagtactatttatgttttatcatctcataacaacaaaaatactaattataaaaaaattttaaataagacgaacgatcaaaattgggcgcggatacttatggttgtacttataatgggacggagagagtattcaagtatgcagaaaacatcgcaggattacaatgttgtttccgtatgagtcctatctgttgatcaacaagacagaatgctataatctgcaacctcctgtaaatcaagccgtacgttctctgtgtaatcggttgactggttggcattaacaagctgctgcttgccagaaaagaaaaacatgacttttctgaatgatttgaaacaca

SEQ ID NO: 828 - DNA, 1231 bp, Saccharum officinarum
cccaaccagacgtcgatggccctgtccgccctaatcagcaccctcctcgccgccgtcgtttggtgcgccgcttacctcgccgccgccatctcctccgccttctgatgccccgctcccccgaccccaacatctcctcctgcagcacaccccacctccagctcttttagttcctactatactcgcaacccctcccgccgactcgcctcgcgccgccatggggtacgcgcagctcgtcatcggccccgctgggagcggcaagtcaacttattgctccagtttgtacgaccattgccagaccgtgggcaggacaattcatattgtcaatcttgatccagctgctgagcactttgactatcctgtagatatggatatcagagagctgatttcattggatgatgttatggaggagattgggttggggccaaatggaggtcttatctactgcatggagcacctagaagacaacttggatgattggtttgatgaacagctagagaactacttggatgatgactatcttgtgtttgattgccctggccagattgaactcttcacgcatgttccagttctgcggaactttgttgagcacctgaaacgaaaaaatttcaatgtttgcgctgtttaccttcttgattcacagtttgtcagtgatgtaacgaaatacatcagtggttgcatggcttctctatcagctatgattcagcttgaacttcctcatatcaacatcctttcaaagatggatctggtctccaacaaaaaagaagtagaagagtacctggacccgaatgcacaggtccttctttcacagctgaatcgacagatggcacctcgatttggcaagttgaacaagtgtctagctgaactggttgatgattacagcatggttaatttcataccacttgatttgagaaaggaaagcagcatacagtatgtgctgtcatacatcgacacctgtatccagtacggggaagatgcagatgtgaaggtcagggactttgagcccatcgaggacgaagactagtaattgcctcattggatgccgaaggagctgcgaactgatggtagtaatcgtgtagtgaggagtggcctttgggaatatatgtatggcgcacgctgcatgtatgcaaaaaacgtcataggatgctgatgacatctacctggtctatgcaagttcgagactaaagcagagcactcatatctgcaagttccagtaaaaatgagtgttccttga

SEQ ID NO: 829 - DNA, 1241 bp, Saccharum officinarum
cccaaccagacgtcgatggccctgtccgccctaatcagcaccctcctcgccgccgtcgtttggtgcgccgcttacctcgccgccgccatctcctccgccttctgattccccgctcccccccgaccccaacatctcctcctgcagcacaccccacctccagctcttttagttcctactatactcgcaacccctcccgccgactcgcctcgcgccgccatggggtacgcgcagcttgtcatcggccccgctgggagcggcaagtcaacttattgctccagtttgtatgaccattgccagaccgtgggcaggacaattcatattgtcaatcttgatccagctgctgagcactttgactatcctgtagatatggatatcagagagctgatttcattggatgatgttatggaggagattgggttggggccaaatggcggtcttatctactgcatggagcacctagaagacaacttggatgattggtttgatgaacagctagagaactacttggatgatgactatcttgtgtttgattgccctggccagattgaactcttcacgcatgttccagttctgcgaaactttgttgagcacctgaaacgaaaaaatttcaatgtttgcgctgtttaccttcttgattcacagtttgtcagtgatgtaacgaaatacatcagtggttgcatggcttctttatcagctatgattcagcttgaacttcctcatatcaatatcctttcaaagatggatctggtctccaacaaaaaagaagtagaagagtacctggacccgaatgaacaggtccttctttcacagctgaatcgacagatggcacctcgatttggcaagttgaacaagtgtctagctgaactggttgatgattacagcatggttaatttcataccacttgatttgagaaaggaaagcagcatacagtatgtgctgtcatatatcgacacctgtatccagtacggggaagatgcagatgtgaaggtcagggactttgagcccatcgaggacgaagactagtaattgcctcattggatgccgaaggagctgcgaactgatggtagtaatcgtgtagtgaggagtggcctttgccctttgggaatatatgtatggcgcaggctgcatgtatgcaaaaaacgtcataggatgctgatgacatctaacctggtctatgcaagttcgagactaaagcagagcactcatatctgcaagttccagtaaaaatgagtgttccttga

SEQ ID NO: 830 - DNA, 1238 bp, Helianthus annuus
tatattttctaaactaaaatattaaaatcacgcccaaattacagaagaaaaagactcaaaatagcgacacactcgccaataataaatcactataacaaacaaagccctggttctttcttcctcctcttgctccctttcaggaggataagcagaagatttaaaggtcgaaacaaagaggcagagtagctatgggttatgctcagttagtaattggtcctgctggaagtggaaagtctacttattgctcaagtttgtaccaacactgtgaaactactcggcgaacaattcatatcgttaacctcgatcccgctgcagaaaactttgattatcctgttgccatggatatccgtgaacttatatctttggatgatgttatggaagagcttggacttggtccaaacggcggtcttttgtattgcatggaacatcttgaagaaaatctggacgagtggttaaacgaagagctggaaaatttcatggaagatgattatctagtatttgactgcccaggtcagatagaactcttttctcatgttccggttcttaaaaattttgtggagcatttgcagcgtaagaatttcaatgtttgtgctgtctacttgcttgattcycagtttattacggatgtgacgaagtttattagtggttgtatggcttcactctccgcaatggttcaacttgaattacctcatgttaacatcctctcgaaaatggacctcgtgactcgaaaaagagacatcgaagattacttgaacccagagcctcagactctgctggcagaactgaatcagcgcatgggtcctcaatttcaaaagcttaataaagccttaattgaattggtggatcagtatagcatggtgagttttgtgccacttgatttaaggaaagaaagcagcatacaatatgttctttcacaaattgacacctgcattcaattcggagaagatgctgatgtgaagattaaggattttgacgaagatgaagatgaggactagaaygcgtgtcatcttttaagttcaycacaactgattcgtgtccttttggcataattgaatgatgatgtctatacttaccagtaatatgaccgatttgtgttttttttcgttaactgttgaagcacttttctgacaacatgcaattagagttgttggatgcttcttgaaattgatcatttatgacgggtttagatgctctaatcccccgttacaagctaacgactacaattattgttgacgacc

SEQ ID NO: 831 - DNA, 1392 bp, Panicum virgatum
aaccaggccagttgagtgagcgagccgccgagagcccgagacatcgatggcactgtccaccctaatcagcgccctcttcgccgccgccgtctggtgcgccgcctacctcgccgccgccatctcctccgcgttctaacccgccgcccctcgcccagctccccgctcctattctgcaccctcgcctcctgctctcgaaaccctactccaaactcccccctccgctccgccgcactcgcgccgccatggggtacgcgcagctcgtcatcggccccgccgggagcggcaagtcaacttattgctccagtttgtacgaccattgccagaccgtgggcaggtcaattcatatagtcaatctggatcctgctgcagagcatttcaactatcccgtagatatggatatcagggagctgatttcgttggatgatgttatggaggattttggaatgggaccaaatggtggccttatctactgcatggagcatcttgaagatagtttggatgattggttggatgaacagctagagaactatttggatgatgactatcttgtgtttgattgccctggccagattgaactattcactcatgttccagttctgcgcaactttgtcgaacatctgaaacggaaaaatttcaatgtttgtgctgtgtaccttcttgattcgcagtttgtcagtgatgtaaccaaatacatcagtggttgcatggcttctctttctgctatgattcagcttgaacttcctcatgtcaacatcctttcaaagatggatctggtctccaacaaaaaagatattgaagagtatctagacccgaatgcgcaggttcttctgtcacagttgaatcgacagatggcaccccggtttggcaagttgaacaagtctttggctgaactggttgatgattacaacatggttaatttcataccacttgacttgagaaaggagagcagcatacaatatgtgctatcctacatcgactcctgcatccagtacggggaagatgctgacgtgaaggttagggacttcgatcctcccgaggacgacgactagctatttgatgcttttgaaactgcaaacgactaggtggtcgtgtcttctgtcttgtggtgaacccttggtttctgagtaggcgttcatgtggtgtctacttgatctctgtagatgaaacaatgcgaactcctgtacgttatatatacctgcttctgcttgtatggctgacaactagttgctgcttgcaagaaaatcccattctggagttgttggaacaccagaagtgaaaactacctcactgaggctgtttttgtacgcaccgtgaatattctcgccaactatcccgggttcccggaagacagacatgcatgcaatgcaacaaagtaaaacttttttttttgag

SEQ ID NO: 832 - DNA, 1217 bp, Nicotiana tabacum
gctcaaacgagcatatctgtaatttgcccagtcttgcgcttggtttskkgctcaaatttccgccgctgcttacaatttcccttgtttcttttagtgttctctcttcctggacagtttattggccttgattgtacagtataagttcttggcttctttcagattttcaattttctcagaacctcctcagttgacctctcgatttgagcaacgtgtaaaargaacagaaaaggcagtgatcatgggctacgcacagttggttattggccctgcaggcagtggaaagtccacttactgctctagtttgcatcaacattgtgagaccacgcggcgcactatccatattgtcaacttggatcctgctgccgagaactttgactatccagtggctatggacatcagagaactcatctcactggatgatgttatggaagaactaggtctcggaccaaatggtggccttatgtattgcatggaacatcttgaagaaaatttggatgagtggctgacagaagagttggacaactacttggatgatgactacctagtgtttgactgcccaggccagattgaacttttttcacatgttcctgtgctgaagaactttgtggaacacctaaggcgtaaaaattttaatgtttgtgttgtgtatttacttgattctcagtttatcacagatgtgaccaaattcataagtggttgcatggcttcactctctgctatggttcaacttgaactaccccatgttaacattctctcaaaaatggatcttgtgacaaacaaaaaggatgttgagaattacttggatccagagcctcagctgttactagcagagttgaataagcgaatggctccacaatttcagaagcttaacaaatcwytgattgaagtggtggaccagtacagcatggtgagctttctccctcttgacttgagaaaagagagcagcatacagtacatcttatctcagattgacaactgcattcagtatggagaggatgctgatgtaaaggttaaaratttcgaccctgaggaggacgattaaaytaawtcttcttgrctcgttctaaaaggagcaaggtcttactcaaatcagtaaggtcttactgatgctgatgcatgttgcaaactcaaaaactacctaaatgtatcacattagcagaataatagctgctcaaacatgaacaaagaataaagtttattcactgctaatcaagcaa

SEQ ID NO: 833 - DNA, 2369 bp, Solanum lycopersicum
cattcaagacaagcaactgatcaagagaattattggcatcacacttggagaggatgatctcaagcaattgatcaagagaatcatggcaatccatcttttgcaagcttggtttaacataactttggagtaagtccaagaaaaccattagrtcttcttcctccagaatgatragaaggtgttgacataagaaagagaaagattgctcattcaraaactcatctataatttcccatacttctttcaaattatccttgtacatcaagtcaacawacatattgataaaaaaattattatcaatggtcagaatatcaccatctcttagtgactcggcaaattccttagatgaccaaaattcaggaacatactcaagaaaattttccactgttcgttcgacatccagatcaagaaaatagtgaggcttagtggcaaccattgcaggtgattgcccatgtttccccttccactcgagctcctcccaacagatgtctctattcacaaaagcaaactgggagagtgccttagccccctttgtatggtccacataaccagtaccagcaaaattagagaaccactgcaaaatacgatttctgtttcctttgaagaaattttctaataaaaaacatttctttgcaatgataagccctgctttctgaggttccttctggaaaagcaattgtagaagttgtccaattaagggttgttttagaggcttagacctcaataaagtcatgaataactcgcgttgattgcgtggtgttatagacctcatctcagcgactgcattacaaagccaaagccgacactcagatcgcccttccaccaacatcagtgaccagatgactgattctagctcgttcagaagagcttttcccatctcaactgattcgccagttgcattttccttccaagatggttgagatagaaataactgaagcattatatctgaaacggtatcggagacggaggccaacgtttggagaaaaaatattagtgtatggttcgtttttctaaaggcatacataataataataataataaccgacccgaataggatgtgggcttgacgagggcccagaccaaataaaatcagctaaacatgtatatatttatagctttttgacgcggaacagaaaaaagggctggctaacaggaagaagggcttcctatttctctctgcaattcctgttgatctcttggccacgtgtacaaggaacagaaaaaggaagtggtcatgggctatgcacagttggttattggccctgccggcagtggaaagtccacttactgctctagtttgtatcaacattgtgagaccacacgacgtactatccatattgtgaacctagatcctgctgcagagaattttgactatccagtggctatggacatcagagagctcatctcgctggatgatgttatggaagaacttggtttgggaccgaatggtggccttatgtattgcatggaacatcttgaagaaaatttggacgagtggctaacagaagagttggaaaactacttggatgatgactacctagtctttgactgcccaggccagattgagcttttctcacatgttcctgtgctgaagaacttcgtggaacacctaaggcgtgccaattttaatgtttgtgtggtatatttacttgattctcagtttattacagatgtgaccaaattcattagtggttgtatggcttcactctctgctatggttcaacttgaactaccccatgttaacatactctcaaaaatggatcttgtgacaaacaaaaaggaagttgagaattacttgaatccagagccgcatctgttactggcagaattgaatcagcgaatggctccacaatttcaaaagcttaacaaatcattgattgaagtggtggaccagtacagcatggtgagctttatccctcttgacctgagaaaagagagcagcatacagtacatcttatcccagattgacaactgcatccagtatggagaggacgctgatgtaaaggttaaagattttgaccaagaggaggacgattagaagttatttttcttgactcattcaccgttgctttggcaggtggtgaaaatgtattaacgagtgtcttttatgagatttaccttttttgagcttctgctcattaattttcttctgcgttataacatgttgactaaaaagacggctgttcgctggaattttcccagtttcaaatcacagcttgttggacattacgtttaagtgaaatttctcttctttctttcggatgattttttattctcttagggtttgtttggttgtttgttaagagtcatataatttttttatcttgcataaaataataaaataggttctctaacagcttgtaaaaaaaaaa

SEQ ID NO: 834 - DNA, 1386 bp, Triticum aestivum
acgccgtcacgccgccactccccggctgcggtccgctctcaccttccgccgacagcccgccacccacctcgacggccgtcgcccgtcggccgtcgcgggtccccgaccgtattccctgccgccccctctccctcgccttctctccgcagctcaccccgcaacttccaatcctccggtagcccaacgccgaccatgggtttcgcgcagctcgtcatcggccccgccggcagcggcaagtcgacctactgctctggtctgtatcaacactgcgagacggtgggcaggaggattcatatggtcaacctggatccagctgcagagcacttcagctatcctgtatctactgatattagagagctcatatcactggatgatgtcatggaggagcttgggatgggaccaaatggcggcctcatctattgcatggagcaccttgaagacaatttagatgattggttggatgaacaattggaaaactacttggatgatgactatcttgtgtttgattgtccaggccagattgaactcttcactcatgttccagtcctgcgtaactttgttgagtatctgaaacggaaaaatttcactgtttgcgctgtgtaccttttggattcgcagtttgtcagtgatgtcacgaaatacattagcggttgcatggcttctctttctgctatgattcaacttgagcttcctcatatcaacatcctttcaaagatggacctggtttccaataaaaaagatgtagaagactatctgaaccctgaggcacaggttcttctgtcacagctgaatcggcagatggcacctcggtttcacaagttaaacaaggctttagctgaactggttgatgattacaacatggtgaatttcataccacttgatttgaggaaggagagcagcattcagtatgtgctgtcaaacatcgacaactgcatccagtacggggaagacgccgatgtgaaggttagggacttcattcccgaggaggacgattaaccattttgatcaagcagaagcaacaaattagtcaggtatcatgtagaataggtccatgggaggaggaattcgccgcagaagcgctatttatctgtttcaattgttagtcgaaaaaacaaggcagaatgcatctgtgaagagtgtgtgggtcaccttatgcgtgtggttgactagcaagtgcttgtgtaaacaaatcatcctcctcttccagagttcttgaatcgcatcagacatgagcggtaatacgtacctaaaatagtgtatgcgctaatgcaccaattctgctcctttctttttgaacagccgtaatgttagtatattttggaggcgctaggttctggaaagtttgtcagattgtatagctcttccttgcaaaggttgttccttgtt

SEQ ID NO: 835 - DNA, 1152 bp, Triticum aestivum
caacccccacaagccctctccctaaacctacccctacccccgtcttcaatcctttggtagcccaacgcctaccatgggtttcgcgcagctcgtcatcggccccgccggcagcggcaagtcgacctattgctctggtttgtatcaacattgcgagacagtgggcaggaggattcatatggtcaatctggatccagctgcagagcacttcagctaccctgtatctactgatattagagagctcatatcactggatgatgtcatggaggagcttgggatgggaccaaatggcggcctcatctattgcatggagcaccttgaagacaatttggatgattggttggatgaacaattagaaaactacttggatgatgactatcttgtgtttgattgcccaggccaaattgaactcttcactcatgttccagttttgcgtaactttgttgagtatctgaaacggaaaaatttcactgtttgcgctgtgtaccttttggactcacagtttgtcagtgatgtcacaaaatacattagcggttgcatggcttctctttctgctatgattcaactcgagcttcctcatatcaacatcctttctaagatggaccttgtttccaataaaaaggatgtagaagactatctgaaccctgaggcacaggttcttctgtcacagctgaatcgacagatggcgcctcggtttcacaagttaaacaaggctttagctgaactggttgatgattacaacatggtgaatttcataccacttgatttgaggaaggagagcagcattcagtatgtgctgtcaaacattgacaactgcatccagtacggggaagacgccgatgtgaaagttagggacttcattcctgaggatgatgattgaccatttgatcaatcagaagcaacaacttagtccgtagcatatagtgtgggtccacgggaggaggaattcaccgccacacggcagcgctgaacaggcagaagcgatgtttatctgctccgatcgttggtcgaaaaaacaacacagaatgcatctgcagagagtgtttggtaaccttcctatggttgtgtggttggtaactatcaattgcttgtaaacaaatcatcctcttcgggagctcttgaacggcaccagacatgagtggtaatacctaaaat

SEQ ID NO: 836 - DNA, 593 bp, Festuca arundinacea
cgagggagcaagtgagtgagtgtaatcaccaacaacatgtctgcctctgtcatggcttcgttggctctgaaaccatctccacctccactttgggagcgatcaaagatccgaggcgtgcgaccttcggcgaggccatccttgctcatagtggccagcaaggtgaagaagatccagactgcccaaccctacgggcctggtggaggagcggatttcaaggacggccttgatgcatctggaagggtggccaaggggaagggtgtttaccagtttgccaacaagtatggtgcaaatgttgatgggtacagcccaatatataccccagaagaatggtctcccggtggtgacgtttatgttggaggaaaaacagggctgtttctctgggcagtcactcttgctggaattctgctgggcggcgctctcctcgtctataatactagtgccttggcttcttgaaccctgcagcaaaccgaactatgtgtataatagtataatattacaactgtaatgacgtatgtaactggatgtaaatatgagtacccacaatgaataataccgctaaatattaatgttctaaaaaaaaaaacctcggccgc

SEQ ID NO: 837 - DNA, 615 bp, Pseudoroegneria spicata
  misc_feature (599)..(599): n is a, c, g, or t
aagagagcgagtcagtgagcgagcgtttaacatgtctgcctctgtcatggcgtctttgtttctgaaaccatctccctctccactgttagaacgagcaaagcttcgaggtgtgcgaccatcggcgaggccatcgctgctcatagtagccagcaagaaggcgaagaaggtccagactgcccaaccctacgggcctggtggtggagtggtgttcaaggaaggcgtcgatgcgtctggaagggcagccaaggggaagggtgtttaccagtttgccgacaagtatggagcaaatgttgatgggtacagcccaatatatacaccagaagaatggtctccaagtggtgacgtttatgttggaggaaagacagggctgtttctctgggcagtcactcttgctggaattctgctgggcggtgctcttcttgtgtacaatactagtgccttggcttcctgaagcctgtgcggcaaaccaaaatatgcaccaaacgatgtgtattgtacgggttatagaaccgtaacgacatatgtaactggatgtaaatatcagtaccagcagtcaataataccgacaattaattactaatgttctaaaaaaaaaaaantaaaggggaagaattc

SEQ ID NO: 838 - DNA, 998 bp, Oryza sativa
gtaacattaactgcatatatcaatatactgtttacagacaactcgctggctctgttagagataagatccccagacaactcgctatgatcagaattgacacctgaaatttctcgaccaggaaaatagttaagcagggcaggaaaccccaggattatccatcaaccaaccaactaggtgcttgcttcagattttcatcagtacatcatctctaatcatccaggtaaaagacaagatcttgtcacgtgatcatggccccatgacacagtattatcatagctactatccaactgacaattgactaacaaatcatagtcactcactgtctgctactgaaagccttcctgtatttaaagccatggatatctgatgatgaactgcataagagatcatttgcattaatttcagagatagagtgagtgatcagttgagtgttgttgcataaacatggctgcctctgtcatggcttctctggctctgaaaccatctgcatctccattactagaacgttcgaagcttcgagggaaagggacaatggcaaggccatctttgatcatagtggccaagaaagcaaagaagattcagacatcccagccctatgggcctgctggaggagtggtgttcaaggaaggtgttgatgcatctggaagggtagccaagggaaagggtctttaccagttttccaacaagtatggagcaaatgttgatgggtacagcccaatatataccccagaagaatggtcttcaactggtgatgtctatgttggaggaaaggcaggtttacttctctgggcaatcactcttgctggaattctagttggcggcgctattcttgtctacaacactagtgcactggcttagctaagtgcagcagaccaagctgtgcctgcttccatgtatataatcttcactaggaatgtaaccagttatgtacctggactggacttgactgccagcggtggtaatgaataaggccgagtaatgttaattctaagttatgc

SEQ ID NO: 839 - DNA, 561 bp, Triticum aestivum
agtgagcaagcgtttaacatgtctgcctctgtcatggcgtctttggttctgaaaccatctccctctccactgttagaacgagcgaagcttcgaggcgcgcgaccatcggcgaggccatcgctgctcatagtagccagcaagaaggcgaaaaaggtccagactgcccagccctatgggcctggtggtggagtggtgttcaaggaaggcgttgatgcgtccggaagggtagccaaggggaagggtgtttaccagtttgccgacaagtatggagcaaacgttgatgggtacagcccgatatatacaccagaagaatggtctccaagtggtgacgtttatgttggaggaaagacagggctgtttctctgggcagtgactcttgctggaattctgctgggcggtgctcttcttgtctacaatactagtgcattggcttcttgaagcctgtgcggcaaaccaaaatatgcaccaaacgatgtgtattgtacgggttacaaaagtaacgacatatgtaactggatgtaaatatcagtacccgcagtcaataataccgataattaatta

SEQ ID NO: 840 - DNA, 740 bp, Triticum aestivum
aaagagggtgatccagtgagcacaaacatgtctgcctctgtcatggcgtctatggttctgacgaagccatctccctctccactgttagaacgagcgaaactccgaggtttgcgaccatcggcgaggccatcgctgctcatagtagccagcaagaaggcgaagaaggtccagactgcccaaccctacgggcctggtggtggagtggagttcaaggaaggcgtcgatgcgtctggaagggtagccaaggggaagggtgtctaccagtttgccgacaagtatggagcaaatgttgatgggtacagcccaatatatacaccagaagaatggtccccaagtggtgacgtttatgttggaggaaagacagggctgtttctctgggcaatcactcttgctggaattctgctgggcggtgctctgcttgtctacaatactagtgccttggcttcttgaagcctgtgcggcaaaccaaaatatgaatcaaacgatgtgtactgtacgggttacaaccgcaacgacatatgtaactggatgtaaatatcagtacccgcaggccgcagtcaataataccgacaattaattactaatgttaagcagcatggtgcaagcgtgattaagttttcagtgcaagcgcatgagctctctcgcaaatgttaccaagttctacaatggcacttgaatgttcacagaatttaattctgtaataagtaaagatgaagataaagaaggcctggtaaaaaaaa

SEQ ID NO: 841 - DNA, 676 bp, Triticum aestivum
tagcgtggtcgcggccgagtgagcctagtgagtgagcacaaacatgtctgcctctgtcatggcgtctttggttctgctgaaaccatctccctctccactgttaggacgagcgaagctccggggtgtgcgaccatcggcgaggccatcgctgctcatagtagccagcaagaaggcgaagaaggtccagactgcccaaccctacgggcctggtggtggagtggtgttcaaggaaggcgtcgatgcgtccggaagggcggccaaggggaagggtgtttaccagtttgccgacaagtatggagcaaacgttgatgggtacagcccgatatatacaccagaagaatggtctccaagtggtgacgtttatgttggaggaaagacagggctgtttctctgggcagtcactctttctggaattctgttgggtggtgctcttcttgtctacaatactagtgccttggcttcttgaagcctgtgcggcataccaaaatatgcaccagcgatgtgtattgtacgggttacaaccgtaacgacatatgtaactgaatgtaaataccagtacccgcagtcaataataccgacaattaattactaatgttctcctgtaagcagcatggtgcaagcatgattaagttttcagtgcaagcgcatgagctctctcgcaaatgtcatcaagttc

SEQ ID NO: 842 - DNA, 534 bp, Triticum aestivum
aacatgtctgcctctgtcatggcgtctttggttctgaaaccatctccctctccactgttagaacgagcgaagcttcgaggcgcgcgaccatcggcgaggccatcgctgctcatagtagccagcaagaaggcgaaaaaggtccagactgcccagccctatgggcctggtggtggagtggtgttcaaggaaggcgttgatgcgtccggaagggtagccaaggggaagggtgtttaccaagtttgccgacaagtatggagcaaacgttgatgggtacagcccgatatatacaccaagaagaatggtctccaagtggtgacgtttatgttggaggaaagacaaggctgtttctctgggcaatgactcctgctgggaatctgctgggcggtgctcctcctgtctacaatactatgcatgggtcttgaacctgtgcggaaacaaaattcacaaacatttatgtcgggtacaaaaagtaacgacatatgtaactggatgtaaatatcaataccgcagtcaataataccgataattaattac

SEQ ID NO: 843 - DNA, 535 bp, Triticum aestivum
agtgagcaagcgtttaacatgtctgcctctgtcatggcgtctttggttctgaaaccatctccctctccactgttagaacgagcgaagcttcgaggcgcgcgaccatcggcgaggccatcgctgctcatagtagccagcaagaaggcgaaaaaggtccagactgcccagccctatgggcctggtggtggagtgggtgttcaaggaaggcgttgatgcgtccggaagggtagccaaggggaagggtgtttaccaatttgccgacaagtatggagcaaacgttgatgggtacagcccgatatatacaccaagaagaatggtctccaattggtgacgtttattttggaggaaagacaaggctgtttctctgggcagtgactcttgctggaattctgctgggcggtgctcttcttgtctacaatactaatgcattggtttcttgaaacctgtgccgcaaacaaaatatcaccaaacatgttattgtacgggtacaaaataacacatattactgatgtaatacagtacccatcatataccg

SEQ ID NO: 844 - DNA, 1327 bp, Zea mays
gcactgcatcagagcacgaccacactacccacccacctccactactgacgaccgattcccagaaagctcgatctagcgcgcgcggctgcagagtgcagacgacgacgtacaccatggcgcggcggtccctggccctgctgctcgcgtcgtcgctcgccctgatggcggccgccgtcgcatcggcggactcgtggctctacgacaagttcaacacggacggcaccgtccgcacccagtacgacgcgtcggggcaggaggtggcgatgctcagcctggaccgcagctccggcgccggcttcaactccaaggagcagtacctgtacggcgagttcagcgtccagatgaagctcatccccggcaactccgccggcaccgtctcgtgcttctacctctcgtcgggcgacggcgacgggcacgacgagatcgacatggagttcatgggcaacgcgagcgggcagccggtggtgctgaacacgaacgtgtgggccagcggcgacggcaagaaggagcaccagttcgacctctggttcgacccctccgccgactaccacacctacaccatcatctggaacccgaccaacatcctgttcaaggtggacggcgacgtgatccggtgcttcaagcgctacgccgacctgccgtacccgagcgcgaggcccatggcgctgcacgccacgctgtgggacggcagctactgggccaccgagaagggcaaggtgccggtggactggtccgccgcgcccttcgtcgtctcctaccggggctactccgccaacgcctgcgtcagcggcggggcctgcggcggcggcggcgacgacgggtggatgagcaagcagcccgacgacgccgagtggggcaccgtccggtgggccgagagcaactacatgcgctacaactactgcgacgacggctggcggttcccccagggcctcccgcccgagtgcagccgcagctaagctagctgattccgccggttttcgtacgctcggcggcgtccgctgacgacacacgccttgttggtttgttcttgctggacatcatacatctctatatgcatgattcttgttctgttattgttaaatcgtgattacaatacttgtaattgtaaagaagtgtgtgggcacgggagtatatcactgtagttttaatttgcttgtaaagaaaagaagggtttttttacttgtgacgcgggagctagcgactgcgtcctgttcgcgtaaaatgtttgcaatggatgatgatgcatgtacgcagcaacacctagcagtgtactacttccacatattattgcgttcaatcaatccagatacacatttaaagttcgatc

SEQ ID NO: 845 - DNA, 1154 bp, Sorghum bicolor
acaaaccaaagtcccctccactttccaagcctccacaaaccaaagagctcttctatagagcagcagccacaccatggcaccgcgttctctgggagtgctcgccgtcgccctcgcgctcttgcaggccgcctcggcgaagtcctggcttggcgccaagttcaccacggacggcaccgtccgcgagggatacgacagttccggccagcaggtggtgatgctcagcctcgaccagcactccggcgccgccggcttcaactccaaggagcagtacctctacggcgagttcagcatcgagatgaagctcatccgcgggaactccgccggcaccgtctcatgcttctacctttcttccggcgacggcgacgggcacgacgagatcgacatggagttcatgggcaacgccaccggtcagccggtggtgctcaacaccaacgtgtgggccaacggcgacggcaagaaggagcaccagttcgacctgtggttcgacccggccgccgactaccacacctacaccatcatctggaaccctacgaacatcctgttcaaggtggacaacctcttcatccggtccttcaagcgctacgccgacctggcctacccgagctccaagcccatgacgctgcacgccacgctgtgggacggcagctactgggcgacggagaagggcaagatgcccatcgactggtccggcgcgcccttcgtcgtctcctaccgcagctacgccgccaacgcctgcgtcagcggcggcgcgtgccgtaccggcagggacgggtggatgcacaggcagctcgacaacgccgagtggggcaccgtcaggtgggcggagaagaacttcatgcgctacaactactgccaggatgggtggaggttcccgcaaggactccccgccgagtgcagccgccactgatgctgatgaactgatacgttctcccccggttcatccagctatactgcgcattgttcattgtttattgcattggtttcgttttcttgggtatatgattcttattctactttgtgaatttgtgattaaaaagcagccctgcagaaacgtgtgggcggttgtacacacctagtttttccctgaacagcagagcatgtaatttttatcgtgcttttggatatatatacaggcatgcagcatgtattgtgag

SEQ ID NO: 846 - DNA, 1055 bp, Saccharum officinarum
actccactgaacaacaagcccattgccaggaagctgtagctgtctatcgcagctgcagacagccagacaccatggagcggcggtctctggctctgttcgcgtcgttcgccctcatgatggcggccgtcgcgtcggcggaatcgtggctctacgagaaattcaacacggacggcaccgtccgcgccaactacgacgcgtccggccagcaggtggcgatgctcaacctcgaccgcagctccggcgccggcttcaactccaaggagcagtacctcttcggcgagttcaccatccagatgaagctcatccccggcaactccgccggcaccgtctcctgcttctacctttcttctggcgacggcgacgggcacgacgagatcgacatggagttcatgggcaactcgagcggccagccggtggtgctcaacaccaacgtgtgggccaacggcgacggcaagaaggagcaccagttcgacctgtggttcgacccggccgccgactaccacacctacaccatcacctggaacccgaccaacatcatcttcaaggtggacggcaacgtgatccgctgcttcaagcgctacgccgacctcccctacccgagctccaagcccatgacgctgcacgccacgctgtgggacggcagctactgggccaccgagaagggcaaggtgcccatcgactggtccggcgcgcccttcgtcgtctcctaccggggatactccgccgacgcctgcgtcagcggtggcgcctgcgccgccggcagcgacgcgtggatgaacaagcagcctgatagcgccgagtggggcaccgtcaagtgggctgagagcaactacatgcgctacaactactgcgacgatggctggaggttcccgcaggggctgccggcagagtgcagccgcagctgattcgttcgccgacgtctcccatcctttcatttcaggcgtccattgccaagttcttgatttatttttgctggatatatatctacgattcttgttctgttgttgkgactttttgtgattaaaaagcarccacgcagcaacgcgagggcggga

SEQ ID NO: 847 - DNA, 1227 bp, Panicum virgatum
ccaccgcaccctaccgatcgatcactagcaagctcctttccaagaagaagctctagatagtagatcgagcggcagatagcaaccatggcggcgcggctgcctccgctggctctgctcgcggcgtccctcgccgtcatggcggccgtcgcgtcggccgactcctggctctacgagaagttcaacacggacggcaccgtccgcgcggactacgacgcgtcgggccagcaggtcgccatgctcaacctcgaccggagctccggcgccgggttcaactccaaggagcagtacctctacggcgagttcagcatccagatgaagctcatccccggcaactccgccggcaccgtctcgtgcttctacctctcttccggtgacagcgacgaccacgacgagatcgacatggagttcatgggcaactcgagcgggcagccggtggtgctcaacaccaacgtgtgggccagcggcgacggcaagaaggagcaccagttcgacctgtggttcgacccggccgccgactaccacacctacaccattgtctggaaccccaccaacatcctcttcaaggtcgacggcaccgtcatccgctgcttcaagcgctacgacgacctgccctacccgagctccaggcccatggcgctgcacgccacgctgtgggacggcagctactgggccaccgagaagggcaaggtctccatcgactgggcgggggcccccttcgtcgtctcctaccgcggctactccgccgacgcctgcgtcagcggcggcgcgtgccccgccggcagcgaccggtggatgaacaagcagcccgacgccgccgagtggggcaccgtcaagtgggcggagagcaactacatgcgctacaactactgcgaggacgggtggaggttcccacaggggctccccgccgagtgcagccgcagctgatcgagctgatgatgattcgtccgccgtcggatctatccattgttaataagctcttgatttgtttcttttaattttgttggatgtccgtatgattcttgatctgtggctgtgaatttgtgattaaaaggaagccccgcatggagcgagagaatactagttttcttgtgaaagaaaaagctttattcctattactttggataaaggggatacttctctcatttgtgaggttctttcttatcttcggtgagtgggcagaatcgtataatggagaagttgaaaaatgagaactcaatgtattccctt

SEQ ID NO: 848 - DNA, 1185 bp, Panicum virgatum
ccaccgcactccactgatctctggtcgatcactaacaagctccttccctagaagaagctccagctagtagatcgagcggcagctagcaaccatggcggcgcggcgggctccgctggctctgctcgcggcgtccgtggccctcctggccgccgccgcgtcggcggactcctggctctacgagaagttcaacacggacggcaccgtccgcgccgactacgacgcgtcgggccagcaggtcgccatgctcaacctcgaccggagctccggcgccgggctcaactccaaggagcagtacctctacggcgagttcagcatccagatgaagctcatccccggcaactccgccggcaccgtctcgtgcttctatcttacctcgggtgacagcgacgaccacgacgagatcgacatggagttcatgggcaactcgagcgggcagccggtggtgctcaacaccaacgtgtgggccagcggcgacggcaagaaggagcaccagttcgacctgtggttcgacccggccgccgactaccacacctacaccatcgtctggaaccccaccaacatcctcttcaaggtcgacggcaacgtcatccgctgcttcaagcgctacgccgacctgccctacccgagctcgaggcccatggcgctgcacgccacgctgtgggacggcagctactgggccaccgagaagggcaaggtccccatcgactgggcggggggccccttcgtcgtctcctaccgcggctactccgccgacgcctgcgtcagcggcggcgcgtgccccgccggcagcgaccggtggatgaacaagcagcccgacgccgccgagtgggggacggtcaagtgggcggagagcaactacatgcgctacaactactgcgaggacgggtggaggttcccgcaggggctccccgccgagtgcagccgcagctgatcgagctgatggtgattcgtccgccgtctgatgcattcatcaggcgtgcattattgttaataagctcttgatttatttcttttaattttgttggacgatgtccgtatgattcttgatctgtgattgtgaatttgtgattattaaaaggcagccccgcatggagccatgcaagggcgagaaaatactagttttcttgtaaaagaaaagctttattcctactactttggataaagggtatacttctgtcacttgtg

SEQ ID NO: 849 - DNA, 1086 bp, Panicum virgatum
aataagctcatttccaagaagctttagagcagccacaatggcagggcggcgttccctggctctgctcgccgtctccctcgcgctcttgcaggtcgcctcggcggcgaggtcctggctcaccgagttcaccacggacggcaccgtccgcacggggtacgacgcttccggccagaaggtgatgatgctcaacctcgaccggagctccggccccgctggattcaactccaaggagcagttcctctacggcgagttcagcatcgagatgaagctcatccccggaaactctgccggcaccgtctcctgcttctacctttcgtccggcaccgacgactggcgcgacgagatcgacatggagttcatgggcaactcgagcggccagccggtggtgctcaacaccaacgtgtgggccaacggggacggcaagaaggagcaccagttcgacctctggttcgatccctccgccgactaccacacctacaccatcatctggaacccggagaacatcctcttcaaggtcgacaacgtcttcatccggtccttcaagcgctacgccgacctgccctacccgagctccaagcccatgacgctgcacgcgacgctgtgggacggcagctactgggccacggagaagggcaaggtccccatcgactggagcaacgcgcccttcgtcgtctcgtaccggagcttctacgccaacgcctgcgtcagcggcggcgcgtgccacgccggcagggacgggtggatgcacaggcagctcgacgccgccgagtggggcaccgtgaggtgggcggagcgcaactacatgcgctacaactactgccaggatgggtggaggttctcgcaggggctccccgccgagtgcagccgcaactgatggtccgtggccggcgtctgatttgtccagctgggcatccattgttactgcattaattggtttctttttcattggatttatgattgttattcttgttcttctttgtgaatttgtgattacaaaagcagccccgcagcagcaaagtgtgggcggttgtacaccgagaaattaaagacgaagcatgtaatttttatcgtgcctttggatacagc

SEQ ID NO: 850 - DNA, 4413 bp, Ricinus communis
atgggtcgcttaaagctgcagccaggaattaagtcgatcgaggaagaacctgaggagtgcgactcttcctactctaacaaggctactttagcatgcatgataaatgcagaagttggtgcagttttggcagtcatgaggagaaatgttagatggggaggtcgttatatgtctggtgatgatcaactagagcactctttggttcagtccttgaagtcattgcggaagcaaatcttctcatggcagcacccatggcatactatcaaccctgctgtgtatcttcagccatttttggatgtgattcgatccgatgaaactggtgctccaatcactggggtcgctttgtcatctgtttacaagattttaactcttgatgttattgatcaaaacacagtaaatgtcgaagatgctatgcacttggtagttgatgctgtcacaagttgcagatttgaggtgacagatcctgcatcagaagaggtagtgctgatgaagatacttcaggttcttttatcttgtatgaaaagtaaagcatcagtcacactgagtaatcagcatgtctgtaccatagtcaatacttgcttccgcatagttcaccaagcaggaagtaaaggagagttgttacagcggattgctcggcacacgatgcatgaacttgttaggtgtatattttcacaccttccggatgttgacaacacagaacatgcactggttaatggagttagtactgtcaaacaggagattggtggtatggataatgattacacttttgtgaacaaacagtcagaaaatggcaacagtagttctgaattggatggtcaaacatcttctgtgagctttggctctagtgtttctacaggtctggtgccaactgttacagaagaaaatacaattggcggtagcggaaaggatgcccttccgtatgatttacacctcatgacagaaccatatggtgttccctgcatggtcgagattttccactttctgtgctctttgttaaatgttgttgagcatatgggaatgggtcctagatctaatacaatagcatttgatgaagatgtacctctctttgcattgggattaattaattcagctgtagaattgggcgggccttctattcgtcatcaccccaggttattgagtttgattcaggatgaattatttcgtaatcttatgcagtttggcttgtccatgagcccactgattctctcaatggtttgtagtattgttctcaatctgtatcatcatctaagtactgaactcaaattgcagcttgaggcttttttcgcttgcgtgattttgagacttgcacagagcagatatggtgcttcttaccagcagcaagaggttgccatggaggctctcgttgacttctgcaggcagaaaacgtttatggtggagatgtatgctaacttagattgtgatataacatgcagtaatgtgtttgaagacctggctaatctgttgtcgaagagtgcatttccagttaactgccctttgtctgcaatgcacattcttgctttggatggtctcatagctgttattcaggggatggctgaaaggataggcaatggatcagttagttcagagcaggctccggtgaacctggaggagtacataccattctggatggtgaagtgtgacaactatggcgatccagatcactgggttccatttgtgcgcaggagaaagtacattaagagaagattgatgattggagctgatcacttcaaccgtgacccgaagaaaggcctagaatttctccaaggaacacatctcttacctgacaagcttgatccacaaagtgtggcctgctttttcaggtacactgctgggttagataagaatctagttggggatttcctgggaaatcatgatgaattttgcgttcaggttcttcatgaatttgctgggacttttgatttccaaggtatgaatctggatactgctctgcggttgttcttggagacttttaggcttcctggagaatctcaaaaaatacaaagggttcttgaggcattctccgagagatactatgagcaatcaccacagattctagctaataaggatgctgctcttttgttatcttattcacttataatgctcaacacagatcagcataatgtacaggtgaagaaaaagatgacagaggaggattttatacggaacaataggcatattaatggaggcaatgacttacctcgagaattcttgtcagaattgtaccactcaatttgcaggaatgagatccggactactccagaacaaggagctggtttccctgaaatgaccccgagtcggtggattgatctaatgctcaaatccaagaaaactgctccttttattgtatctgattctagagcctaccttgatcatgatatgtttgcaataatgtcaggtcccacaattgcggctatctcagttgtgtttgatcatgctgaacatgaagatgtttaccagacatgtattgatggtttcttagctgttgcaaaaatttctgcttgtcatcatcttgaagatgtattggatgatctagtcgtgtctctctgtaagttcacaactctcctgaatccatcttccgttgaggaacctgtgctagcctttggtgatgacacaaaagccaggatggcaactgtgactgttttcaccattgcaaacaggtatggtgattatattcgcacaggctggagaaatattctggattgcatcttacggttgcacaaactaggtcttcttccagcacgtgttgccagtgatgctgctgatgaatcagaactttctactgaacccggtcaagggaaacctattacaaattctctatcttcagttcatatgcaatctatgggaactcctaggagatcttctggattgatgggccggtttagtcagctcttatctcttgacactgaggagccaagatcacaacctactgagcaacaacttgctgctcatcaacgcacccttcagacaattcaaaagtgccatgtcgacagcatatttactgagagcaagttcttgcaagctgaatctttattacagcttgcacgagctctcatctgggcagcagggcgaccccagaaagggaacagctctccagaggatgaagatactgcagttttctgcctggagttgttgattgcaattactctgaataaccgtgacaggattgtgctattatggcagggtgtttatgagcacatagctaatattgttcaatcaactgtaatgccttgtgcattagtagagaaggctgtgtttggactcctccggatttgtcagcggttgctcccctataaagagaacctggctgatgaacttttgaggtccttgcaacttgttttgaagcttgatgcccgtgttgctgatgcttactgtgaacaaattacacaggaagtcagtcgccttgtaaaggcaaatgctacgcatatcagatctttaatgggatggcgtacaattacatccctgctttccataacagctcggcaccctgaagcttctgaagctggatttgatgcactgctgtacattatgagtgatggagctcacttgatgccagccaactatgttctttgtgttgatgcagcaaggcagtttgcagagtctcgtgtggcacaggcagagaggtctgtacgtgcactagatcttatggcgggttccgttgattgtttggctcggtggtctcatgaggctaaggaagcaatgggggaggaggaagctgcgaaattgttacaggacattggggagatgtggctgaggcttgtacagggactaagaaaagtttgtttggatcagagagaagaggtcagaaaccatgcacttttgtcattgcagaaatgcttgacagtagtggatgggatcaatcttccacatggtttgtggctacagtgttttgatctggtgatctttacaatgcttgacgacttgcttgaaattgctcagggacactcccaaaaagatttcagaaacatggatggtacactaattattgctgtaaagctcctgtcaagagtgtttttacagctactccatgaccttgctcagttaacaactttctgtaagctatggctgggagtgctcagccgaatggagaaatatctgaaggttaaagtaagagggaaaaagagcgagaagcttcaggaagtagtgcctgagcttttgaagaacaccttgcttgcaatgaaggccaagggagtgctagttcagaggagtgccttaggtggggatagcttgtgggaactaacatggctgcatgtgaataacattgctccatctttacaatctgaggtgttcccagatcaagactgggagcagtctcagcataagcagggtgaaacaattggtagtttggcatctgatggaacgggttctgttccatcaaatggatcagtggcttctgaaggttctggaatgggaggttaa

SEQ ID NO: 851 - DNA, 5014 bp, Populus trichocarpa
atggggagattaaagctaaaccctgggattaagtcaattgaggaagagcctgaggagcgtgatgctgctgttgaatcaaatagggctgatttattagcatattcgattaattctgaagtcagtgccgtgttggcggtcatgaggagaaacgtgagatgggggggtcggtatatttcaggcgatgaccagctagaagactctctaattcaatctttgaagacgttgaggaagcaaatcttctcatggcagaatccgtggcatactatcaaccctgctctttatcttcagccctttttggatgtcattcggtccgatgaaacgggtgcaccaatcaccggggttgctttgttgtctgtttacaagatattaactcttgatgtgattgatgaaaatactgtaaatgttgaagatgctatgcagctggtagttgatgctgtgactagttgccggtttgaggtgacagatccttcatctgaagaaatggtgttgatgaagatacttcaggttcttctggcttgcatgaagagtaaggcatctgtcatgttgagtaatcaacatgtttgtaccatagtgaacacttgttttcgtatagtacatcaagcaggcagtaaaagcgagttgctgcagaggatttctcgccacactatgcatgaacttgtcaagtgcattttttcacaccttccagatgttgaaagcgctgaacagacattggttaatggagttacttctcacaaacatgagattggtgggctggataatgattatgcttttgggagtaaacagatggagaatggaaatggtaattcagaattggatggccaagcatccactgtgagctttggttccaatgcttccacagctctggtggcaagggaagaaaatgcaattgggactggtggtggaaaggatggccttccatttgatttgcaccttatgacagaaccatatggagtgccttgcatggtggagatatttcatttcttgtgctctttattaaatgttgttgagcatattggaatgggtcccagatcaaatactatagcatttgatgaagatgtcccactttttgctttgggtttaattaattctgcaatagaattgggcggcccttctattcgttgtcacccgaggttactgagtttgattcaggatgaattatttcgtaatctgatgcaatttggtttgtcagtgagtccgcttattctctcaatggtctgtagtatagttctcaatctgtatcaccatctccgaactgaactaaaactccagctcgaggctttcttctcatgtgtgattttgagacttgcgcagagcagatatggtgcttcataccagcagcaagaggttgccatggaggctcttgtagacttctgcaggcagaaaacctttatggtggagatgtatgccaatttagattgtgacataacatgcagtaacgtgtttgaagagcttgctaatttattgtcaaagagtgcttttccagtgaattgccctttgtctgcaatgcacattcttgctcttgatggccttattgctgttattcaggggatggctgaaaggataggcaatggatcggtaagttcagagcagggaccagtgaatcttgaggagtacaccccgttctggatggtgaagtgtgacaactatagtgatcctaatcattgggttccatttgtccgcaggaggaagtacattaagagaaggttgatgatcggagctgatcactttaatcgtgacccaaagaaaggactagaatttctccaaggaacacatctcttacctgacaaactggaccctcaaagtgtggcttgctttttcaggtacactgctgggttagataagaatcttgttggtgatttcttgggaaatcatgatgagttttgcgttcaggttctccatgaatttgcttggacttttgatttccaagacatgaatcttgatactgctttgcggttgttcttggaaacttttagactgcctggagaatcacaaaaaatacaaagggtgcttgaggcattttctgagagatattatgagcaatcaccacagattcttgctaacaaggatgcagctcttttgctgtcttattcccttataatgctcaacacagatcagcacaatgtacaggtgaagaaaaaaatgacggaagaggacttcatccggaataataggcacatcaatggaggcaatgacttacctcgagaatttcttacggagctttaccattcaatttgcaaaaatgagatccgcacaactcctgaacaaggatttggttaccctgaaatgaccccaagccgttggattgatctaatgcacaagtccaaaaagactgctccgttcattttatctgattccagagcctaccttgaccatgatatgtttgccataatgtcaggtccaacaatcgctgctatctctgtggtgtttgataatgcagaacatgaagatgtttaccagacatgtattgatggattcctggctgttgctaaaatctccgcatgccatcatcttgaagatgtgttggatgatctagttgtgtctctgtgcaagttcacaaccctcctgaatcaatcttcagttgaggaaccggtgctagcctttggcgatgatgcaaaagcaaggatggcaactgttacagtttttaccattgcaaataggtatggtgattacattcgcacaggatggaggaatatcctggactgcatcttgcgattgcacaaacttggtctcctccctgctcgtgtggccagtgatgctgctgatgaatcagagcttgctgctgaccctgtgcatggtaaacctattacaaattctctgtcatcagttcacatgcaatccatgggaactccaaggagatcttctggattaatgggccgattcagtcagctcttgtctctcgacactgaggagccaagatcgcaacccactgaacaacaacttgctgctcatcaacgcacccttcagacaatccaaaagtgccatgttgacagcatatttactgagagcaagttcttgcaagctgaatcgttgttgcagctagcacgagcactcatctgggctgcaggtcgccctcagaaagggaacagttcaccagaggatgaagatactgctgttttctgccttgaattgctcattgcaattacactgagcaacagggacaggattgtgctattgtggcagggtgtttatgagcacatagctaatattgttcaatcaactgtaatgccttgtgccttagtagagaaggctgtttttggactcctccggatttgccagcggctgctgccctacaaagagaacctggctgatgaacttttgaggtcactgcaacttgtcttgaagcttgatgcccgtgttgctgatgcatactgtgaacaaattacacaggaagtgactcggcttgtgaaagcaaatgctacacacatcagatccctaatgggttggcgtacgattacatccttgctttccatcactgctcgtcacccagaagcttctgaagcaggattcgatgcgctgttgttcattatgactgatgaagctcatttgttgcctgccaattatgttctctgtgttgatgcagcaaggcagttttcagagtctcgtgttggacaggcagagagatctgtgcgagcacttgaacttatggcaggttctgttaattgtttggctaggtggtcgcatgatgcaaaggaaacaatgggagaagaggagtctgcaaaattatcacaggatattggggaaatgtggctgaggcttgtgcaaggtttacggaaagtttgtttggatcagagagaagaggtcagaaaccatgctcttttatcattgcaaaagtgcttgacaggagtggatgagattaaccttccacatggtctgtggttacaatgttttgatctggtgatctttactatgctagatgacttgcttgaaattgctcagggacaccaaaaagactaccggaatatggaagggacacttatcattgctgtaaaactcctgtcaaaggtgtttttacagttacttaatgaacttgcacagctgacaactttctgcaagctatggctaggagtgcttagccgaatggaaaaatatcttaaggtaaaagtgaaagggaagaagaatgaaaatctccaggaaacggtgcctgagcttcttaagaacactttacttgcaatgaagagtaggggagtgcttgtgcagaggagtgctctaggtggggatagcttgtgggaacttacatggctgcatgtgaataacattgctccatctttgcaagctgaggtgttccctgaccaagatcgagagcagtcacatcataagctgggtgaaactggtggaagtttggtgtctgatgaaacagattctgtttcttccaaggaatcagtgcatgctgaagttgctggcacaggaggttaacatttgcacaatgtttagcagactgatcggtttgttgatatttgtagctgagggcacatagttggaagcattggtattttttacaggttccaatattggaatcaactggggtactgataaagattcagctttatcttagttttagtttgggttgatgtaaactgtagtcaagaagcgaatcgaacagatgaaaatcgttgttcaggacttcaagcatcagagctggtcagtcggtgagaaccccgcgtagtttttctggtattgtccttatgttttgcatttataagaactttccatgcgtgctatcatcaaaagtgggtttctttgaagatgttatatagttaatagatgaaggatttaacccgatagtctttcttttatttgaattcttccagggaagaatgctctcatcacggtttccggaattttgagcttgaaatttatattgactttctggttgatgtacaggactcagaatttgaatctgaaacttgtatgtttcaagtaggttatactcggaattaaaatgtagtgtaccgttgtctggagacatgccatggttttgcagatttaaatacaattcttcagattctggatgctc

SEQ ID NO: 852 - DNA, 4857 bp, Glycine max
atgggacgtctgaagctgcaagctggtatcaatgcaatagaggaagaggaacctgaggaatgtgatgctgcctatcctaacaaaacaactttggcatgcatgatcaattcagagattggtgctgttttggcggtcatgagaagaaatgtaagatggggaggtcgttatatgtctggcgatgatcagctggaacactctcttattcagtcttttaagacagtaaggagacaaatcttttcgtggcaccaccatcagtggcaagctattaaccctgccttgtatctacagccgtttttagatgtaattaggtctgatgaaactggtgccccaattactagtgttgctttgtcatctgtttacaagattttgactcttgatgtgatcgatcataatactgtcaatgttgaggatgccatgcacttggttgttgatgctgtcactagctgcagatttgaggtcactgatccttcttcggaagaagttgttttaatgaagatactacaagttcttctagcttgtatgaaaagtaaagcatctataatgctgagtaaccaacatgtttgcaccatagtgaatacttgtttccggattgttcatcaagcaggaagtaaaggtgagttgttgcagcagatagcacggtacacaatgcatgaacttgtaaggtgtattttctctcaccttcaagatgttggcaacacagaccatgcattggttaatgggagcactaatttgaaacaggagaccggaggcctagataatgagtatgcgtttggaagtagacaatcggagaatggcagcatgacttctgaatatgataatcagtcattatctacaaactctgctcccaatgctgcaagtgttgtgaaaacaactgtgatggacgaaaacacagcgataactattactggaaaggagggtggaccacatgacatgcatctcatgactgaaccatatggtgttccttgcatggtggaaatatttcactttttgtgttctttgctgaatgttgtcgagcatacaggaatgggtcctagatcaaacacactagcatttgatgaagatgtgcctctctttgccttaaatttaattaattcagcaatagaacttggaggaccttctatttgtcgtcacccaaggttgctgagcttaatccaggatgaattgtttcataatctgatgcagtttggtttgtcaacgagtccccttatactttcgatggtgtgtagcattgttctcaatttgtatcatcatcttcgtacagaactcaaattacagctggaagcatttttttcttgtgtcattttgagacttgcacaaagcagatatggggcttcataccagcagcaagaggtagccatggaggcccttgttgacttctgtaggcaaaagacatttatggtagatatgtatgctaattttgactgtgacataacttgcagtaatgtctttgaagaccttgctaatttattgtccaaaagtgcatttcctgtgaattgtccattgtctgccatgcatattcttgctttggatggtcttattgctgttatacagggaatggctgaaaggatagccaatggatctgtaagctcagaatattctccagttaatcttgaagagtatactccattctggatggttaaatgtgagaattataatgatccaaatcattgggttccttttgtccgccgaagaaagtacataaagagaagactgatgattggtgctgaccactttaatcgtgatcctaagaaaggtctagagtttctccaaggaacacatcttttgcctgacaaacttgatccccaaagtgttgcctgcttcttcagatacactgctgggttggataagaatcttgttggtgatttccttggaaatcatgatgaattctgtgttcaggttcttcatgaatttgctggaacatttgatttccaagacatgaacttagacacagctctgcgtctattcttggagactttcagacttcctggagaatcacaaaagatacatagggtgcttgaagctttctctgagagatattatgaacaatcgccacatatcctagctaacaaggatgctgctcttgtgttatcatactcaatgataatgcttaatacagatcagcacaatgtgcaagttaaaaagaagatgacagaagaggattttatccggaataataggcatataaatggtggcaatgatctgcctcgagaaatgctgacagagatttaccattcaatttgtaagaatgaaattcgcacaatccctgaacaaggtgttggatttcctgaaatgacaccaagtcggtggattgatctaatgcataagtccaaaaaaactgctccatttattgtatctgattctaaggcctaccttgatcatgatatgtttgccataatgtcaggcccaacgattgctgccatctctgtggtatttgatcatgctgaacaggaagaggtataccaaacatgtatggatgggttcttagctattgctaaaatttcagcttgccatcatcttgaagatgttcttgatgatctggtagtgtcgctttgcaagttcactacacttttaaacccatcatcagttgaggaaccagtccttgcctttggagatgacatgaaagcaagactagcaactgtgacagtattcactatagcaaacaggtatggggattacatacgcacaggttggagaaatattcttgattgcatcttaagactgcacaagcttggtcttcttcctgcccgtgttgccagtgatgcagctgacgaatcagagctttctgctgaaactgtgcatggaaagcctattatgaattctttatcctcagctcatatgcaatctattggcactccaaggagatcctcgggattgatgggtagatttagtcaactcttatctcttgacactgaggaaccaagatcacaacctactgaacaacaacttgctgctcatcagcgcaccctacaaaccatacagaagtgtcatattgacagcatattcacggagagtaaattcctgcaagctgaatctctattgcagctagcaagagcactcatttgggctgcggggagaccacaaaaagggaacagcacacccgaggatgaagatacagcagttttctgcctggagttgctgattgcaatcactttgaataacagggatagaattgggattctttggcagggtgtgtatgaacacatatccaacattgttcagtcaactgtaatgccctgtgccctggtagagaaggctgtttttggactcctgcggatttgccagcggttgcttccctacaaggagaacattgctgatgaacttctgaggtcattgcaacttgtcttgaagcttgatgcccgggttgcagatgcatactgtgagcagattactcaggaggtcagtcgccttgtgaaggcaaatgcttctcatataagatctcagttaggatggcggacaattacatcactgctttccatcacagctagacacatagaagcatctgaggctgggtttgatgcactattgttcataatgtctgacggtacccacttgcttccagctaattacattctgtgtgtagatactgccaggcagtttgctgagtctcgtgttggacaagcagagcgatctgtgcgggcactagatctcatggcagggtctgtcaattgcttggcccagtggactagtgaggctaagggagcaatggaggaggaacaaatgtctaagttgtctcaggatatcggagagatgtggttgagactagtacaaggtctaaggaaggtatgtttagaccagagagaggaggttagaaatcatgctttattatcgctgcagaagtgcttgacaggggccgatggcatttatctaccatacagcttgtggttgcaatgttttgatcttgtgatcttcactgtgcttgatgacctgcttgagattgcacagggacactctcaaaaggactaccgcaacatggaaggcacacttatcttagcaatgaagctcttgtccaaagtttttcttcaattactcccagaattatcacaattgacaaccttctgtaagctatggttaggtgtactgaccagaatggaaaaatatataaaggtgaaggttagggggaaaagaagcgagaagcttcaagagacaatgccagagctgcttaaaaactccttgcttgttatgaagatgaggggtatactggcgcagaggagtgccttgggtggtgatagtctgtgggaacttacatggctacacgtgaataacatttcaccatcattgcaacttgaggtattccctgagcaggattctgagcatttgcagcacaagcagggcgaatcaataggaggtacggtgcctgatgaaaaggtttccatgccttcaagtgaaacagcaagccgtgaagatgctggcattgttggttgattagaggttctatgtcgctgctacttgaatcagttttcctgtttataaccatacacacaatccctgaccttaaaatactgattgtgcagaatttgtggatcatattcgcatcctaattttgttttgccactgatagatgcagaagtattataggagggaaagtatagttctaaggcaaagacgtgctagttcatctagttaaatctcattgtcacctgtctgttggcatttgcccttttccgttcccccttgaagcttcttgttcccgtaatttagatgaaatatattgtactttgaattgagatagatttctacatttcagcggggtactgtagggcttccccttctacctatgaagctgcgtcagggatagtaagcctaaatttcccaaaaacatttatacagaacctcgattttctcttaatgcagcttgca

SEQ ID NO: 853 - DNA, 1636 bp, Zea mays
ccccccttcactttctcctcctcgtgaagcgagctctccacgcccctgcgattccatttccatcctgcccgctcccaacttcaaaacggccgcggcgcagatccacacgcacgggcaggcaggcaggcatacggacaggaccgccgccgcagctttcaaatcccggggcggattaccctgcagacggagcccacagcccagcaccgcagcagtccaccgggatctcgccttcgtcgccccgtgtcgcgtcgcgccggtggccgagcctggggacgctagctagagcctactactgtagaccgtagagccatggggaacagcatctaccggttcctatgcggcctgtgcgcgccctcgtcgtcggagcacgggctccacggcgcgcaccccgccgtcgccgcgctcggccgcgacgtcctcagcttccagagcacctcgcaggttccggacgagctgagccggcacgtcgtctcctccaagaaagcgcaggcgaattggtacaagaagctgctggtggcatggaagaaagcccggccgcctccgaagacgcccgaggaagccgcggccttcgttgtgcagacgctcaagaaccatcagaaagcagatgtggagggcctgttgtctttctacggcctgccgcatccgaacgcggcggcagcagcagcaggcgcgcccgccgctcgcccgccgcccaagaaggcccagcagggcgccaagttcgagctgcacacgctccccattgaccccaagtctgtggccgacggcgacacggtgaacgtgtacgtcgacgcggcggacccgcgggaggccggcagcgtgccccgcgaggtgcagaaggctgcggcggagcgggccagggcgcgggctgccaaggactaccagaaggccgacgcgctgcagaaggtcatagtcgacgcagggtacaggccggttcctaacgcgagaggcgaggaggtgctggcgaagaagtacaggatcaggctgagggggatcgatgcgcccgagagcgcgatgccgtatggcaaggaagccaaggaggcgctgctcaaacttgtccaggggaagagcttgaaggtctacgtgtacgacgaggaccggtacggtagatgcgtcggagacatctactgcgacggggtatttgtgcaggagcaaatgctgaagaagggtttcgcgtggcactacaccgcctacgatcaacgcccggagctggccaagtgggagaaacaagcgcagaccggccggaagggcctgtgggcggcgtcgaagccacagaaaccatgggagtggaggaaggacaagcgcaacgggacagcatgaacaaacccccccgtgcatggttcagtgtgtgtgtgtccatgaacacctgatacattgatgtacctgcagacttttaggacggtatgtgtcggggattcagtagcggtgcagtatggttgtgtgtacactgtaatagacgattccttacagttacagggatgtgaagcaggacaagagagattggcgtgatccctaatttcgtatggggattcgtcgtgcaactgtatcaaatgcattgtaccatcatttacacccatgtgacctgttgtgaagaagagtagctgagattgtgacctgtgttgtatccaaagcaaatgtt

SEQ ID NO: 854 - DNA, 1499 bp, Oryza sativa
gtgaagagagctccgattccgaaacggctaaaaccgctttcacactgcctctttcgcgcagatccatacaaaaccaccggaaaagttttcaaatcccgaagcggattcgcgcacggaaacccacagtcgattctccggtgagaggattgtttcggcggcgaggtcgggggcatggggaacagcatatacaggttcctgtgcggcctctgctcgccgtcgccggagtaccagccgcacggcgcgcaccccgccgtcgcggcgctcggccgggacatccagcagttcgaggccacctcgcaggttccggatgggctgagccggcatgtagtctcctccaagaaagcgcaggctaattggtacaagaagctgatagtgacatggaagaaagccaggccgacgccgaggacgccggaggaagccgcgcggctcgtcgtcaccacgctgaagaatcatcagaaagcagacgtcgagggattcttggttttctatggccttccaattccaaatgcagcagcaagtacccctgcgcctcacactgcacacgtcccaaaacctcaaggttgcaagtttgagctgcacactctcccggtcgatgcaaaggccgtggccgacggcgacacgatcaccgtgtacattgacacggccgatcctcgggagtccggcaatgttccccgtgaaattcagaaagcggcggcggaacggacaagggcgcgcgcggccagggattatcagaaggccgacgggttgcagaagatgatagctgatgcaggatataggcaagttcctaatgcgagaggcgaggaagtgctcgcaaagaagtacaggatcaggctaagggggattgatgcgccggagagcgccatgccgtacggcaaggaggcaaaagaggcgcttctgaaaatggtgcagggaaagagcctgaaggtctatgtgtatgatgaggaccggtatggtagatgcgtcggagatatctactgcgatggggtgtttgtgcaggagcaaatgttgaagaaaggatgtgcatggcactatactgcctatgaccaacgaccagagctggccaagtgggagaaacaggcgcaatctggcaggaagggcttgtgggcggcgtcaaggccacagaagccatgggaatggaggagggacaagcgcaatggtacagcatgaacatgaaccatgaacaacagatgattgatttataatattagctctttcagacttgtagcccggagcaatatatgctttacaccacagtagaagtgtagatcgtgtagtgtgtacactagtacatcggcagaggggttgtcaaggaagaagagggcgttgattggtgtgtgtactataattgattaagtgcatatcgtgatttgtgtgttgtattgtatttgagaattgcattgttgtaaaactgaaactggtagaggatgtccaagtgaattcaatgttgttcaggaacttcataaagctgaatataagtaatcatctatcccccttctctg

SEQ ID NO: 855 - DNA, 1739 bp, Saccharum officinarum
cgagctcccccctgcccctgcgattccatcccgtcccggcctccaacttcaaaacggccgcggcgcagatccacacgcacaggcaggcagacggacaggaccgccgccgcaggtttcaaatcccggggcggatttccttctctgcacctgcagagagagacggagcctagcagtagcaccaccgggatctcgccttctcgtcgtccgtccacctgtggtgaccgaggcaggggcgctaggtagagcctagaggcatggggaacagcatctaccggttcctgtgcggcctgtgcgcgccctcgcacgggctccacggcgcgcaccccgccgtcgccgcgctcggccgcgacatcctcagcttccagagcacctcgcaggttccggacgagctgagccggcacgtcgtctcgtccaagaaagcgcaggcgaattggtacaagaagctgctggtggcatggaagaaagcccgaccgcctccgaagactcccgaggaagccgcggccttcgttgtgcagacgctcaagaaccatcagaaagcagatgtggagggcctgttgtctttctacgrcctgccgcatccgaacgcggcagcargcgcacccgctgctcctccaccgcccaagaagcctcagggcgccaagttcgagctgcacacgctccccgtaagactccggccggccagctcccgtttgctgaatctttccgtcgtcgcgtctaaaaaactcgacccggtggggaaaagaccgccccacggctttcaaataagaaattgaccccaagtctgtggccgacggcgacacggtcaacgtgtacgtcgacacggcggacccccgggaggcyggcagcgtgccccgygaggtgcaraaggctgcggcggagcgggccaaggcgcgggccgctaagaactaccagaaggccgacgcgctgcagaagatcatagttgacgcaggatacaggccggttcctaacgcgagaggcgaggaggtgctagcgaagaagtacaggatcaggctaagggggatcgatgcgcccgagagcgcgatgccgtatggcaaggaggccaaagaggcgctgctcaaacttgtccaggggaagagcttgaaggtctacgtgtatgacgaggaccggtatggtagatgcgtcggagacatctactgcgacggcgtatttgtgcaggagcaaatgctgaagaaaggttttgcctggcactacaccgcctatgatcaacgcccagagctggccaagtgggagaaacaagcacagactggccggaagggcttgtgggcgtcgtcgaagccacagaaaccatgggagtggaggaaggacaagcgcaacgggacagcatgaacagaccyccgaggttcagtatgtgccgtgtgtgttattagccatgaacacctgattgatgatttacctgcagacttttagggtggtatatatcgggggtcagtagcggtgcagtatgatcgtgtgtacactagacgattccttaaagttacagggctgtgaagcaggacggaagagattggtgtgatgccaaatttcgtatggggatttgtcgtacagttgtatcgaatgcattgtattagcaccacttgtactgctgtgaagtagatcaattgagcccgtaaaatgtgttgatgtatggaaagccgctgttgatatagaactttggatggatgtcaatagaatgaccgaattgctaacaatgtaattcagatagtaacctcacgcgtccg

SEQ ID NO: 856 - DNA, 1794 bp, Hordeum vulgare
gttggcctactgggaagaaaagcacggctgctacccaatcccatctgctacccctctcttcctgctcggtgacgcacctctggtctcggggatgaggacctccatggctctgctggcggcctcggcggcgctgctgctgatggtgtcgctggcggcggcggcggacatgtcgatcgtgtcctacggggagcggagcgaggaggaggtccggcggatgtacgccgagtggatggcggagcacggcagtacgtacaacgccatcggcgaggaggagcgccgcttcgaggcgttccgggacaacctccgctacatcgaccagcacaacgccgccgccgacgccggggtccactccttccgcctcggcctcaaccgcttcgccgacctcaccaacgaggagtaccgcagcacctacctcggcgcccgcaccaagcccgaccgggagcggaagctcagcgccaggtaccaggccgccgacaacgacgagctgcccgagtccgtcgactggaggaagaagggcgcagttggtgccgtcaaggaccagggcggctgtgggagctgctgggctttctcagcaatagcagctgtcgaaggcatcaaccagattgtcacaggcgacatgatccctctgtccgagcaagagcttgttgactgtgacacttcatacaaccagggatgcaatggaggtctgatggactatgcatttgagttcatcattaacaatggtggtattgactctgaggaggactacccctacaaggagagggacaaccgttgcgatgctaacaagaaaaatgccaaggttgttaccattgatgggtacgaggatgtgcctgtgaacagtgagaagagtctgcaaaaggcagttgcaaaccagcccatcagtgttgcgatcgaggctggtggcagggcattccagctctacaaatcgggtatcttcacgggaacctgtggaacagcacttgaccatggtgtcgccgccgttggttatggtacagagaatggcaaggactactggctcgtcaggaactcctggggtagcgtctggggagaggatggttacatccggatggagcgtaacatcaaggcatccagtggcaaatgtggtattgctgtcgagccttcctacccgacgaagacgggcgagaacccccctaaccccggcccaactccaccgtctcccgccccaccgtcttccgtctgtgacagctacaacgagtgccctgcgagcacgacctgctgctgcatctacgagtacggcaaggagtgcttcgcctggggctgttgcccacttgagggtgctacctgctgcgatgatcactacagctgctgccctcataactatcccatctgcaacaccaagcagggaacgtgcctcgcggccaaggacagcccactgtcagtgaaggctcagaggcgtaccctggccaagcctataggtgctttctctggcattgcaattgacggcaagaagagcagcgcgtaaacatttgcatcacggcattggtacagccaacggccatggtgattaacttctgcaaatgatcacctggtgatccacgatcgaaggcgcagcatggcgatagctatgctctcaagtatcttctttataatagatgctcctgtacataatcctaaaatcgggttcggtcgtttacagaaccaccaaatttgcttttgcatatgtatatgtaaaactcagctcattcccacgcagtttggagctgccattgttattatggaattcatcaagaaacatgataagcagattgcagtattgatgcatagttctcgtgt

SEQ ID NO: 857 - DNA, 1532 bp, Brachypodium distachyon
gctgcaaagtccatctaaccccatctactccctccccaccctcctatcgacactgattgcggagatgaggagctccatggctctggtggccgcggcggcgctgctgctgctggtgtcgctggcggcggcggcggacatgtcgatcgtgtcgtacggggagaggagcgaggaggaggtccgccggatgtacgtggagtggatggcggagaacgggaggacctacaacgccatcggcgaggaagagaggaggttcgaggtgttcagggacaacctgcgctacgtcgaccagcacaacgccgccgccgacgcagggctccactccttccgcctcggcctcaaccgcttcgccgacctcaccaacgaggagtaccgcgacacctacctcggcgtccggaccaagccggtgagggagcggaggctgagcggcaggtaccaggccgccgacaacgaggagctgccggagtccgtcgactggagggagaagggggccgttgccaaggtcaaggaccagggcggctgtgggagttgctgggctttctcagcaattgctgctgttgaaggtatcaaccagatcgtcacaggtgacatgatcgctctgtccgagcaagagctagttgattgtgacacatcatacaaccaggggtgcaatggaggtctgatggactatgcatttgagttcatcattaacaatggtggaattgacagcgaggaagactacccttacaaggagagggacaaccgttgtgatgctaacaagaaaaatgcaaaggttgtcacaattgatgggtatgaggatgtacccgtgaacagtgagctgagtctgaagaaggcagttgcaaaccagcccatcagtgtcgctattgaggctggtggcagggcattccagctctacaaatcgggtatcttcacgggaagatgtggaacagctcttgaccatggtgtcaccgcagttggttatggttcagaaaacggcaaggactactggattgtgaagaattcttggggcaccgtctggggtgaggatggctacgtccggttggagcgtaacatcaaggcaaccagcggcaaatgtggaatcgccattgagccttcttaccccctcaagaagggcgctaaccccccgaaccctggcccaactccgccatcccctgccccaccatcaaccgtctgtgacagctacaacgagtgccctgcgagcacgacctgttgctgcatttacacctacggcaaggagtgctttgcctggggctgctgcccactcgagggcgctacctgctgtgatgatcactacagctgctgcccccacagctacccaatctgcaacgtccagcagggaacttgcctcgcgggtaaggacagcccaatgtcagtgaaggctctgaagcgtattctggccaagccacacggtaccttctccgggaagagcagcgcataagcaattgcagcatgcccattagacccatcgacaaccactgtgatgaacttccacaaatgatcacctggttactgacgaaggcgcggggtgaccgatc

SEQ ID NO: 858 - DNA, 1736 bp, Festuca arundinacea
ggcacgaggccataccactctcccccactctcccgtcgcctggcgttcttgctcacagtggtcgcaagatgaggagctccacggctctcttggccgcggcggcggcgctgctgctgtcgctggcggcggcggccgacatgtcgatcgtgtcgtacggggagaggagcgaggaggaggcgcgccggatgtacgcsgagtggaargcggagcacggccggaactccaacgccatcggcggcgaggacgagctccggttcgcggtcttcagggacaacctgaggtacatcgacgagcacaacgccgccgccgacgccgggctccactccttccgcctcggcctcaaccgcttcgcsgacatcaccaacgaggagtaccggagcacctacctcggcgtccggaccaagccggagaggaagcagaagctcagcgccaggtaccaggccgccgacaacgaggacctgccggagtccgtcgactggaggaccaagggcgcggtccctgcggtcaaggaccagggcggctgtgggagttgctgggctttctcagcaatagcagctgttgaaggcatcaacgcgattgctacaggcgacttgatcgckctgtctgagcaagagcttgttgactgtgacacttcatacaacgagggatgcaatggaggtctgatggactatgcatttgagttcatcattaacaatggtggaatcgactccgaggaggactacccttacacagagaaggatggccgttgtgatgctaacaagaaaaatgccaaggttgttacaattgatgggtacgaggatgtacctgtgaacagtgagaagagtctgcagaaggcagttgcaaaccagcccatcagtgttgcgattgaggctggtggccgggcattccaactctacagctcgggtatctttaccggaacatgtggaacagcgcttgaccatggtgtcgccgctgttggttatggtacagaggatggcaaggactactggattgtcaggaattcctggggtagcagctggggtgaggccggctatgtcaggatggagcgtaacatcaagtcaaccgacggcaaatgtggcattgccatcgagccttcctacccgttgaagactggcgcgaaccccccaaaccctggccccacgccgccggctcctgttcctcccaccccaccatcctccgtctgtgacagctactacacgtgccccgccagcacgacctgctgttgcatcttcgagtatggaaaggagtgcttcgcctggggttgctgcccgctggagggcgctagctgctgcgatgatcactacagctgctgccctcatgactaccccgtgtgcaacactaggcgtggaacctgcagcgcgaccaaggacagcccactgtcagtgaaggctytgaagcgtatcatggcgacgcgcaccggggctcgcagggcagaagacggcatgaagagcagcgcgtaaagacttccatcatgacattrcacccgtaaaccaccatggtgatcaacttctgcgaacgatcacctggtgatccctgatggcgcggtgtggcgtgctctcaagtatctcctttattacagatgctcgtgtacataaacttgaaattcggttcggttgtttamagaaccgccacatttgcttccgcatatgtatatgtaatattcagctcctttcccacgcagtttgaagctgmcaatttattacayaattgatcaagcaacacgataagcagatttc

SEQ ID NO: 859 - DNA, 1810 bp, Leymus cinereus x Leymus triticoides
ccgttgctgtcgccgttgctgtcgccgttgctgtcgctactcctctcttcctgctcggtggtgtacttgtggtctcggggatgaggagctccatggctcttttaggggcggcggcggcgctgctgctgctggtgtcgctggcggcggcggtggatatgtcgatcgtgtcgtacggggagaggagcgaggaggaggtccggcggatgtacgccgagtggatgtcggagcaccggaggacgtacaacgccatcggagaggaggagcgccggttcgagatcttcagggacaacctccgctacatcgaccagcacaacgccgccgccgacgccggggtccactccttccgcctcgggctcaaccgcttcgctgacctcaccaacgaggagtaccgcagcacgtacctcggcgcccggaccaagcctgacagggagcggaagctcagcgccaggtaccaggccgacgacaacgaggagctgccggagtccgtcgactggaggaagaagggggccgttgctgccatcaaggaccagggcggttgtgggagctgctgggctttctctgcaatagcagctgttgaaggcatcaaccagattgttacaggcgacatgatccctctgtccgaacaagaacttgttgactgtgacacttcatacaacgagggatgcaacggaggtctgatggactatgcgtttgagttcatcattaacaatggtggtatcgactctgaggaggactacccctacaaggagagggacaaccgttgtgatgctaacaagaaaaatgcgaaggttgttaccattgacgggtatgaggatgtgcccgtgaacagtgagaagagtctgcagaaggcagttgcaaaccagcccatcagtgttgcgatcgaggctggtggcagggcattccagctctacaaatcgggcatcttcaccggaacctgtggaacagcgcttgaccatggtgtcgctgccgttggttatggtacagagaatggcaaggactactggctcgtcaggaactcctggggtaccgtctggggtgaggatggttacgtccggttggagcgtaacataaaggcatccagtggcaaatgtggtattgccgtcgagccttcctacccyctgaagacgggcgagaaccccccgaaccctggcccaactccgccgtctcccgccccaccatcttccgtctgtgacagctacaacgagtgcccygcgagcacgacctgctgctgcatctacgagtacggcaaggagtgcttcgcctggggctgttgcccactcgagggtgctacctgctgcgatgatcactacagttgctgccctcataactaccccatctgcaacacccggcagggaacctgcctcgcggccaaggacagcccactgtcagtgaaggctcagaggcgtaccctggccaagcctatcggtgctttctctggcattgcagctgacggcaagaagagcagcgcgtaaacatttgcatcacgacaatcctacagccaatggccatggtgattaacttctgcaaatgatcacctggtgatccacgatcgaaggcgcagcatggcgatagctatgctctcaagtatcttctttataatagatgctcctgtacataatcctaaaatcaggttcggttgttcacagaaccgccacatttgcttttgcatatgtatatgtaaattcagctcattcccacgcagtttggagctatggaattcatcaagaaacaagataagcagattgcagtatcgatgcatagttctagtgtatgatgcttatgttgcgcgctgatcatttacttcgctttg

SEQ ID NO: 860 - DNA, 1885 bp, Zea mays
gaagaaaaggaaggaagaagggcctcctgtatcctctcacttccctcagtcctcgtccgtctgctccctcctctctctacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcgacttgatctccttgtctgaacaagagcttgtcgactgtgacacttcgtacaatcaggggtgcaatggaggtctgatggactatgcatttgagttcatcatcaacaatggcggaatcgacaccgagaaggattacccttacaagggcacggacggacggtgtgatgtcaacaggaaaaacgcgaaggttgtcactattgacagctacgaagatgtaccagcgaacgatgagaagagtctgcagaaggcagttgcaaaccagcctgtcagtgtcgcaattgaggctgctggcacagcatttcagctctacagctcgggtatcttcactggaagctgtggaacagcgctggaccatggtgtcacggccgtcggctacgggacagagaacggcaaggactactggatcgtgaagaactcatggggcagcagctggggcgagtccgggtacgtgaggatggagcgcaacatcaaggcgtccagcggcaagtgcggtatcgcggttgagccgtcatacccgttgaaggagggcgccaacccgccgaaccctggccccagcccgccgtccccgaccccggcgcccgccgtgtgcgacaactactactcgtgccctgacagcaccacctgctgctgcatctacgagtacggcaagtactgcttcgcctggggctgctgcccgctcgagggcgccacctgctgcgacgatcactacagctgctgcccccatgactaccccatctgcaacgtcaggcagggaacctgcctcatgggcaaggacagcccactgtcactgtcagtgaaggctacgaagcgaaccctggccaagccgcactgggctttctccggcaacacagctgacggaatgaagagcagcgcatgagaaaacgcagcgtggcattaggtcgtcagcagcctgggtgatcgattagagcccctgcgtgggaaatggtcacctggccccctgattgacgacggaagcatggctcggcggccgctatctacctatatcgattttagtaggtactcactcctgtacataaaccctgcagaaaaaaagagggttcagttgtttatggaaccctggcaaatttgctttcgcgcacaatgtaaaactcagctaagctccccggcgtagctcgacacagctgcgatctattattatttgatgtaatggggaccgatattgcaacgaccactaatgttatgctacattcattttcttggacgcgctctgttatgtgtc

SEQ ID NO: 861 - DNA, 1958 bp, Zea mays
atccatctgctctgctccggtccgttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgcttcgccgacctcaccaacgacgagtaccgcgccacctacctcggcgtcaggagcaggccgcagagggagaggaggctcggtgacaggtacctggccggcgacaacgaggacctgccggagtccgtcgactggcgggccaagggcgccgtcgcggaggtcaaggaccagggcagctgcgggagttgctgggctttctcaacaatagcggctgtggaaggcatcaaccagattgttactggcgacatgatctccttgtctgagcaggagcttgttgactgtgacacttcatacaaccaggggtgcaatggaggtttgatggactatgcgtttgagttcatcatcaacaacggcggaatcgacaccgaggaggattacccttacaagggcacggacggacggtgtgatgtcaacaggaaaaacgccaaggttgttactatcgacagctatgaagatgtaccagcgaacagtgagaaaagtctgcagaaggcagttgcgaaccagcccatcagtgttgcaattgaggctggtggcagagcatttcagctctacaactcgggtatcttcacaggaacctgtggaacagcgttggaccatggtgtcacggccgtcggctacggcacagagaacggcaaggactactggatcgtgaagaactcttggggcagcagctggggcgagtccggctacgtcaggatggagcgcaacatcaaggcgtccagcggcaagtgtggtatcgccgttgagccgtcgtaccctctgaagaagggcgccaaccccccgaaccctgggccgaccccgccttcccccaccccgccgcccaccgtctgcgacaactactactcgtgccccgacagcaccacctgctgctgcatctatgagtacggcaagtactgcttcgcctggggctgctgcccgctcgagggcgccacctgctgcgacgaccactacagctgctgcccccatgactaccccgtctgcaacgtcaagcagggaacctgcctcatgggcaaggacagcccactgtcactgtcagtgaaggctacgaagcgcaccctggccaagccgcactgggctttctctggcaacacagctgctgatggcatgaagagcagcgcatgagaaaaacgcagcatggcattaggccgtcaacagccagcatgattagagcccccctgcatgcagaatgatcacccggtcccgtagttcacgacgaaagcatggctgggcggccgctgtttacggatttacttatatcactatagtaggtactcctcctgtacataaggctgaaaaaaaatgggttcagttgtttatggaactctgccaaatttgcttttgcatgccatgtaaaaatccagctagctcttgccaagcttcacctgcgcagttcaacaggactgcgattgatattcggtgtaatggaagtatttatcggaacaatcagcaatgttatgctatattcatttcttggacgtgaacaatagattggtcgatcccagttctcagagcggtggcgcagggggatggtccgtctgaggccttgcccaccaccaaacaagaggaagcggttctatttttaattgttg

SEQ ID NO: 862 - DNA, 1774 bp, Oryza sativa
catctactcctcttctacctctcctcctcctcctcttcttggtcgtcttctcctagctcgccaagatgaggatttccatggctctcgcggcggccgcgctgctgctgctgctgtcgctggcagcggcggacatgtcgatcgtgtcgtacggggagaggagcgaggaggaggcgcggcggctgtacgcggagtggaaggccgagcacggcaagagctacaacgccgtcggcgaggaggagcggcggtacgcggcgttcagggacaacctccggtacatcgacgagcacaacgccgccgccgacgccggggtccactccttccgcctcggcctcaaccgcttcgccgacctcaccaacgaggagtaccgggacacctacctcggcctcaggaacaagccgcggagggagaggaaggtcagcgacaggtacctcgccgccgacaacgaggcgctgccggagtccgttgactggaggaccaagggggccgtggctgagatcaaggaccagggaggttgcggaagttgctgggctttctcagcaatagcagctgtagaaggcatcaaccagattgttactggcgacctgatatctttgtctgagcaggagctagttgactgtgacacttcatataacgagggatgcaatggaggtctgatggactatgcatttgatttcatcatcaacaatggtggaatcgacaccgaggatgactacccttacaaaggcaaggacgaacggtgtgacgtaaacaggaaaaacgcaaaggttgtcacaattgacagctacgaagatgtaacaccaaacagtgagacgagtctgcagaaggcggtagcaaaccagcccgtcagtgttgcaattgaagccggtggcagagcattccagctctactcatcgggtatcttcacgggtaaatgtggaacagcactagaccacggcgtcgctgctgttgggtacggcacagagaatggcaaggactactggatcgtgaggaactcgtggggcaagagctggggtgagtccggctacgtccgtatggagcgcaacatcaaggcgagcagtggcaagtgcggcattgccgttgagccatcctaccctctgaagaagggcgagaaccccccgaaccccggccctactccgccgtccccaaccccgcctcccaccgtctgcgacaactactacacttgccccgatagcaccacctgctgctgcatctacgagtatggcaaatactgctacgcctggggctgctgcccactcgagggcgccacctgctgcgatgatcactacagctgctgccctcacgagtaccccatctgcaatgttcagcagggaacctgcctcatggctaaggacagtccactggcagtgaaggctctgaagcgtaccctggcaaagccaaacttgtctttcttgtttggcaacggcaagaagagcagcgcttgagcaatttcagaaccgtatcagaccgtccagagccagcgtggttgcatcatcaaatgatcagctggtaactgacgaagacgattgcgcagctcggcggcgaaccctgcgcactaagtatatctgcttttataatagatttctcgtgtacataaaatctaaaaaaacgggttcagttggttacagaactgccaaatttgcttctgaatgtatatgtaaaattcagctaggtttgctcctaagctcctagatgccagttcgacggaactgcaaattgatattggaacaagataaggtcattgccatattaatccatcattcatgtattccatacc

SEQ ID NO: 863 - DNA, 1847 bp, Saccharum officinarum
cccacgcgtccggggacctccagtccagactcctgtctcatccatccatctgctccctcctcttcctagctagctagctcgccttcctgtagcgcggcggagatgggcgcctccactacgtcgctggcggcggcggcggcgctgctgctgctgctcgtgtcgctcgccgcggcggcggacatgtcgatcatctcctacggggagcggagcgaggaggagacgcggcggatgtacgcggagtggatggcggcgcacggccggacctacaacgccatcggcgaggaggagaggcggtaccaggtgttcagggacaacctccgctacatcgacgagcacaacgccgccgccgacgcgggcgtccactccttccgcctcggcctcaaccgcttcgccgacctcaccaacgaggagtaccgcgccacctacctcggcgtcaggaccaagccgcagagggagaggaagctcagcgccaggtaccacgccgacgacaacgtggagctgccggagtccgttgattggaggaccaagggcgccgtcgcggaggtcaaggaccagggcagctgcgggagttgctgggctttctcaacaatagcagctgtagaaggcatcaaccagattgttacgggcgacttgatctccttgtctgagcaggagcttgttgactgtgacacttcatacaaccaggggtgcaatggaggtctgatggactatgcgtttgagttcatcatcaacaatggtggaatcgacacggagtctgattacccttacaagggcacggatggccggtgtgatgccaacaagaaaaacgcgaaggttgttactatcgacagctatgaagatgtaccagcgaacagtgagaagagtctgcagaaggcagttgcaaaccagcccgtcagtgttgctattgaggctggtggcagtgcatttcagctctacagctcgggtatcttcactggaaagtgcggaacagcgttggaccatggtgtcacggccgtcggctatggcacagagaatggcaaggactactggatcgttaagaactcatggggcagcagctggggcgagtccggttacatcaggatggagcgcaacatcaaggcgtccagcggcaagtgcggtatcgccgttgaaccatcgtaccccctgaaggagggcgccaaccccccgaaccctggcccgaccccgccttctcccaccccagagcccagcgtctgtgacaactactactcgtgccctgagagcaccacctgctgctgcatctacgagtatggcaagtactgcttcgcctggggctgctgcccgctcgagggcgccacctgctgtgacgatcactacagctgctgcccccatgactaccccatctgcaacgtacagcagggaacgtgcctcatgggcaaggacagcccactgtcagtgaaggctacgaagcgcaccctggccaagccgcactgggctttctctggcaacacagctgatgatggcatgaagagcagcgcatgagaaaacgcagcatggcattaaggccgtcaatagccagggtgattagagcccctgcatgcaaaatgatcacctggtcgctcatcgacgacgaaagcatggctcggcggttgctgtttacctatatccctatagtaggtactcctgtacaaaaatgggttcagttgtttatcgaactctgccaaatttgcttttgcatataatgtaaaattcagctagctctgctaagctcctcggcgcagttcgacagaactgcgattgatattgatgttatggaaattgatattggaacaatcagcaacgttatgctacattcatttcttcgacgcgccctattatgtgtcgatgat

SEQ ID NO: 864 - DNA, 1823 bp, Panicum virgatum
aaaaggaaggcctccacctcctctctccctctcactccgcagctccccgtccacctgctccctcctcttcttcctcagctagtcgcctcctcggagcagcggagaagatgggtacctccaccgcggcgtcgctcgcggcggcggcgctgctgctgctggtctccctggccgcggcggcggacatgtcgatcgtgtcctacggcgagcgcagcgaggaggagacgcggcggatgtacgccgagtggatggccacgcacggccgggcctacaacgccatcggcgaggaggagcgccggtaccaggtgttcagggacaacctccgctacatcgacgcccacaacgccgccgccgacgcgggcgtccactccttccgcctcggcctcaaccgcttcgccgacctcaccaacgacgagtaccgcgccacctacctcggcgtcaggcccaagccgcagagggagaggaagctcagcgccaggtaccaagccgacgacaacgaggagctcccggaatccgtcgactggagggccaagggcgccgtcgcggagatcaaggaccagggcagctgcgggagttgctgggctttctcaacaatagcagctgtggaaggcatcaaccagattgtgacgggcgacctgatctctttatctgagcaggagcttgttgactgcgacacctcatacaacgaggggtgcaatggaggtctgatggactacgcgtttgagttcatcatcaacaacggtggaattgacacggaggaggattacccttacaagggcactgacaaccggtgtgatgtcaacaggaaaaatgcaaaggttgttaccattgacagctatgaagatgtaccggtgaacagcgagaagagtctgcaaaaggccgttgcgaaccagcccgtcagtgttgcaattgaggctagtggcagagcatttcagctctacagctcgggtatcttcaccggaagatgcggaacagcgctagaccacggtgtcacggccgtcggttacggcacagagaacggcaaggactactggatcgtgaagaactcgtgggggtccagctggggcgaggccggctacatccggatggagcgcaacgtgaaggcgtccagcggcaagtgcggtatcgccgtcgagccatcgtaccctctgaagaagggcgcgaaccccccgaaccccggcccgacgccgccatcccccaccccgccgcccgccgtctgcgacaactactactcctgcccggacagcaccacctgctgctgcatctacgagtacggcaagtactgcttctcctggggctgctgcccgctggagggcgccacctgctgcgacgatcactacagctgctgcccccatgactaccccatctgcaacgtcaaggagggaacctgcctcatggccaaggacagcccgctgtcagtgaaggctctgaagcgcaccctggccaagccgcactgggctttctctggcaacgcagctgatggcatgaagagcagcgcttgaacaatctccagcaagatatcaggccgccaacagccacggtgatcagagctcctgcaaacgatcacccggtgcttaatcgaccaagacattgcgtggtgcggcagccgctgttttaagtgtatctgtataataggtgctcctgtacataagcctgaaaaaatgggtttcagttgttcacggaactgctgccaaatttgcttttacatactatatatgtaagattcagctagctctgctaagcgccttgccgcgcagttcggccgaactacgattgatgtttatggaaattgattattggaacatatcatgactatcctatattca

SEQ ID NO: 865 - DNA, 1591 bp, Panicum virgatum
aaggaaggcctccacctcctcctctcctctcactccgcagctcccatccacctgctcccccttccgatcctcagctagtcgccttctcggaccagcggagatgggcacctcctccacggcgtcgctggccgcggcggcgctgctgctgctggtctccatggccgccgcggcggacatgtcgatcgtgtcctacggcgagcgcagcgaggaggagacgcgccggatgtacgccgagtggatggccacgcacggccgggcctacaacgccatcggcgaggaggagcgccggtaccaggtgttcaaggacaacctccgctacatcgacgcccacaacgccgccgccgacgcgggcgtccactccttccgcctcggcctcaaccgcttcgccgacctcaccaacgaggagtaccgcgccacctacctcggcgtcagggccaagccgcagagggagaggaagctcagcgccaggtaccacgccgaagacaacgaggagctcccggaatccgtcgactggagggccaagggcgccgtcgtcgaggtcaaggaccagggcagctgcgggagttgctgggctttctcaacaatagcagctgtggaaggcatcaaccagattgttacgggcgacctgatctctttatctgagcaggagcttgttgactgcgacacctcatacaacgaggggtgcaatggaggtctgatggactatgcgtttgagttcatcatcaacaacggtggaatcgacactgaggaggactacccttacaagggcagagacaaccggtgtgatgtcaacaggaagaatgcaaaggttgttaccatcgacagctatgaagatgtaccggtgaacagcgagaagagtctgcaaaaggccgttgcgaaccagcccatcagtgttgcaattgaggctagtggcagagcatttcagctctacagctcgggtatcttcactggaagatgcggaacagagctagaccacggtgtcacagccgtcggttacggcacagagaacggcaaggactactggatcgtgaagaactcgtggggcgccagctggggcgaggccggctacatccggatggagcgcaacgtgaaggcgtccagcggcaagtgcggtatcgccgtcgagccgtcgtaccctctgaagaagggcgcgaaccccccgaaccccggcccgacgccgccgtcccccgccccgccgcccgccgtgtgcgacaactactactcctgcccggacagcaccacctgctgctgcatctacgagtacggcaagtactgcttctcctggggctgctgcccgctcgagggcgccacctgctgcgacgatcactacagctgctgcccccatgactaccccatctgcaacgtcagggagggaacctgcctcatgggcaaggacagcccactgtcagtgaaggctctgaagcgcaccctggccaagccgcactgggctttctctggcaacgcagctgacggcatgaagagcagcgcttgaacaatctccagcaagatatcaggcggccaacatccacggtgatcggagctcctgcaaacgatcacccggtgcttaatcgaccaagaaaaagcgtggcgc

SEQ ID NO: 866 - DNA, 1763 bp, Triticum aestivum
tacggcgacccacccgtccggaagtctgctacccaatcccatctactaccccccatctctcttcctgctccgtggtgtacttgtggtctcgaggatgaggagctccatggccctcttggcggcggcgctgctgctgctggtgtcgctggcggcggcggcggacatgtcgatcgtgtcgtacggggagcggagcgaggaggaggtgcggcggatgtacgccgagtggatgtccgagcaccgcaggacgtacaacgccatcggcgaggaggagcgccgcttcgaggtcttcagggacaacctccgctacatcgaccagcacaacgccgccgccgacgccgggctccactccttccgcctcggcctcaaccgcttcgccgacctcaccaacgaggagtaccgcagcacgtacctcggcgcccggaccaagccggaccgggagcggaagctcagcgccaggtaccaggccgacgacaacgaggagctgccggagaccgtcgactggaggaagaagggggccgttgctgccatcaaggaccagggcggctgtggaagctgctgggctttctcagcaatagcagctgttgaaggcatcaaccagattgttacaggcgacatgatccctctgtccgagcaagagcttgttgactgtgacacttcatacaacgagggatgcaatggaggtctgatggactatgcgtttgagttcatcattaacaatggtggtatcgactctgaggaggactacccctacaaggagagggacaaccgttgcgatgctaacaagaaaaatgcgaaggttgttaccattgatgggtacgaggatgtgcccgtgaacagtgagaagagtctgcagaaggcagttgcaaaccagcccatcagtgttgcgattgaggctggtggcagggcattccagctctacaaatcgggtatcttcaccggaacctgtggaacagcacttgaccatggtgtcgccgccgttggttatggtacagagaacggcaaggactactggctcgtcaggaactcctggggtaccgtctggggagaggatggttacatccggatggagcgtaacatcaaggcatccagtggcaaatgtggtattgccgttgagccttcctacccgacgaagacgggcgagaacccccctaaccccggcccaactccaccatctcccgccccaccgtcttccgtctgtgacagctacaacgagtgccccgcgagcacgacctgctgctgcatctacgagtacggcaaggagtgcttcgcctggggctgttgcccactcgagggtgctacctgctgcgatgatcactacagctgctgccctcataactatcccatctgcaacacccagcagggaacctgccttgcggccaaggacagcccactgtcagtgaaggctcagaggcgtaccctggccaagcctatcggtgctttctctgtcattgcaactgacggcaagaaaagtagcgcgtaaacatttgcatcaccacaatcctacagccaacggccatggtggttaacttctgcaaatgatcacctggtgacccacgatagaaggcgcagcatggcaatagctgtgctctcaagtatcttctttatagtagatgctcctgtacataatcctaaaatcgggttcggttgttcacagaaccgccacatttgcttttgcatatgtatatgtaaattcagcacattcccaggcagtttggggctgctattgttatatggaattcatcaagaaacaagataagcagatt

SEQ ID NO: 867 - DNA, 1783 bp, Triticum aestivum
tctgctacccaatcccatctactgctcccccgtctctcttcctgctccgcggtgtacttgtggtctcgaggatgaggacctccatggttctcttggcggcggcgctgctgctgctggtgtcgctggcggcggcggcggacatgtcgatcgtgtcgtacggggagcggagcgaggaggaggtccggcggatgtacgccgagtggatggccgagcaccgcaggacgtacaacgccatcggcgaggaggagcgccgcttcgaggtcttcagggacaacctccgctacatcgaccagcacaacgccgccgccgacgccgggctccactccttccgcctcggcctcaaccgcttcgccgacctcaccaacgaggagtaccgcagcacgtacctcggcgcccggaccaagccggaccgggagcggaagctcagcgccaggtaccaggccgacgacaacgaggagctgccggagagcgtcgactggaggaagaagggcgccgttgctgccatcaaggaccagggcggctgtggaagctgctgggctttctcagcaatagcagctgttgaaggcatcaaccagattgttacaggcgacatgatccctctgtccgagcaagagcttgttgactgtgacacttcatacaacgagggatgcaatggaggtctgatggactatgcgtttgagttcatcattaacaatggtggtatcgactctgaggaggactacccctacaaggagagggacaaccgttgcgatgctaacaagaaaaatgcgaaggttgttaccattgatgggtacgaggatgtgcccgtgaacagtgagaagagtctgcagaaggcagttgcaaaccagcccatcagtgttgcgattgaggctggtggcagggcattccagctctacaaatcgggtatcttcaccggaacctgtggaacagcacttgaccatggtgtcgccgccgttggttatggtacagagaacggcaaggactactggctcgtcaggaactcctggggtaccgtctggggagaggatggttacatccggatggagcgtaacatcaaggcatccagtggcaaatgtggtattgccgtcgagccttcctacccgacgaagacgggcgagaaccctcctaaccccggcccaaccccgccgtctcccgccccaccgtcttcggtctgtgacagctacaacgagtgccccgccagcacgacctgctgctgcatctacgagtacggcaaggagtgcttcgcctggggctgttgcccacttgagggtgctacctgctgcgatgatcactacagctgctgccctcataactatcccatctgcaacacccagcagggaacctgcctcgcggccaaggacagcccactgtcagtgaaggctcagaggcgtaccctggccaagcctatcggtgctttctctggcattgcaactgacggcaagaagagcagcgcgtaaacatttgcatcacgacattcgtacagccaacggccatggtgattaacttctgcaaatgatcacctggtgatccacgatcgaaggcgcagcatggcgatagctatgctctctagtatcttctttataatagatgctcctgtacataatcctaaaatcgggttcgatcgtttacagaaccaccaaatttgcttttgcatatgtatatgtaaaactcagctcattccctcacagtttggagctgccattgttattatggaattcatcaagaaacatgataagcagattgcagtattgatggataatctcatgtatgatgcttatatgcc

SEQ ID NO: 868 - DNA, 1387 bp, Brassica rapa
  misc_feature (1331)..(1331): n is a, c, g, or t
aaaagagtaacactagcaagagacgatgaaggttgaaaccaccggtaaggaaatcataaaaccatcttccacaaccccagatgatctccgaactctccaactctctatctatgaccacttcctccctcccatttacacagtcgcctatctcttctacgccaaagatgagttgatctcaccagaacacacttcccacaaactcaagacttctctgtccgaaaccttgaccaaattctaccccctcgcgggaagaatcaacggagtgactgtcgactgtaacgacgaaggagctgttttcgtcgacgctcgtgtcgataactgttccctctctggttttctcgcatctccagatctcaatgccctccaacagttgcttcctctagacgccgtagtcaacccatacgaggctgcttccacctggccaatgttgctcgtgaaggcgacttacttccaatgcggaggcatggccatcggagtctgcatcactcacaaaatcgccgatgcagcctccatgtcgactttcattcggacttggtctgctgaggctcgcggagaggccgggaacacggtgatggatcctaagtttgccgcagcgaatttttacccaccagccaatgagacctataagcttccggtggacgaaaaagccaacaagagaagcagcatcacgaagagattcgtcttcagtgcagctaagttggaagagctcaagaccaaagccactagtccagaatccgcagaccgacctacgcgtgtagagagcgtcaccgcccttctctggaagtgcttcgtctctgcttcattcttagacacttgtggtcgcaaagttctgatccagctcgctgacttgcgctccaagctaccgtcccttctcccagaaagcctgatcgggaacgtcatgttctcctctgtggtattaagtactggtcaaggagaggaagtgaaaattgaagaggccactagagacttacagaaaaagaaggaggacttacaaactatgatccaagacgtcggggatggttcatcttcgatgattggttctaaactagctaatctgatgctcactaattatgcccggatgagctacgagacacacgagccctacacagtgagtagctggtgcaaattaccactttacgaggctagctttggatggggataccctgtttgggttgttggaaatgtggctcccacgtttgaaaacattgccatgttgatcgattccaaggacggacatgggattgaagcttttgtcacgctgcctgaagagaacatgtcatcgctcgagcagaacccggaacttctcgcctttgcttccttgaatccttgtntcgtggtctaaactctaaattatgtaatcaaataaaatctgttgtttcgttaataa

SEQ ID NO: 869 - DNA, 1783 bp, Brachypodium distachyon
cgctccagaatccagatcagtccacagctccccagctgcgccttctccccccacccgattcctcctatttccgagttcgcctgcgcgtgtgggtgcgggcgaagccatggtcggacggagctcgctcccggagggcgctctcttcctcggattcgacagctccacccagtctgtgaaagctactgtgctcaacaatgagttgacaatagtagcttctgaaactgttaattttgactctgagttgccgcactacaagaccgaaggcggagtttacagagaccccacagatgatggccgcattttttcaccaaccataatgtgggtggaggctttggagctggtgcttgagaaattgaaaccaaaaatcgacttcagtaaggttgtggccgtttcgggtagtgggcagcaacatggcagcgtttactggaagaagggcagtgaagctgttctctcttccttggatccgagtaagagcttgctatcccagcttaaggatgccttctctacaatggactcaccgatatggatggacagtagcactactaagcaatgcagagagatagaaaatgcagtcggaggtgcattggagttatcaaagctaactggatctcgtgcccatgagaggtacactgggcctcagataagaaagatataccaaacaacacctgatgtttatgaaagtactgagagaatatctttggtgagttcattcatggcatccatccttgttggatgctatgcaagtattgatgaaactgatggtgctgggatgaacttgatggatataaaccacaggatctggtcaaaaactgctttagaggcaacagctcctgatcttgaacagaagcttggaaatcttgcaccggcatatgcagttgctggtcgaatttctccttattttgtagaaaggcttcagtttgataaaaattgtttggttattcagtggtcaggagacaatcccaatagccttgcaggtttaactctaaatacaccgggtgatcttgcaattagccttggtactagtgatacagtttttgggattactgccgaagctaaaccaggcctggaaggccatgttttccccaaccctgttgaaccggatggttacatggtcatgctttgttacaaaaatggctcgttgacccgggaagatgtgcggaatagatgtgcagaaaaatcatgggatgttttcaacaactatttggagaaaacagcccccatgaatggtgggaaattaggattctactacaaagaccatgaaatcctgcctcctcttccagctggcttccaccgatacgtggtggagaacttcaatgaaaactcacccgacaatctgacggagcgcgaggtgcaagaattcgatccaccatctgaggtgagaggcatcgttgagggccagatgctctcgatgcgaggccacgccgagcggttcggcatgcccaaccctcccaagcggatcatagcaacaggcggggcttcctccaacgagagcatcctcaagctgatcgcgcaggtctttggctgccccgtcttcacagtccagagacccgattcggcttcgcttggtgcggccctcagggcggcccatgggtggctgtgcaaggaggaaggaggctttgttcccatctcctgcatgtacatgagcaacctggagaagacctccctggccgcgaagctcgccgtgccggcccccggagatggggagctgctgaagaagtacacatcgctggtgaagaagaggatggagatcgagaggcgtctggtggagaagatcgggcgcgcc

SEQ ID NO: 870 - DNA, 2265 bp, Zea mays
ggcgttaagcagtggccggactgccggaggagggcagaggtggtcaggtggagttcgccagttcggagtcgccgattgagtcgggagccagagaggccgagaacggatgcttcctgttgcttgctgcgcacctcgtgggctggaagttgggcgtcagctaattttccgctccgcaccgactgcagccccgggcaccgtatccgctctttagcaatcataacaaacatacccgaaggaagccaacagatttcagtatttcacggtcaccagtccctcctacccgcttcccataaaatcttctgatctgtaacgcattcgtcgtcgcccacatccgcttcgctctcttgctcttttagtcccatctcccatcccacctggaggcgaatttcgtctggggaaaaagtcggcggccatggccgggcgagactccctcccggagggttctctcttcctcgggttggacagctccactcaatcactgaaagctacggtgctcaataatgagctcacaatagtagcttctgaaattgttaattttgactctgaattgccacactacaaaactgaaggtggggtgtacagagacccagcagatgataggcacattttttcaccaaccattatgtgggtggaagctttggaggtgctgcttgagaagctaaaaccaaagatcaacttcggtaaggtagtggctgtttctgggagtgggcagcaacatggcagtgtttattggaagaagggcagccatgctgtgttatcctccttggatgctagtaaaagcttgttatcgcaactcaaggatgcattttctacaatgaactcaccattatggatggatagtagcacaacaaagcaatgcagagaaatagagaatgcagttggaggtgcactggagttagcaaaactgacaggatctcgtgcgtatgaaagattcactggcccccagataaggaagatctatcagacagagcctgatgtttatgaagataccgagagaatatctttggtgagctcgttcatggcatctatccttgttggaagctatgcaagtattgatgaaactgatggtgcggggatgaacttgatggatatcaagcaaaggacctggtcaaagtctgctttagaggcaactgctcctggacttgaagcaaagcttggaaatctagcaccagcatattcagctgctggccgaattgctccttattttgtagaaaggtttcagtttgataagaactgtttggtcattcagtggtctggagataatcctaatagccttgcaggtttaactctgaatacccctggtgatcttgccattagccttggtactagtgatacagtattcgggataacaacagaagctaaaccaagccttgaaggacatgttttccccaatcctgttgagcctaatggttatatggtcatgctatgctacaaaaatggctccttgaccagagaagatgtacgaaatcgctgtgcagacaaatcatgggacgtttttaacagctatctggagaaaacgccccctctaaatggtgggaagataggattctactacaaagaccatgagatcctccctccacttccagtgggtttccatcggtacactgtcgaaaacctcaacgacgtctcatcagacgctctgttggagcgtgaagtggaagaacttgacccaccgtccgaggttcgtgccatcattgagggccaaatgctgtcgatgcgaggccacgccgagaggtttggcatgccgaaccctcccaaacggatcatagcaaccggcggggcatcctccaacgaaagcatcctcaagtcagtcgcgcagatcttcggctgccctgtcttcacagtccagagacctgattcggcatcgctgggcgcagcgctgagagctgcccacgggtggctgtgcaacgcgcaaggtagcttcgtccccatctcgtgcctgtaccagggcaacctggagaagacctcccttggctcgaagctggcagtcccggccggcgacaaggagcaggaccgggagctcctccagaagtacaccatcctgatgaggaagagaatggagatcgagagacgcctggtggagaagattgggcgatcgtagggataaaaaaatcatgaagcgctgctgaggctggcaggaccgaataatttgtgaataagtatggattatctcgatcgtaggaaacaaattcatggcaattcgtgaataaaagtggattatcgtccataacgcagaactttcttaaaggtcagagcttaagtttt

SEQ ID NO: 871 - DNA, 1982 bp, Pseudoroegneria spicata
  misc_feature (9)..(10): n is a, c, g, or t
  misc_feature (47)..(49): n is a, c, g, or t
cgatccctnngcctccttccctcccggctcgcgtcgcctgccgtcgnnnccggaggaggggattcgcgtgggcgccgacgaggcggactggtcacctgcagccatggtcgggcgcagctccctcccggatggggccctcttcctcggactggacagctccactcagtctgtgaaagctactgtgctcagcaatgagttaataatagtcgcttctgaaactgttaattttgamtctgagttaccgcactacaaaaccgagggtggggtctacagagatcctacagatgacggccgtatatattcaccaacaataatgtgggtggaggctttggaactgctgcttgagaaattgaaaccaaagatcaatttcagtaaggttgtggccgtttcagggagtgggcagcaacatggcagcgtttattggaagaagggcagtcaagctgtactgtcctccctggatcctaktaagagcttrgtatcccagcttaaggatgccttttctaccatggactcgccaatatggatggatggtagcactaccaagcaatgcagagaaatagaaaatgctgtcgggggagcattggagttatctaagctgacagggtctcgtgcctatgagagattcactgggccccagatacggaagatctaccaaacagcaccccatatttatgaaaatactgagaggatatctttggtgagctcattcatggcatctatccttgtcggatgctatgcaagtattgatgaaactgatggcgctgggatgaacttgatggatataaacaagaggacctggtcaaaagctgttttagaggcaactgctcctgatcttgaacagaagctgggaaatctggcaccggcatatgcagctgcaggtcgcatttcttcatattttgtagaaaggcatcagtttgacaagaactgtttggttattcagtggtcaggtgacaatcccaatagccttgcaggtttaacactgaatacacctggcgatcttgcaatcagccttggtactagtgacacagtttttgggattactgccgaagctaatccaagccttgaaggccatgtttttcccaaccctgttgaaccggatggttacatggtgatgctatgttacaaaaatggctcattgacccgtgaagatgtgcggaatcagtgcgcagaaaaatcatgggatgttttcaacaactatctagagaaaacaccccctctgaatggcgggaagttaggattctactacaaagaccatgaaatcctgcctcctcttcctgttggtttccaccgatacattgtcgaaaatttcaatgacggctcatctgacaatctgaaggagcgtgaggtgcaagaattcgatccacaatctgaggtccgtgccatcgtcgagggccagatgttgtcgatgcgagggcatgccgagcggtttggcatgcccaatcccccgaagcggatcatagcaaccggtggggcatcctccaatgagagcatcctcaagttgatcgcgcaaatctttggctgccctgtcttcacagttgagagacccgattcggcctcgctgggtgccgctctgagagctgctcatgggtggctgtgcaaggaggaaggaggctttgttcccatctcccgcatgtacatgggcaacctggagaagacctcactgggcrcaaagctggcggtcccggcgccgggggaggagggcagggagctcctgaagaagtacaccgtgctcatgaagaagagrawggagatcgagagacgcctggtggagaagatcgggcgtgcgtagagatactaggacatatcatatggcgctggggccatatgggcatagggattataggaaatatataataaagtcactggatcaactgttaatgctcgctggtgttgtgcgcgtcagccgtgaagaatgtgccgcggtcctgtgcacgaataatttgtgatgcgttcgttatgaaaaactgtcacatgtttctaca

SEQ ID NO: 872 - DNA, 2500 bp, Oryza sativa
aaaacgctggccccacctgtaagtgagcattggatagatagattatctgacagacttcctcaacgaacgtagcgatgaataccccaacagaatgttgcgcgggcgcttgctaaatgctaatccatcatcattttatgcgctaatccactccagatcacgccgctaatccttatccaaacgaattaacaacaaatcagtcgcgcgtttgaaacgagtccactccacctccatccagatcagtgtatataaaccgccgcgccgtttgttcgtgctgattctctctctctctctaatcagtagtaccccagatcagtttgttgctttgctgcttcttccggttccaatctgagaggggggattcgcgcgggaggcgaggcgaggcggcagccatggtggggcggagctccctcccggagggttccctcttcctcggattcgacagctccactcagtccctaaaagctaccgtgctgaacaacgaattgataatagtagcttcagatattgttaactttgattctgacttaccgcactacaaaacagaaggtggtgtttacagagatcctgcagatgatggccacatattttcaccaacaataatgtgggttgaagcctttgaattgctacttgagaagctaaagccaaagatcaactttagcaaggttgtggccatttcagggagtgggcaacaacacggcagtgtttattggaagaagggtagtcatgcggtgttgtcttccttggatcctactaagagcttgttatcccagctgaaggatgccttttctaccatggactcaccaatatggatggacagtagcacaactaagcaatgcagagaaatagaaagtgtagtaggcggcgcattggagctatcaaagttgacaggatctcgtgcctatgagaggttcactgggcctcagatccggaagatataccgaacagttccgcaagtttatgatgatactgagagaatatctttggtgagttcgttcatggcatcaatcctggtggggaactatgcaagtattgatgagactgatggtgctgggatgaacttgatggatataaaccagagaacctggtcaaagactgttttagaggcaacggctcctgggcttgaagagaagcttggaaagttggcaccagcatatgcagtagctggtcgaattgctccttattttgtagaaaggcttcagtttgataagaattgcttagttattcaatggtctggagacaatcccaatagccttgcaggtttaactctgaatactcctggtgaccttgcaattagccttggtactagtgatactgtttttgggataactgctgaagctaaaccaagtcttgaaggccatgttttccctaaccctgttgaacctgatggttatatggtgatgctgtgctacaaaaatggttcattgacccgagaagatgtgcggaacagttgcgcggagaaatcctgggatgttttcaacagttatctagagaaaactccacctctaaatggcggaaaattaggattctactacaaagaccatgaaattctgccgccacttccagttggcttccatcgatacattgttgaaaacctcaatgatgtcacatccaacaatctggtggaacgtgaggtggaagaatttgatccaccatctgaggttcgcgccataatcgaaggccagctgctgtcaatgcgaggccatgccgagagattcggcatgcctaaccctcccaagcggatcatcgcaaccggtggcgcatcctccaacgagcgcatcctccactcaatcgcgcagatctttggctgtcctgtctttacagttcagagacctgattctgcctcgcttggcgcggcactgagagctgcccatggctggctgtgcaatgaggaagggagcttcgtccccatctcctgcatgtaccagggtaacctggagaagacctccttgggtgcaaagctcgccgtctcaaccggagagggtgtggaggacaaggagctcctggagaagtacacggtgctcatgaggaagaggatggagattgagaggcggctggtggagaagattgggcgcgcgtaggtagcagcattgcaaagctgctgtcctcgagtcacagttaattagagggaaatgaaatcattggtagaaacttatttataatatatagttagtagtgtatcaagatcatgttattatgttcttgtgcacggaataaataataaatgtaaatttgcaaactaaacaagctcgtctgttctttctgttcatcaattagatgaaactttaaatcttctttaaattctcatagatgaaacttgtttgggtggcttaaattctcataggggcatcttctacttttccaatttccaggtttatgattctgtcctcgttttttagctaaagcttatgttttgccccctttccgttaagaagacttaatggtgttaaaattcatgtcaagcttgtgcctgaccacttattttaattgaataatatatgtg

SEQ ID NO: 873 - DNA, 2209 bp, Sorghum bicolor
actccagtaccagcaatcggtaacaaacatccttatccgacggaagccaacaacggatttgacggtccccagtccactcctcgtctttgccgatcgccgctcgctttccatatatctctcccagctccgtttgatccgtagcgcactcgtccgtcgtcgtcgctcccactccgcgtcgccccactctccctctcctcgtcgaactcgcctggctcctagtcccgtcccacttggagcgaattttgcccggggtgagagaggcggcggccatgtcggggcgaggctctctgccggagggctcgctctttcttggattggacagctccactcaatcgctgaaagctacggtgctcaacaatgagttaacaatagtagcttctgaaattgttaattttgactctgaattgccgcactacaaaactgaaggtggggtgtacagagaccccgcagatgatggccacattttttcaccaaccattatgtgggtggaagctctggagctgctgcttgagaagctaaaaccaaagatcaacttcggtaaggtagtggctgtctcagggagtgggcagcaacatggcagcgtttattggaagaagggcagccatgctgtgttgtcctccttggatgctagtaagagcctgttatcgcagctcaaggatgcattttctacgatgaactcaccgatatggatggatagtagcacaactaagcaatgcagagaaatagagaatgcagttggaggtgcactggagttagcaaaactgacaggatctcgtgcctatgaaagattcactggtcctcagataaggaagatctatcagacagaacctgatgtttatgaagatactgagagaatatctttggtgagctcgttcatggcatctatccttgttggaagctatgcaagtattgatgaaactgatggtgcggggatgaacttgatggatataaaccaaaggatctggtcaaaatctgttctagaggcaactgctcctggacttgaagcaaagcttggaaatctagcaccagcgtattcagctgctggccgaatcgctccttattttgtagaaaggtttcagtttgataagaactgtttggtcattcagtggtctggagacaatcctaatagccttgcaggtttaactttgaatactcctggtgatcttgccattagccttggtactagcgatacagtattcgggataactgcagaagctaaaccaagcattgaagggcatgttttccccaatcctgttgaacccgatggttatatggtgatgctatgctacaaaaatggctctttgaccagagaagatgtgcgaaatcggtgtgcagacaaatcatgggatgtttttaacaattatctggagaaaacaccccctctaaatggtggaaagttaggattctactacaaagaccatgaaatccttccaccacttccagtgggtttccatcggtacgctgtcgaaaacctcaatgacgttacatcagacactctgttggagcgtgaagtggaagaatttgacccaccgtctgaggttcgtgccatcattgagggtcaaatgctgtcaatgcgaggccacgccgagaggtttggcatgccgaaccctcccaagcggatcatagcaaccggtggggcatcctccaacgaaagcatcctcaagtcaatcgcccagatcttcggctgccctgtctttacagtccagagacctgattcggcttcgctgggggcggcgctgagagctgcccacgggtggctgtgcaacgcccaaggcagcttcgtccccatctcatgcctgtaccagggcaacctggagaaaacctctcttggctcgaagctggcggtgccggccggcgacaaggaggaggaccgggagctcctccagaagtacaccctcctgatgaggaagaggatggagatcgagagacgcctggtggagaagatcgggcgatcataggaaaatcacgaatttagcacttttgaagctgccaggaccgaataatttgtgaataactgttgattatcatcctttatacgcaagctctcttaggtgagagtcagtattggttctgattttataagcctggctctgtggctcagctgagaaaaatttgtgctgggactctggacatcgttgtgagacacgcacaaaacctttgaaagagacagcacttcgcaagggtaaacgaatcttaaaaatctttgtta

SEQ ID NO: 874 - DNA, 2600 bp, Panicum virgatum
cgccagtccactcctcgtcctctagatcgccggtatataatccctcttccggctccaccgtcgattcccccgcccctgctctgctctgctctgccatggctgccgggggggagctcggattccggtgaggatgaggcttgccggcggtgtgggttaggaggagcagcacgagggcagcgagatctaccccgcggtgccttcgattggggctggagcggcggggaagggtgtcgccggcggagcagcaggcggcggcgggtggggcggcgttccggcctcagtccggctgcggcagggctggacgagggcgggagagcgggccccgcgtcgtagcgcacctcctctacatccccttgatttggcgcgtggagggcgacacagaaccatagcgttcgccgctgcgggcttttttacggtaaacccgtactgcagatgaagaagcggacggcttaccgtatccagtgcgcatagcctgatccgcggcgcagtcgtttgtcgtcttcgccttccggatcgctcttgctcgtagttccgtccctgcttgagcgaatttgtagcgggggactagagacggcggccatggcgggccgaggctccctcccggagggctctctcttcctcggattcgacagctccactcagtcactgaaagctactgtgctcaacaatgagttaacaatagtagcttctgaaattgttaattttgactctgaattgccgcactacaaaactgaaggtggggtgtacagagattccactgacgatggccacatattttcaccaaccattatgtgggtggaagctttggagctgctgcttgagaagttaaaacccaagataaacttcagtaaggttctggccgtctcagggagtgggcagcaacatggcagtgtttactggaagaagggcagcaaggcagttctttcctccctagattccagtaagagtttgttattgcagctcaaggatgccttttctacaatgaactcaccaatatggatggacagtagcacaactaagcaatgcagagaaatagagaatgcagtcggaggtgcattggagttagcaaaactgacaggatctcgtgcatatgagagattcactggtccccagatacgaaagatctatcaaacagagcccaatgtttatgaagataccgagagaatatctttggtgagctcattcatggcatcaatccttgttggaagctatgcaagtattgacgaaactgatggtgctgggatgaacttgatggatataaaccagagaacctggtcaaagactgttttagaggcaactgctcctgaacttgaagcaaagcttggaactctagcaccagcatattcagctgctggccagattgctccttattttgtagaaaggtttcagtttgataagaactgtttggtcattcagtggtctggtgacaatcctaatagccttgcaggtttaactctgaatactcctggtgatcttgccattagccttggtactagcgatacagtatttgggataacagcagaagctaaaccaagtcttgaagggcatgttttccccaaccctgttgagcctgatggttacatggtgatgctatgctacaaaaatggctccttgaccagagaacatgtgcgaaatgagtttgcagagaaatcatgggatgttttcaacggctatctagagaaaacgccccctctaaacggtggaaagttaggattctactacaaagaccatgaaatcctgccaccacttccagttggtttccatcggtacattgttgagaaccttgatgatgcctcatctgacaatcttatagagcgtgaagtggcagaattcaatccaccatctgaggtccgtgccatcattgaaggtcaaatgctgtcgatgcgaggccatgctgagagatttggcatgccgaaccctcccaagcggatcatagcaaccggtggggcatcctccaacgagagcatcctcaagtctattgtggaaatctttggctgtcctgtcttcacagttcagagacctgattcggcctcactgggtgcagcgctgagagccgcccatgggtggctgtgcaacaccaaaggaagcttcgtccccatctcgtgcttgtacgagggcaacctggagaagacttcccttggctcgaagcttgcagtcccagccggagagaaggaggaagatagggagctactaaagaagtacaccctgctgatgagtaagaggatggagatcgagagacgcctggtggagaagattgggcgggcataggaaagttgtgaagcatcgctgcacctgtcggggcacgaagaattgtgaataatagtgactatcatctcttattgcaactctgcaaggagaagtgttctaagcactctgttttttacaacctggttcagcaaagcaaatttgccaagattcgaaccagtgcattgttggcattattttaactttaaaagaaaaactttccattcctttagctaccagttgtaacagcccatagccgccgatgagatcaaatcgggacgtgagcaagattacaagggatacagatgatctcgataacttgaggaggaagatgttcttccatttcccctttgctt

SEQ ID NO: 875 - DNA, 936 bp, Brachypodium distachyon
tcccacggcagcttctataaatccacccatctgaagcaaagctcactactacagctgcatccatcaagcaaccaagatcattcacaaagctagctagctagcgttcgagtcagacacaaattacaaatggcagctgcgacggcgaagaagagcgggagcgagatgggggtggttcttggtctggacgtgccgcggtacatgggccgctggtacgagatcgcgtcgttcccaaacttcttccagccccgggacgggcgggacacgcgcgccacgtacgagctcatggaggacggcgccacggtgcacgtgctcaacgagacctggagcaaagggaagcgcgactacatcgagggcaccgcctacaaggccgacccgtccagcgaggaggccaagctcaaggtcaagttctacgtgccccccatcctccccatcatccccgtcgtcggcgactactgggtcctctacgtcgaccccgactaccagtacgccctcgtcggcgagccccgccgcaaaaacctctggattctgtgcaggaagacgcagatcgaggaggaggtgtacgagcagctgctggagaaggccaaggaggaaggctacgacgtggccaagctgcacaagacgccgcagagcgacccgccgccggagagcgacgccgcgcccgccgacaccaaagggtcctggtggttcaagtcgctctttggtaaatgattcagtaaactggtgctggaagagatatcatgtgtgcttttatcgtagtatacataatattagttgatcaatctgtaccgtagcgaataaatgggactctcgatcggaaaacaatctttgctgtatgtatatagaatatttgtgtgccttcctcctgttatggtggagctatactgtcaatctgtgtttggagaaaatgaagctagtgaactaatacagttatactgc

SEQ ID NO: 876 - DNA, 908 bp, Festuca arundinacea
ggcacgaggctgaaaccgaaaccctcccacacatcctataaatccacccacctcatctgagctcattacagckgcacsaagcaaccgatcgagatcgaacatccagctagctagaagawacarcatacaatggcggcgaaggtgaagagcgggagcgagatgggcgtggtgctggggctggacgtkgcgcggtacatggggcggtggtacgagatcgcstccttccccaacttcttccagccgcgcgacgggcrggacacgcgggcgacctacgagctgatggaggacggcgccacsgtgcacgtgctsaacgagacgtggagcaaaggsaagcgcgactacatcgagggcaccgcctacaaggccgacccggccagcgacgaggccaagctcaaggtcaagttctacgtcccgcccttcctccccatcatccccgtcgtcggcgactactgggtcctctacgtcgacgacgactaccagtacgcgctcgtcggcgagccccgccggaagagcctgtggatcctgtgcaggaagacgcacatagaggacgaggtctacagccagctgctggaaaaggccaaggaggaaggctacgacgtctccaagctgcacaagacgccgcagagcgacccgccgccggagagcgacgcagcccccaccgacagcaaagggacatggtggttcaartcgctcttcggtaaatgatcgaatmggccggtgctggaacagaacgatgcaastgtttatctttaccatagcagtattagttcatctatctatctttacsgtggcgaataaatgggaatcaaagaccagtagtagtctcttgttatagaacatcgatccgtgtgtgtttcttgattattcaggtgtttctgttctgtatgatgtagctggtatatatatgt

SEQ ID NO: 877 - DNA, 834 bp, Leymus cinereus x Leymus triticoides
tcctatatatccacccatctcaagctcactacggcttcatccaagcaaccgagaccagctcacgaatccaccgatcaggaagcgagacacggaccgagcagctagcgcgcagcgatcgacaatggcaaccaagaagagcgggagcgagatgagtgtggtgctggggctggacgttgcgcggtacatggggcggtggtacgagatcgcgtccttccccaacttcttccagccgcgcgacgggcgtgacacgcgggcgacctacgagctcatggaggacggcgccacggtgcacgtgctcaacgagacgtggagcaaagggaagcgcgactacatcgagggcaccgcctacaaggccgacccggccagcgacgaggccaagctcaaggtcaagttctacgtcccgccgttcctccccatcatccccgtcgtcggcgactactgggtcctctatgtcgacgacgactaccagtatgccctcgtcggcgagccccgccggaaaaacctatggatcctgtgcaggaagacgcacatcgaggaggaggtgtacaaccagctgctggagaaggccaaggaggaaggctacgacgtggccaagccgcacaagacaccacagagcgacccgccgccggagagcgatgctgcgcccaccgacagcaaggggacctggtggttcaagtcgctctttggtaaatgataggttcatccgtctatatatgcagttggccggcactgtaacagccatgatgtgtgtttatctttatcttagtgtattagctaatctctacggtggcgaataaatgggattcaatgatatatatggtactaccgttttta

SEQ ID NO: 878 - DNA, 1138 bp, Zea mays
aataaacgacccccgcaaccaaagacctctccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgaggacgtgtacaaccagctggtggagcgggccaaggaggaaggctacgacgtgagcaagctgcacaggacgccgcaggacgacccgccgccggagagcgacgccgcgcccaccgacaccaagggggtgtggtggttcaagtcgctcttcgggaaatgactgcccgtcaccgcacgcgcgcgtgctccggtactgtgcttgcagttgcagcaaataaaaccaggcctgagtgagtgaggattggtattttagctttgtagtatctgtctcgctatctgtgtgtgtggaactgtggactgtgctgttacgttatacgtgcatgtatttttaagatttctctagctaattgcatcgatcggcgaggtagtcactcaggggattatgtgagtttgcaaaaagccaaaaaagtctatacgcgtatagaatttgcttgcttgcttgacagccagccaactgttgtcgaatgatagttctggcgttgctaactgtcaggcttttgaaagcgagtcaaagacggtccagctcgcgaaaggt

SEQ ID NO: 879 - DNA, 742 bp, Saccharum officinarum
tccacatcaaacaaccccaaagccctctcccctttctatatatccatccatccatcgcaagcaagctccaaagcaagcacctgcaactgcaacaaagccagcggcagtcaccggattgtcacgaaaagcacacagtaacccataccacccaccagcaacaatggcggcggcagaggggaagaagagcggcgggcagatgacggtggtgcggggcctggacgtggcgcggtacatggggcggtggtacgagatcgcgtcgttcccgtccttcttccagccccgggacggccgggacacgcgcgccacctaccggctgctggaggacggcgccacggtgcacgtcctcaacgagacgtggagcaagggcaagcgcgactacatcgagggcacggcctacaaggccgacgccagcagcgacgaggccaagctcaaggtcaagttctacctcccgcccttcctccccatcatccccgtcgtcggcgactactgggtgctctacgtcgacgacgactaccagtacgcgctcgtcggcgagccgcgccgcaagaacctctggattctgtgcaggaagacgagcatcgacgaggaggtgtacaaccagctggtggagcgggccaaggaggaaggctacgacgtgagcaagctgcacaggacgccgcaggacgacccgccgccggagagcgacgccgcgcccaccgacaccaagggagtatggtggttcaagtcgctctttgggaaatga

SEQ ID NO: 880 - DNA, 935 bp, Panicum virgatum
cattcgcatcatcacctgcaacgagcaatcaatccccagattttcaccgccggaaacaggcaaggccgtaactagcagctcatcgaccggcggccagcagctagcaatggcagcggcggcggaggggacgacggcgaagaagagcggcggcgagatgacggtggtgcgcgggctggacgtggcgcggtacatggggcgctggtacgagatcgcgtcggtcccgtccttcttccagccccgggacggccggaacacgcgcgccacgtacgcgctgcaggaggacggcgcgacggtggacgtgctcaacgagacgtggagcaagggtaagcgcgactacatcgaggggacggcgtacaaggccgaccccgccagcgacgaggccaagctcaaggtcaagttctacctcccgcccttcctcccaatcatccccgtcgtcggcgactactgggtgctctacgtcgacgacgactaccagtacgcgatcgtcggcgagccgcgccgcaagaacctctggatcctgtgcaggaagacgagcatcgacgaggaggtgtacaaccagctggtggagcgggccagggaggaaggctacgacgtgagcaagctgcacaggacgccgcaggacgacccgccgccggagagcgacgccgcgcccaccgacaccaagggggtctggtggttcaagtcgctcttcggcaaatgatcgtccatcacattgctgcgcttgcttgctgcttgttgcttgctagctagctagtacactagtgaatctatctgctataatccgtgccgcgcgcggcgaataaaattggattgctgctgaattcttctccgtctgctgttagtatacctatgtatgttcttgttgcgttatacatgtgcttggaatttggaggaatcgatggagttaattagactgtactcttattagttgtttt

SEQ ID NO: 881 - DNA, 1074 bp, Panicum virgatum
cacttggcaagcgttccagagccctccacgccattctcctcgcacctgcaccttatcctcttcttgctcccctcctctctccgtccagcgagcaacctgcaatcccccaaacccctcaccgagatcatccctcccggcccttctatatatccatcaccagctcatcccattcgcatcatcacctgcaacgagcaatcaatccccagatttttcacaggcggaaacacgcaaagccgtaactagcagctcatcgaccggctagcaatggcggcggcggcggcggcggaggggacgacgacgaagaagagcggcggcgagatgacggtggtgcgcgggctggacgtggcgcggtacatggggcggtggtacgagatcgcctcggtcccgtccttcttccagccccgggacggccggaacacgcgcgccacctacgcgctgctggaggacggcgcgacggtgcacgtgctcaacgagacgtggagcaagggcaagcgcgactacatcgaggggacggcgtacaaggccgaccccggcagcgacgaggccaagctcaaggtcaagttctacctcccgccgttcctccccatcatccccgtcgtcggcgactactgggtgctctacgtcgacgccgactaccagtacgcgctcgtcggcgagccgcgccgcaagaacctctggatcttgtgcaggaagacgagcatcgacgaggaggtgtacagccagctgctggagcgggcgagggaggaaggctacgacgtgagcaagctgcacaggacgccgcaggacgacccgccgccggagagcgacgccgcgcccaccgacaccaagggggtctggtggttcaagtcgctcttcggcaaatgatcgtccatcgcgtgctgcgctttgctctgcttctcgcttgcttgctagctagctagtacactagtgtatctctctgctataatccgtgccgcgcgcggcgaataaaattggattgctgctgaattcgtctccgtctgctgttatacctatgtgtatgttcttgttgcgttatacatgtgcttggaatttggaggaatcgatggagttaat

SEQ ID NO: 882 - DNA, 968 bp, Triticum aestivum
tttctcgacccaacgctacctcgattggggcacgaggacaactgaactkkscctaamgrgytgmwagcttgcctctgaagccctctcacacctcccatatatccacctatctcaagctcactacaacttcatccaagcaaccgtgatcagttcacgaatccacctaaagcgagacacagaccgagcagcgaccgggcggcgatagacgatggcggccaagaagagcgggagcgagatgggcgtggtgctggggctggacgttgcgcggtacatggggcggtggtacgagatcgcgtccttccccaacttcttccagccgcgcgacgggcgcgacacgcgggcgacctacgagctcatggaggacggcgccacggtgcacgtgctcaacgagacgtggagcaaagggaagcgcgacttcatcgagggcaccgcctacaaggccgacccggccagcgaggaggccaagctcaaggtcaagttctacgtcccgcccttcctccccatcatccccgtcgtcggcgactactgggtcctctatgtcgacgacgactaccagtatgccctcgtcggcgagccccgccggaaaagcctatggatcctgtgcaggaagacgcacatcgaggaggaggtgtacaaccagctgctggagaaggccaaggaggaaggctacgacgtggccaagctgcacaagacgccgcagagcgacccgccgccggagagcgatgccgcgcccaccgacagcaaagggacctggtggttcaagtcgctctttggtaaatgatagattcatccgtctgtatatgcagttggccggcactgtaacagccatgatgtgtgttcatctgtatcttagtgtattagctattctctatggtgtcgaataaatgggactcagtgatatggtatactaccgttttccaggaaaagactccatgacgagctttatcaactgggacagcctacgtgcc

SEQ ID NO: 883 - DNA, 796 bp, Triticum aestivum
ccgagactagctcacgaatccaccgatcaggaagcgaggcacagaccgaacagctagcgcacggtgatcgacgatggcggccaagaagagcgggagcgagatgggcgtggtgctggggctggacgttgcccggtacatggggcggtggtacgagatcgcgtccttccccaacttcttccagccgcgcgacgggcgcgacacgcgggcgacctacgagctcatggaggacggcgccacggtgcacgtgctcaacgagacgtggagcaaaggcaagcgcgactacatcgagggcaccgcctacaaggccgacccggccagcgaggaggccaagctcaaggtcaagttctacgtcccgccgttcctccccatcatccccgtcgtcggcgactactgggtcctctatgtcgatgacgactaccagtatgccctcgtcggcgagccccgccggaaaagcctatggatcctgtgcaggaagacgcacatcgaggacgaggtgtacaaccagctgctggagaaggccaaggaggaaggctacgacgtggccaagctgcacaagacgccgcagagcgacccgccgccggagagcgatgccgcgcccaccgacagcaaagggacctggtggttcaagtcgctctttggtaaatgatggattcatccgtatgtatatgcagttggccggcactgtaacagccatgatgtgtgttcatctgtatcttagtgtattagctaatctttatggtgtccaataaataaatcagactcagtgatatagtactaccgttttcaggaaaagact

SEQ ID NO: 884 - DNA, 1056 bp, Hordeum vulgare
agagggggagagagagagagagagagagagagagagagagagagagagagagagagagagagagagagagagagagtggggttttgggattttagcctccccgccgccgccgccgcccagcgaattcgacaagctcccgagctcgccggatccgatggccgtcaccttctccgacctccactccgccgacgggctcaaggccctcgaggcgcacctcgccggcaagacctacatctccggcgatgcgatcaccaaggacgacgtcaaggtgttcgcggcagtgcccgtgaagcccagcgcggagttcccaaacgctgcccgctggtacgacgccgttgccgcggctgtttctccgaggttccctggccaggcctctggggtgagtgcatcatcggctcctgctgcagctgctcctgctgcttccaaggatgaagatgatgatgatgacatggatctgttcggcgatgagaccgaggaggacaagaaagcagcagctgagcgtgaggctgccaagcctgcaaagaagaaagaaagtggcaaatcctctgtcctcatggacatcaagccatgggacgatgagactgacatgaagaagttggaggaggctgtccgcggtgttcaaatggagggtctcacctggggtgcatctaagctcatgcctgtgggttatggcatcaagaagctccagatcatgctgacgatcattgatgacctcgtgtctgtcgacactctcattgaggaagtgctctgcgaggcgcccatcaacgagtacgtccagtcgtgtgacatcgttgccttcaacaagatctagaatctttgtccgctcacctgttgctgctggattcttggtactgggattggtctgtctctgtcgtcccatttagttacccctcttacagaaatgctactggttttgtttttgagtcaagccctggtcttgaatgtctgttacctttaaatagttgaattgctgagcagtttgtaatggcgaaacatctatcatggggagtaaactcagtcttttctaactgtgataggattattcagatggactcg

SEQ ID NO: 885 - DNA, 907 bp, Brachypodium distachyon
cttcctcctctcggtctctagggttttgggattttagcctccgccgccgccgccgccgcaccagccgttgacgagtcctgcaaccccgccggacccgatggccgtgtcgttctccgagctccacaccgccgacgggctcaaggccctcgaggcgcacctcgccggcaagacctacatctccggggagcagatcagcaaggacgacgtcaaggtgttcgcggcggtgccttccaagcccagcgcggagttccccaacgctgcccgctggtatgacactgtcgccgcggctcttgcgtcaaggttcccgggcaaggcttctggagtgaacctgtctgcagcaggttcttcatcgggccctgctgacgcatccaaggatgctgaggatgatgatgacttggatcttttcggtgatgagaccgaggatgacaagaaagcagcagaggagcgtgtggctgccaagcctgccaagaagaaagaaagtggaaaatcatctgtgctgatggatgtcaagccatgggatgacgaaactgacatgaagaagttggaggaggctgtccgcagtgttcaaatggagggcctcacttggggtgcatcaaagcttgttgccgtgggttatggcatcaagaagctgcagatcatgttgacgattgtggatgatctcgtgtcagtcgacaccctcatcgaggaggtcctctgcgaggagcccatcaacgagtatgtccagagctgtgacattgttgccttcaacaagatctagagtctcggtcaatctgcttgttgctgctgggttcttggaagcgggattggctgtttgatctggaatcatattccatcccatcttgttaccctcatacagaaatgctactggttttattttttgagtgatcttggatgtctgctatcttta

SEQ ID NO: 886 - DNA, 1029 bp, Cenchrus ciliaris
gtttgggattttagccgccgccgccgctcctcaccctctcgagaagtcgcagccgacgtagtcctcgccggatccgatggccgtgactttctccgatctccacaccgccgacgggctcaaggccctcgaggcgcacctcgctggcaagacatacgtctccggagatgtgatcagcaaggacgacgttaaggttttcgcggcggtgccktcgaagcctggtgccgagttccccaatgctgcccgctggtacgagaccgtttcsgcggcgctcgcctcaagattccctggcaaggctgttggtgtgaatctgcctggagcgggagcagcagctgctcctgcggctgaggctgccaaggaggaggatgatgatgacttggatcttttcggtgatgaaaccgaggaggacaagaaggctgcagatgagcgtgcggctgccaaggcttctgccaagaagaaagaaagtggcaagtcctctgtcctcatggacgtgaagccgtgggatgatgaaactgacatgaagaagcttgaggaggctgttcgcagtgtccagatggagggtctcacctggggagcatccaagcttgtrcccgttggttatggcatcaagaagatgaccatcatgttgaccattgtggatgatctcgtgtctgttgacagtcttattgaggaccatcttacggcggagcccatcaacgagtatgtccagagttgcgacattgttgccttcaacaagatttaaatcccagttattgtgcaccatacttgctgctggggtctaggacctggtcttggttgcgacgacaagaactcaagtttctcgtgggatgcgagctcttatctcttttagttactttgctatagaatgtcagtcttgagtctattgttgagtgctgccaggtttttgaatatccgtttgtcttaagaatagttgaactgctgggtggtgaaacattttgatgtgtctaaaagtacaacagttatgtttgcaatgctagttttgaatgaggatgggaaacgtgtttaccgtta

SEQ ID NO: 887 - DNA, 797 bp, Gossypium hirsutum
gattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggacgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagttt

SEQ ID NO: 888 - DNA, 1037 bp, Leymus cinereus x Leymus triticoides
ttttagcctcagccgctgccgccgccgctcagcgaattcgacaagcccccgagctcgccggatccgatggccgtcacgttctccgacctccacaccgccgacgggctcaaggccctcgaggcgcacctcgccgggaagacctacatctccggcgatgggatcaccaaggacgatgtcaaggtgttcgcggcagtgcccgtgaaacccagcgcggagttcccgaatgctgcccgctggtacgacgccatcgccgcgactgtttcttcaaggttccctggccaggcctctggggtgagtgcatcatcggctcctgctgcagctgctcctgctgcttcyaaggatgaagacgatgatgatgatgacatggatctgttyggygatgagaccgaggaggacaagaaagyagcagctgagcgtgcrgctgccaagcctgcaaagaagaaagaaagtggcaaatcctctgtcctcatggacatcaagccatgggacgatgagactgacatgaagaagttggaggaggctgtccgtggtgttcaaatggagggtctcacctggggtgcatctaagcttatgcctgtcggttatggcatcaagaagctccagatcatgctgatgatcatcgacgacctcgtgtctgtcgacacacttattgaggaagtgctctgtgaggcgcccatcaacgagtatgtccagtcgtgtgacatcgttgccttcaacaagatctagagtctttgtatgtccagtcgtgtgacattgttgccttcaacaagatctagagtctttgtccgcccacctgttgctgctggattcttggtactgggattgattggtctggaaaacatgatgtcgtcccatttagttacccctcttacagaaatgctactggttttgtttttgagtgatgtcctggtcttgagtatctgttacctttaaatagttgaattgctgagcggtttgtaatggcgaaacatctatcatggggagtaaaatcagtctttgatactgtgatagggtgatccagatgttgtttacagtta

SEQ ID NO: 889 - DNA, 945 bp, Zea mays
cctctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaacagcggta

SEQ ID NO: 890 - DNA, 1032 bp, Zea mays
atagggagagaggagagagtctgcaggatccagcagactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgctgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagtttatcccttctagtctattacagaaacgttgttcggagctgagtctattataaacatcttggtctgagtttattgttgagtggtgccagtttttttcaatatacatttatcttaaaaacagcggtactgatgttttttgtttctaaagttaatgagtttgcaatggttctgagtcaa

SEQ ID NO: 891 - DNA, 996 bp, Pseudoroegneria spicata
  misc_feature (4)..(4): n is a, c, g, or t
tagngctttgggattttagcctccgccgccgccgccgccgcccagcgaattcgacaagctcccgagctcgccggatccgatggccgtcacgttctccgacctccacaccgccgacgggctcaaggccctcgaggcgcacctcgccggcaagacctacatctccggagatgggatcaccaaggatgatgtcaaggtgttcgcggcagtgcccgtgaagcccagcgcagagttcccgaacgctgcccgctggtacgacaccgtcgccgcggctgttgcttcaaggttccctggccaggcctctggggttagtgcatcatcggctcctgctgcagctgctcctgctgcttccaaggatgaagacgacgatgatgacatggatctgttcggcgatgagaccgaggaggacaagaaagcagcagctgagcgtgcggctgccaagcctgcaaagaagaaagaaagtggcaaatcctctgtcctcatggacatcaagccatgggacgatgagaccgacatgaagaagttggaggaggctgtccgcagtgttcaaatggagggtctcacctggggtgcatctaagcttatgcctgtgggctatggcatcaagaagctccagatcatgctgacgatcatcgacgacctcgtgtccgtcgacactcttattgaggaagtgctctgcgaggcgcccatcaacgagtatgtccagtcgtgtgatatcgttgccttcaacaagatctagaatctttgttcgcccacctgttgctgctggattcttggtactgggatctgtcgttctggaaaacattatgtcgtcccatttagttacccctcttacagaagtgctactggttttgtttttgagtgatgccctggtcttgaatgtctgttacctttaaaatagttgaattgctgagcggtttgtaatggcgaaacatctatcatgtggagtaaaatcagtctttgataactgtggtaggatgatccagatgttctggttta

SEQ ID NO: 892 - DNA, 1181 bp, Oryza sativa
ggtctctagggtttgggattttagccgccgccgccgccgccgccgctcacccgcgccttcgacgagctccagcccgtagacctcgccggatctccccgatggccgtgaccttcaccgacctccacaccgccgacgggctcaaagccctcgagcagcacctctccggcaagacctacgtctccggaaacgcgatcagcaaggacgacatcaaggtgttcgccgccgtgccatcaaagcctggagctgagttcccgaacgctgctcgctggtatgataccgtcgctgcggccctcgcttcaaggttccctggcaaggcagttggagtgaatctgcctggaggaggtgcggcatcgtctgctgcagcggctgcgccagctgctaaggatgctgatgaagatgatgatgacctggatctttttggtgatgagaccgaggaagacaagaaagcagcagatgagcgtgcagcttccaaggcctcttcaaagaagaaagaaagcggaaaatcatctgtcctgttggatgtcaaaccatgggacgacgagactgatatgaagaagttggaggaggctgtccgcagtgtgcagatggagggtctcacctggggagcatcaaagcttgtgcctgtgggttacgggatcaagaagttgcagatcatgttgaccattgttgatgacttggtgtctgtggatagccttatcgaagaacatctgactgaagagccgatcaacgaatttgtccagagctgcgacatcgttgcgttcaacaagatttaaaatatcaaaaggggatgttgctacttatccaaaaactgggactgggactggttgttctggaagcatttttcatcccatcttattatccttcacagaaatgctagtttgagtttatttttgagtgatgcctgtcattagtgcctcttatctttaagtagttgaactgcagagcggcttgtaatggcgaaacatatgctatgtcaaagtacatccgtccatttttactgtgcaagttttgatgagtatgcgtttcgttgagtaacttttgatgagtatccgtccatccgtccaagcttggaatgcgtttcgttgtgtaacgttgtttgtgtaggtttagttgctcgatgatgtgtggtcaaggttttcacttctctgttgagtgatttgtccgcttatttgttttagtca

SEQ ID NO: 893 - DNA, 958 bp, Saccharum officinarum
agggtttgagattttagccgccgccgcagctcgtctcacttccctgagaagtcgcagccgacgacgtactcctcgccgatcgatccgatggccgtcttctgcgacctccacaccaccgatgggctcaagtccctcgaggctcacctcgccggcaagacttacgtgtccggtgatgcgatttctaaggatgacattaaggtctttgcggcggtgccgtcgaagcctggcgctgagtttcctaatgctgcccgctggtacgagaccatctctgcggctgtagcgtcaagattccctggtaaggctgttggtgtaaatctgcctgcgggatcagctcctgcagcagctgctcctgcggctgaggctgaggatgatgatgatgaccttgatcttttcggcgatgaaaccgaggaggacaagaaggctgctgatgagcgcgccgctgccaaggcctcatccaaaaagaaagaaagtggtaaatcctctgtccttatggatgtcaaaccatgggacgatgaaactgatatgaagaagctggaggaggctgttcgcagtgtccagatggagggtctcacttggggagcgtcaaagcttgtgcctgttggatacggcatcaagaagatgactattatgttgacgattgtcgacgatcttgtgtccgtcgacagcctaattgaggatcaccttacggaagagccgatcaatgagtacgttcagagttgcgacattgttgctttcaacaagatctagagttcaaatgctgagattgggcaacggctggcagcgcttaaagtttgttctgggatgtgagagtttatcccttctagttaccttgttatagaaatgttggttggagtttattgttgagtgccgccagatttttgaatatctgtttatcttgaaatagcggaactgctgggcgatgttatgtgtctaaagttatgagtttacaatggttctg

SEQ ID NO: 894 - DNA, 708 bp, Saccharum officinarum
agggtttgagattttagccgccgccgcagctcgtctcacttccctgagaagtcgcagccgacgacgtactcctcttcgatccgatggccgtcttttctgacctccacaccgccgacggcctcaagaccctagaggcgcacctagcgggcaagacctatgtttcaggtgatgcgattactaaggatgacattaaggtctttgcggcggtgccgtcaaagcctggcgctgagtttcctaatgctgcccgctggtacgagaccatctctgtggctgtagcctcaagattccctggtaaggctgttggtgtaaatctgcctgcgggatcagctcctgcagcagctgctcctgctgctgaggctgaggatgatgatgaccttgatcttttcggggatgaaaccgaggaggacaagaaggctgctgatgagcgcgccgctgccaaggcctcatccaaaaagaaagaaagtggtaaatcctctgtccttatggatgtcaagccatgggacgatgaaactgatatgaagaagctggaggaggctgttcgcagtgtacagatggagggtctcacttggggagcatcaaagcttgtgcctgttggatacggcatcaagaagatgactattatgttgacgattgtcgacgatcttgtgtctgtcgacagcctaattgaagatcaccttatggaagagccgatcaatgagtacgttcaga

SEQ ID NO: 895 - DNA, 820 bp, Saccharum officinarum
  misc_feature (35)..(35): n is a, c, g, or t
atgcgattactaaggatgacattagttctttgcgncggtgccgtcaagccctggcgctgagtttcctaatgctgcccgctggtacgagaccatctctgtggctgtagcctcmagattccctggtaaggctgttggtgtaaatctgcctgcgggatcagctcctgcagcagctgctcctgctgctgaggctgaggatgatgatgaccttgatcttttcggggatgaaaccgaggaggacaagaaggctgctgatgagcgcgccgctgccaaggcctcatccaaaaagaaagaaagtggtaaatcctctgtccttatggatgtcaagccatgggacgatgaaactgatatgaagaagctggaggaggctgttcgcagtgtacagatggagggtctcacttggggagcatcaaagcttgtgcctgttggatatggtatcaagaagatgactattatgttgacgattgtcgacgatcttgtgtctgtcgacagcctaattgaggatcaccttacggaagagccgatcaatgagtacgttcagagttgcgacattgttgctttcaacaagatctaagagttaaaatgctgagattgggcaatggccggcagcccttctagttatagaaatgttggttggagtttattcttgagtgctgccagatttttgaatatctgtttatcttgaaatagcggaactgctgggcgatgttatgtgtctaaagttatgagtttacaatggttctgagttctttgcaatgcttaattttaaaaatgatgcggggttttaatccaaaatggtgttttttaatccatcctcgatatt

SEQ ID NO: 896 - DNA, 766 bp, Saccharum officinarum
agggtttgagattttagccgccgccgcagctcatctcactccccgagtagacgcagccgacaacgtactcctcgccgatcgatccgatggccgtcttctgcgacctccacaccaccgatgggctcaagtccctcgaggctcacctcgccggcaagacttacgtgtccggtgatgcgatttctaaggatgacattaaggtctttgcggcggtgccgtcgaagcctggcgctgagtttcctaatgctgcccgctggtacgagaccatctctgcggctgtagcgtcaagattccctggtaaggctgttggtgtaaatctgcctgcgggatcagctcctgcagcagctgctcctgcggctgaggctgaggatgatgatgatgaccttgatcttttcggcgatgaaaccgaggaggacaagaaggctgctgatgagcgcgccgctgccaaggcctcatccaaaaagaaagaaagtggtaaatcctctgtccttatggatgtcaaaccatgggacgatgaaactgatatgaagaagctggaggaggctgttcgcagtgtccagatggagggtctcacttggggagcgtcaaagcttgtgcctgttggatacggcatcaagaagatgactattatgttgacgattgtcgacgatcttgtgtccgtcgacagcctaattgaggatcaccttaacgaagaagcgatcaatgagtacgttcagagttgcgacattgttgctttcacaagatctaaattcaaattctagattgggca

SEQ ID NO: 897 - DNA, 975 bp, Saccharum officinarum
acgcgtccgagggtttgagattttagccgccgccgcagctcgtctcacttccctgagaagtcgcagccgacgacgtactcctcttcgatcagatggccgtcttttctgacctccacaccgccgatggcctcaagaccctagaggcgcacctagcgggcaagacctatgtttcaggtgatgcgattactaaggatgacattaaggtctttgcggcgttgccgtcgaagcctggcgctgagtttcctaatgctgcccgctggtacgagaccatctctgtggctgtagcctcaagattccctggtaagactgttggtgtaaatctgcctgcgggatcagctcctgcagcagctgctcctgctgctgaggctgaggatgatgatgaccttgatctttttggggatgaaaccgaggaggacaagaaggctgctgatgagcgcgccgctgccaaggcctcatccaaaaagaaagaaagtggtaaatcctctgtccttatggatgtcaagccatgggacgatgaaactgatatgaagaagctggaggaggctgttcgcagtgtacagatggagggtctcacttggggagcatcaaagcttgtgcctgttggatacggtatcaagaagatgactattatgttgacgattgtcgatgatcttgtgtctgtcgacagcctaattgaggatcaccttacggaagagccgatcaatgagtacgttcagagttgcgacattgttgctttcaacaagatctaagagttaaaatgctgagattgggcaatggccggcagcccttctagttatagaaatgttggttggagtttattgttgagtgctgccagatttttgaatatctgtttatcttgaaatagcggaactgctgggcgatgttatgtgtctaaagttatgagtttacaatggttctgtgtctaaagttttgagttctttgcaatgcttacttttaaaaatgatgcggggtttt

SEQ ID NO: 898 - DNA, 1080 bp, Panicum virgatum
gggtttgagattttagccgccgccgccgctcctcacgtccttgagaagtcgcagccgacgtagtcctcaccggatccgatggccgtgactttctcggacctccacaccgccgacggcctcaaggccctcgaggcgcacctcgccggcaagacctacgtctccggggatgcgatcagcaaggacgacattaaggtgtttgcggcggtgccgtcgaagcctggtggtgagttccccaatgctgccagatggtacgagaccgtcgccgcggctcttgctgccagattccctggcaagggtgtcggtgtgaatctgcctggagcgggatcggctcctgcagcagctgctcctgcggctgaggttgctaaggatgatgatgatgacgacttggatcttttcggtgatgaaaccgaggaggataagaaggctgctgatgagcgtgcggctgccaaggcctctgccaagaagaaagaaagtggcaagtcctctgtcctgatggacgtgaagccgtgggatgatgaaactgacatgaagaagcttgaggaggctgttcgcagtgtccagatggagggtctcacttggggagcttcaaagcttgtgcccgttggttatggtatcaagaagatgacaatcatgttgaccattgtggatgacctcgtgtccattgatagtctgattgaggaccacctcatggaggcacccatcaatgagtatgtccagagctgtgacattgttgccttcaacaagatctagaatcccaattatcgggcactaaatctgctgctggggtcttggtctcttggaactggattggttatgatggcaagcgctcaagtttctcgtgggatgcgagctcttaccccttttagttactctgctatagaaattgtcgggtctgagtctattgttcagtgctgccaggtttttgaatatctgtttatcttgaatagttgaactgctgggcggtgaaacatgtgctgtgtctaatgtacaccagttttctgtgcaacgctagttttgaacgaggatgagaaacgtgtttctgatactgcttttctgtctgcaatagcaaatagttgcggg

SEQ ID NO: 899 - DNA, 1139 bp, Panicum virgatum
ctctccatctctagggtttgggattttagccgccgccgccgctcctcacgtccttgagaagtcgcagccgacgtagtcctcgccggatccgatggccgtgactttctctgagcttcacaccgccgacggcctcaaggccctcgaggcgcacctcgccggcaagacctacgtctccggggatgccatcagcaaggacgacattaaggtgtttgcggcggtgccgtcgaagcctggtgccgagttccccaatgctgcccggtggtacgagaccgtcgccgcggctgttgcctccagattccctggcaagggtgttggtgtgaatctgcctggagccggatcggctcctgcagcagcagctcctgcggctgaggttgccaaggatgatgatgatgatgatgatgacttggatcttttcggtgatgaaactgaggaggacaagaaggctgcagatgagcgtgcggctgccaaggcctctgccaagaagaaagaaagtggcaagtcctctgtcctgatggacgtgaagccgtgggacgatgaaactgacatgaagaagcttgaggaggctgttcgcagtgtccagatggagggtctcacttggggagcttcaaagcttgtgcctgttggttatggtatcaagaagatgacaatcatgttgaccattgtggacgacctcgtgtcagttgacagtctgattgaggaccacctcacggaggcacccatcaacgagtatgtccagagctgtgacattgttgccttcaacaagatctagaatcccaattgttgggcactaaatctgctgctggggtcttggaactggattggttgtgatggaaagcgctcaagtttcctgtgggatgcgagctcttaccccttttagtaactctgctatagaaatggtcggtccgagtctattgttaagtgctgccaggtttttgaatgtctgtttatcttgaatagttgaactgctgggcagtgaaacatgtgctgtgtctaaagtacaccagttttctttgcaatgctagttttgaatgaggatgagaaacgtgttttttgatactgcttttctgtctgcaatagcacagttgcgggaattatgatactgtattctgtggcaactgatgcggctgatattttactct

SEQ ID NO: 900 - DNA, 977 bp, Triticum aestivum
ctagggttttgggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcatcgatgaccttgtgtccgtcgacactcttattgaggaagtgctttgcgaggcgcccatcaacgaatatgtccagtcgtgtgacatcgttgccttcaacaagatctagaatctttgttctcccacctgctggattcttggtactgggattggtcgatctggaaaacattatgtcgtcccatttagttacccctcttacagaaatgctactggttttgtttttgagtgatgccctggtcttgaatgtctgctacctttaaatagttgaactgctgagcggtttgtaatggcgaaacatctatcatgtggagtaaaatcagtctttgataaccgtgatcggatgatc

SEQ ID NO: 901 - DNA, 997 bp, Triticum aestivum
acgaattcggcacgaggctagggttttgggattttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaaggttccctggccaggcctctggggtgagtgcatcctcggctcctgctgcagctgctcctgctgcttccaaggatgaagatgatgacgatgacatggatctgttcggcgatgagaccgaggaggacaagaaagcagcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctggggtgcatctaagcttatgcctgtgggttatggcatcaagaagctccagatcatgctgacgatcatcgacgaccttgtgtctgtcgacacccttattgaggaagtgctctgtgaggcgcccatcaacgagtatgtccagtcgtgtgacatcgttgccttcaacaagatctagaatctttgttcgcccacctgttgctgctggattcttggtactgggattggttgatctggaaaacattatgtcgtcccatttagttacccctcttacagaaatgctactggttttgtttttgagtgatgccctggtcttgaatgcctgctacctttaaatagttgaattgctgagcggtttgtaatggcgaaacatctatcatgtggagtaaaatcagtctttgataactgtgataggatgatc

SEQ ID NO: 902 - DNA, 993 bp, Triticum aestivum
ggcacgaggctagggttttgggattttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtatgacaccgtcgccgcggctgttgcttcaaggttccctggccagtcctctggggtgagtgcatcatcggctcctgctgcagctgctcctgccgcttccaaggatgaagacgacgatgatgacatggatctgtttggcgatgagaccgaggaggacaagaaagctgcagctgagcgtgaggctgccaagcctgcaaagaagaaagaaagtggcaaatcctctgtcctcatggatatcaagccatgggacgatgagactgacatgaagaagttggaggaggctgtccgcagtgttcaaatggagggtctcacctggggtgcatctaagcttatgcccgtgggttatggcatcaagaagctccagatcatgctgacgatcattgacgacctcgtgtctgtcgacactcttattgaggaagtgctctgcgagacgcccatcaacgagtatgtccagtcgtgtgacatcgttgccttcaacaagatctagaatctttgttcacccacttgttgctgctggattcttggtactgggatctgtcgatctggaaaacattattgtcgtcccatttagttacccctcttacagaaatgctactggttttgtttttgagtgatgccctggtcttgaatgtctgctacctttaaatagttgaactgctgagcggtttgtaatggcgaaacatctatcatgtggagtaaaatcagtctttgataactgtgataggatgatc

SEQ ID NO: 903 - DNA, 709 bp, Triticum aestivum
agccgccgccgcagctctctcacttccccgagaagccagccgacgacgtactcctcgccgatacgatggccgtcttctccgacctccacaccgccgacggcctcaagaccctggaggcgcacctagcgggcaagacctatgtttcaggtgatgcgatcactaaggatgacattaaggtctttgctgcggtgccatcaaagcctggcgctgagtttcctaatgctgcccgctggtacgagaccatctctgcggctgtagcctcaagattccctggtaagcctgttggtgtaaatctgcctgcgggatcagctcctgcagcagctgctcctgctgctgaggctgaggatgatgatgaccttgatcttttcggggatgaaaccgaggaggacaagaaggctgctgatgagcgtgccgctgccaaggcctcttccaaaaagaaagaaagtggtaaatcctctgtccttatggatgtcaaaccatgggacgatgaaactgatatgaagaagctggaggaggctgttcgtagtgtccagatggagggtctcacttggggagcatcaaagcttgtgcctgttggatacggcatcaagaagatgactattatgktgacgattgtcgacgatcttgtgtccgtcgacagcctaattgaggaccaccttacggaagagcccatcaacgagtacgttcagagttgcgacattgtcgcttt

SEQ ID NO: 904 - DNA, 1452 bp, Hordeum vulgare
cggcacgaggatccaccaatctccagcctccgccctataaatcgccccgccggcgccaattcggcgacccaccgagccagccacctctgaccctgggcgcatccaaacaaaggagggagtcgcgcccagtctacgctagcggccgatcacatcaccagctgcaggcaggggattaattaagcggtgggggcggggaaagcgcggcggcggcatggagagctcgacatcgaggacgagactgaattgcatcagcctggcggaccccgacacccagagatcggtcgcgctcctcaagcaggcatgcttggattcaggcttcttctatgtgctggatcatgggataagccaggaattcatggatgaggtttttgccgaaagcaagaagttctttgaacttccgaacagtgagaaaatgaagcttctccgaaatgagaagaatcgagggtatacacctatgctagatgagattcttgatccagaaaaccaagtgaatggtgactacaaggaagggtattatattggtgttgaggtacctacagatgacccacaatcaaataggccattttatggtccaaaccagtggccttctgaagaagtattgcccaaatggagggaggtgatggagcaatatcacagggaagcattgagagtggccaaatcagttgcaaggatcattgctcttgctttgaacctagatgcagatttctttgatagacctgaaatgcttggcgattccatagccacattaaggctcctgcactatgaaggtggacaaaaaacaggtcaagtgtcaaatccttctaagggagtttatggagccggtgcacattcggattatggcctgatcactctcttagcaactgatgatgtagttggtctccaaatatgcaaggacaggaatgctcagcctcaagtatgggaatatgtagctcctgttaaaggcggctttattgtcaatcttggtgatatgctcgaacgctggagtaactcccttttcaggtcaactttacatcgagtggtcctggatggacgagagcgctattccattgcctttttcgtggagccaagccacgactgcgtagtcgagtgcctgccaacctgcaaatctgagacgaatcctccaaagttccccccaatcacttgctcggcgtacctatcccagcgctacaaggacacgcatgcagatctgagcacttacggcaacggcaaagcctgaaagaagcagctctattttttgccctgttcactttcttgccttcccatctactagtatgacgtgtaatgttgcgggtggcaataagaatgcccttaggacggaggatggcaatgttgtactactaatgtgctaatatcagtgtaaccatagctgtggagaagtcatcatcgttcatgtggacatgaacaatggttgccttctttctgaatgtgtacaagttccgaagtttatcgctc

SEQ ID NO: 905 - DNA, 1124 bp, Brachypodium distachyon
gcggccgcgaatcgaggccggcggcggttgcgaggagaggcagaagccgcagggattaggtagggggcggggagagcgcggcggcggcacatggagagctcgacctcgagcacgagcctgaattgcatcagcctgtcggacccggacatccagagatcggtcgcgctcctcaagcaggcatgtctggattcaggctttttctacgtgctggatcatggaataagccaggagttaatggatgaggtttttgcccagagcaagaagttctttgaactcccaaacagtgagaaaatgaagcttctccgaaatgagaagaatcgggggtatacacctatgctagatgagattcttgatccagaaaatcaagtgaatggtgactacaaggaagggtattatataggtgttgaggtacctgcagatgatccacaatcaaacaggccattttatggtccgaatcagtggccttctgaagaagtattgcccaaatggagggaggtgatggaggaatatcacagggaagcattgagagtggcaaaatcagtagcaaggatcattgctcttgctttgaacctagatgaggacttcttcgatacacctgaaatgcttggtgatcctatagccacattaaggctcctgcactacgaaggtggacgagaaacaggtcaagtgtcaaatccttccaagggagtttatggagcgggtgcacattcggattatggcctgatcactctcttagcaactgatgacgtggttggtcttcaaatatgcaaggacagcaatgctcagcctcacgtatgggaatatgtagctccagtgaaaggtggctttattgtaaatcttggtgatatgctcgaacggtggagtaactgcatcttcaggtcaactttacatcgagtggtactcagtggacaagagcgttactctattgcctactttgtggaaccaagccacgactgcatagtcgagtgcctgccaacctgcaaatcggagacaaatcctccaaagttccctccgataacttgctctgcatacctatcccagcgctacaaggacacgcatgcagatctgagcgcttacagcgacggcaaagcctgaaagaagctctagttttttttgccctcttc

SEQ ID NO: 906 - DNA, 1395 bp, Leymus cinereus x Leymus triticoides
cgcgtccagtctacgctagcggccacgaatcgaggcggcggcgtgctgcgtgaaagagcggagaggaggaggcagccacaggggattagactagcggcggggaaagcgtagcggcagcatggagagctcgacctcaaggacgagcctgaattgcatcagcctcgcggacccggacatccagagatcggttgcgctcctcaagcaggcatgcctggattcaggcttcttctacgtgctggatcatgggataagccaggaattcatggatgaggtttttgccgaaagcaagaagttttttgaacttccgaacagtgagaagatgaagcttctccgaaatgagaagaatcgagggtatacacctatgctagatgagattctagatccggaaaatcaagtgaatggtgactacaaggaagggtattatattggtgttgaggtacctgcagatgatccacaatcaaataggccattttatggtccaaatcagtggccttccgaagaagtattgcccaaatggagggaggtgatggagcaatatcacagggaagcattgagagtggccaaatcagttgcaaggatcattgctcttgctttgaacctagatgcggacttctttgatagacctgaaatgcttggggattctatagccacattaaggcttctgcactatgaaggtggacaaaaaacaggtcaagtgtcaaatccttctaagggagtttatggagctggtgcacattcggattttggcctgatcactctcttagcaactgatgatgtagttggtctccaaatatgcaaggacaggaatgctcagcctcaagtatgggaatatgtagctcctgtgaaagggggctttattgtcaatcttggtgatatgctcgaacgctggagtaactccattttcaggtcaactttacatcgagtggtccttgatggacgagagcgctactctattgcctttttcgtggaaccaagccatgactgcgtagtcgagtgcctgccaacctgcaagtccgagacgaatcctccaaagttcccccctatcacttgctcggcgtacctatctcagcgctacaaggacacgcacgcagatctgagcacttacggcgacggcaaagcctgaaagaagcacctctggtttttgccctgtccccttttttgccttcccatctatctagtatgacatgtaatgttgcaagtggcaataagaatgcccctaggacggaggatggtaatgtaccactaatgtgctaatatcagtgtaaccatagctgtggagatgtcatcatttgttcatgtgcagatgaacaatggtggtcttctttctgaatgtgtaccgagttccagattttattgctcaccgtggccttctctttccgagtttttgggatgata

SEQ ID NO: 907 - DNA, 1612 bp, Zea mays
cggacttctcgtcttggctttaacctttttcccttttgcaacctttttcgaccaaccttcgtctccagactcgtccaccctataaattgtctcgccagaccattccaatccggcaactcctgctctgcctgagcctgagcgtaggcggctaccagagagaagggtaggcggcgccggcggcgggagcaatagaagagcggtaaatccaagagagatcagagcctcggagggaaacagaagcgcacagagcatggagagcccgatctcgaggactaacctgaattgcatcagcctggcggacccgaacgtccagaaatcagtggcgctcctcaagcaggcatgcctggattcaggcttcttctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagttaatggtgactacaaggaaggatattatattggagttgaggtacctgcagatgatccagaagcaaacaggccattttatggtccaaatcagtggccttctaaagaagtattaccaaaatggagagaagtgatggagcaatatcacagggaggcgttgagagtagcaaaatcagtcgcaaggatcatcgctctcgctctagatctagatgtggacttcttcgatagacctgaaatgcttggcgagtcaatagccacgctaaggctcctgcactacgaaggtggacaagaaacaggtaaggtgtcagatcctgcaaagggtgtttacggagcgggcgcccattcagactacggcctgataactctcctggcaaccgatgatgtagttgggctccaaatatgcaaggacaagaacgctcagcctcaactgtgggaatacgtagctccgttgaaaggcggatttatcgtcaaccttggcgacatgctcgaaaggtggagtaacggcgttttcaggtcaaccttacatcgagtggtcctagatgggcgagaacgttactcgatagcctacttcgtggaaccaagccacgactgcgtggtggagtgcctgccgacctgcaagtccgaatcaaatcctccaaagttccctccgatcacctgctccgcgtacctgtcccagcgctacaaggacactcacgcggatctgaaatcctacgacgacagcaaggcctgatcagaggactgccctctcctctctctgtctcagcgatcagtacgtacgacgtgtatcctgcaataacactgggtggagggcggcagtaccagtgtaccacagtatcagtataggtatagagagttctgttggtgccaccgtgccaccgtccatgtgttcatgtaagatgacgagaagaatcaagaacgggggccggcgttgaggtccccggccttaatctaggccttgttgttgctgtcgtgttgtgaggttcaatccccgagcttatcctttggtgctgttgagaggtccacagtccccttcgttccgttttgtttttggttttggtacaccaggagcaattttgttgtggattgc

SEQ ID NO: 908 - DNA, 1332 bp, Sorghum bicolor
cggcggcgggagcaaaagaagagcggcgaatccaagagagatcagagcctcagagggagagtcgagagagggagagagaagcgcccaacatggagagcccgatctcgaggactaacctgaattgcatcagcctggcggacccggacgtccagaaatcggtcgcgctcctcaagcaggcatgcctggattcaggcttcttctatgttgtggatcatgggataagccaagagttcatggatgaagttttttcccagagcaagaagttctttgaccttcctcacagtgagaaaatgaagcttctccgagacgagaagaatcgagggtacacacccatgctagatgaaattcttgatcctgaaaatcaagtgaatggtgactacaaggaaggatattatattggagttgaggtaccagcagatgatccagaagcaaacaggccattttatggtccaaatcagtggccttctaaagaagtattaccaaaatggagggaagtgatggagcaatatcacagggaggcattgagagtagcaaaatcagttgcaaggatcattgctcttgctctagatctagatgtggacttctttgatagacctgaaatgcttggggagcctatagccactttaaggctcttacactatgaaggtaaagtgtcaaatcctgcaaagggtgtttatggagcgggtgcccattcagattatggcctgataactctcctagcaaccgatgatgtagttggactccaaatatgtaaggacaagaatgctcagcctcaagtatgggaatatgtagctcctgtgaaaggaggatttatcgtcaatcttggtgatatgcttgaaagatggagtaacagcattttcaggtcaaccttacatcgagtggtcctagatggccgagaacgctactcgatagcctactttgtggaaccaagccatgactgtgtagttgagtgcctgccgacctgcaaatccgaatcaaatcctccaaagttccctccgatcacctgttctgcatacctgtcccagcgttacaaggacactcatacagatctgaactcctacaacaacagcaaggcctaaaggatggcctactaaatctttttttcactacttttgtcagccatctgtacggcagacatgtaacctgcaataacactaggtggaggacggcactgtgtgtgtagtgtgtactaatacggtaataccaataccagattaccagtgtatcacagtatcaatataggtatagcagttttgtagacgccattctccatgtaagatgaagagaagaattgaagatcaagaatggccttcctgtcgtgttgtgaagttc

SEQ ID NO: 909 - DNA, 1651 bp, Saccharum officinarum
accttttccacctaccttcctctccaggctcgttcacctttataaatcgtctcgtcagaccattccaatccggcaactcctgctctgcctgagcctgagcgtatcawgawamggggaaggcggctaccagggaagagggtaggcggcggcggcgggagcaaaagaagagcggcaaatccaagagagatcagagcctcagagggagagagtcgagaggagagagaagcgccgagcatggagagcccgatctcgaggactaacctgaattgcatcagcctggcggacccggacgtccagaaatcggtcgcgctcctcaagcaggcatgcctggattcaggcttcttctatgttgtggatcatgggataagccaagagttcatggatgaagtttttgcccagagcaagaagttctttgaccttcctcacagtgagaaaatgaagcttctccgagacgagaagaatcgagggtacacacccatgctagatgaaattcttgatcctgaaaatcaagtgaatggtgactacaaggaaggatattatattggagttgaggtacctgcagatgatccaggagcaaacaggccattttatggtccaaatcagtggccttctaaagaagtattaccaaaatggagagaagtgatggagcaatatcacagggaggcgttgagagtagcaaaatcagttgcaaggatcattgctcttgctctagatctagatgtggacttctttgatagacctgaaatgcttggcgagcctatagccactttaaggctcttgcactatgaaggtaaagtgtcaaatcctgcaaagggtgtttatggagcgggtgcccattcagattatggcctgataactctcctagcaaccgatgatgtagttggtctccaaatatgtaaggacaagaatgctcagcctcaagtatgggaatatgtagctccagtgaaaggtggatttatcgtcaatcttggtgatatgctggaaaggtggagtaacagcattttcaggtcaaccttacatcgagtggtcctagatgggcgagaacgttactcgatagcctactttgtggaaccaagccatgactgcgtagttgagtgcctgccgacctgcaaatccgaatcaaatcctccaaagttccctccgatcacctgttctgcatacctgtcccagcgttacaaggacactcatgcagatctgaactcctacaacgacagcaaggcctaaaggatgccctactaaacccttttattcactgcttctgtcagccatctgtacggaagatatgtaacctgcaataacactaggtggaggacgacactgtgcgtgtagtgtgtactaatatcgataccagattaccagtgtatcacagtatcaatataggtataacagttctgtagatgccattctccatgtaagatgaagaggagaattgaagatcctaaattgtggtaccatgaggaccagcattgcttcggcacctatttttttaatattaccaaatataaagggcggccgctttttaaggatacaaacttttcgtcacccgtgcatgcaaaattataagtttttttattgggggcacctaaatttaaattccctgggcgggcgtttttcaaacgctggtgattgggaaaaaccttggcggttcccc

SEQ ID NO: 910 - DNA, 1413 bp, Panicum virgatum
caatccaatccggtggcaattcctgcgctctgcctgcacgcatcgggaaaaagaggcggctaccaggaaagcggagggtagacggcggcggaaggagggagcaaaagaagagcggcaaatctgagagagatcagagcctcgagggctgagagtcggcagagagcgccgagcatggagagctcgatctcgagtactgagctgaattgcatcagcctggcggacccggacatccagaaatcggtcgcgctcctcaagcaggcatgcctggattcaggcttcttctatgttgtggatcatgggataagcgaagagttcatggatgaagtttttgcccagagcaagaaattctttgaccttccccacattgagaaaatgaagcttctccgagacaagaagaaccgcgggtatacacccatgcttgatgaaattcttgatccagaaaatcaagtgaacggtgactacaaggaaggatattatataggtgttgaggtacctgcagatagtccagaagcaaacaaaccattttgtggtccaaatcagtggcctgctgaagaagtattgccaaaatggagggaggtgatggagcaatatcacagggaggcattgagagtagcaaaatcagttgcaaggatcattgctcttgctctggacctagatgtggacttctttgatagacctgaaatgcttgccaagcctatagccactttaaggctcctacactatgaaggtcgagtgtcaaatcctgcaaagggtgtctatggagcaggagcgcattcagattatggcctaataactctccttgcaaccgatgatgtagttggacttcaaatatgtaaggacaggaatgctcagcctcaagtatgggaatatgtagctccggtgaaaggaggattcatcgtcaatcttggtgatatgctcgaaaggtggagtaactgcattttcaggtcaaccttgcatcgagtagtcctcgatgggcgagaacgctactcaatagcctactttgtggaaccaagccacgactgcgtagtcgagtgcctgccaacctgcaaatctgaaacgaatcctccaaagttccctccaatcacctgctctgcctacctgacccagcgctacaaggacactcatgcagatctgagctcttacagcgacggcaaggcctgaaggatgccctactcttacttttttttttgtcactacttactgatgcttcagtttcagccatccaatgtttacgtgtaaccttcataacacagtagtgtggaggatggcactttgtgtgtactaataccattaccagtgtgtatcacggtatcagtataagcatagcagttttgtggatgccgttctctatgtaccatgaagggaagagccaagaagggacttctctgttctcgtgtatagtgtttgctgttc

SEQ ID NO: 911 - DNA, 1457 bp, Panicum virgatum
ggcaattcctgccctctgcctgcgcgcatcgggaaaaaaagaggcggctaccaggaaagcggagggtaggcggcggccgcaagttgggagcaaaagaagagcggcaaatctaagagagatcagagcctcaagggagagagtcggcagagagcgccgagcatggagagctcgatctcgaggaccgagctgaactgcatcagcctggcggacccggacatccagaaatcggtcgcgctcctcaaacaggcatgcctagattcaggcttcttctatgttgtggatcatgggataagccaagagttcatggatgaagtttttgcccagagcaagaaattctttgaccttccccacagtgagaagatgaagcttctccgagatgagaagaatcgagggtatacacccatgctggatgaaattcttgatccagaaaatcaagtgaatggtgactacaaggaaggatattatataggagttgaggtacctgaagataatccagaagcaaacaaaccattttatggtccaaatcagtggcctaacgaagaagtattgccaaaatggaggaaggtgatggagcaatatcacagggaggcattgagagtagcaaaatcagttgcaaggatcattgctcttgctctggacctagatgtggacttctttgatagacccgaaatgcttgccaagcctatagccactttaaggcttttacactatgaaggtggacaaaagacaggtcgagtatcaaatcctgcaaagggtgtctatggagcaggaacgcattcagattatggcctaataactctcctggcaaccgatgatgtagttggacttcaaatatgtaaggacaggaatgctcagcctcaaatatgggaatatgtagcgcctttgaaaggaggattcatcgtcaatcttggtgatatgcttgaaaggtggagtaactgcattttcaggtcaaccttgcatcgagtagtcctagatgggcaagaacgctactcgatagcttactttgtggaaccaagccacgactgcgtagttgagtgcctgccgacctgcaaatctgaaacaaatcctccaaagttccccccaatcacctgctctgcctacctgtcccagcgctacaaggacactcatgcagatctgagctcttacagcgacggcaaggcctgaaggatgccctactcttacccttttttttctgtcactactcactgatgcttcagtttcagccatccaatgtttacgtgtaaccttcaataacacagtagtgtgaaggatggcactgtgtgtgtactaataccattaccagtgtatcagtataagcatagcagttttgtagatgccgttctctatgtaccatgaagagaagagccaagaagggacttctctgttctcgtgtatagtgtttgctgttctgaagactgaagttcctcgagcttatccttagtcgctgttgagaggtc

SEQ ID NO: 912 - DNA, 1393 bp, Triticum aestivum
ctgactctgagcgcatccaacaaaggagtcgcgtcacagtctacgctagcggccacgaatcggggcggcggcgcgctgcgagaaagagcggagcaggcagccgcaggggatcaggctggtggtggggaaagcgtagcggcggcggcatggagagctcgacctcgaggacgagcctgaattgcatcagcctggcggaccccgacatccagagatcggtggcgctcctcaagcaggcatgcttggattcaggcttcttctatgtgctggatcatgggataagccaggaattcatggacgaggtttttgccgaaagtaagaagttctttgaacttccgaacagtgagaaaatgaagcttctccgaaatgagaagaatcgagggtatacacctgtgctagatgagattcttgatccagaaaaccaagtgaatggtgactacaagggaagggtattatattggtgttgaggtacctgcagatgacccacagtcaaataagccattttatggtccaaaccagtggccttccgaagaagttttgcccaaatggagggaggtgatggagcaatatcacagggaagcattgagagtggccaaatcagttgcaaggatcattgctcttgctttgaacctagatgcggacttctttgatagacctgaaatgcttggcgattcgatagccacattaaggctcctgcactatgaaggtggacaaaaaacaggtcaagtgtcgaatccttctaagggagtttatggagctggtgcacattcggattatggcctgatcactctcttagcaactgatgatgtagttggtctccaaatatgcaaggacaggaatgctcagcctcaagtatgggaatatgttgctcctgtgaaaggcggctttattgtcaatcttggtgatatgctcgaacgctggagtaactccattttcaggtccactttacatcgagtggtccttgatggacaagagcgttactctattgcctttttcgtggaaccaagccacgactgcgtagtcgagtgcctgccaacctgcaaatccgagacgaatcctccaaagttccccccaatcacttgctcggcgtacctatctcagcgctacaaggacacacacgcagatctgagcacttacagcgacggcaaagcctgaaagaagaagctctggtttttgccctgtccccctttttttgccttcccatctatctagtatgacgtgtaatgttgcaagtggcaataagaatgcccttaggatggaggatggtaatgttgtactgctaatgtgctaatatcagtgtaaccatagctgtggagatgtcattcattgttcatgtggacatgaacaatggttgccttctttctgaatgtgtacaagttccgaagtttattgctca

SEQ ID NO: 913 - DNA, 1588 bp, Triticum aestivum
ataaatagaagtccatacagagaggaatcgcgcattgttttttcctggtccagagaccaggccgtccgcagccaccaagagatcgcctccgctttcgtgcccctcgcaaaccttcttccaaattccaccaacctcgagcctccgcccctatatatcgcccccggcgccaattcggcgatccaccagccacctctgactctgagcgcatccaacaaaggagtcgcgtcacagtctacgctagcggccacgaatcgaggcggcggcgcgctgcgagagagagagagcggagaggatcaggctggtggtggggaaagcgtagcggcggcatggagagctcgacctcgaggacgagcctgaattgcatcagcctggtggaccccgacatccagagatcggtcgcgctcctcaagcaggcatgcttggattcaggcttcttctatgtgctggatcatgggataagccaggaattcatggacgaggtttttgccgaaagcaagaagttctttgaacttccgaacagtgagaaaatgaagcttctccgaaatgagaagaatcgagggtatacacctatgctagatgagattcttgatccagaaaaccaagtgaatggtgaccacaaggaagggtattatattggtgttgaggtacctgcagatgacccacagtcaaataggccattttatggtccaaaccagtggccttccgaagaaatattgcccaaatggagggaggtgatggagcaatatcacagggaagcattgagagtggccaaatcagttgcaaggatcattgctcttgctttgaacctagacgaggacttctttgatagacctgaaatgcttggcgattcgatagccacattaaggctcttgcactatgaaggtggacaaaaaacaggtcaagtgtcaaatccttctaagggagtttatggagctggtgcacattcggattatggcctgatcactctcttagcaactgatgacgtagttggtctccaaatttgcaaggacaggaatgctcagcctcaagtatgggaatatgtagctcctgtgaaaggcggctttattgtcaatcttggtgatatgctcgaacgctggagtaactccattttcaggtcaactttacatcgagtggtccttgatgggcaggagcgttactccattgcctttttcgtggaaccaagccatgactgtgtagtcgagtgcctgccaacctgcaaatccgagacgaatccgccaaagttccccccaatcacttgctcggcgtacctatcccagcgctacaaggacacgcacgcagatctgagcacttacagcgacggcaaagcctgaaagaagcacctctggtttttgctctgttcccctttttttgccttcacatctatagtatgacgtgtaatgttgcaagtggcaataagaatgcccttaggacggaggatggcaatgttgtactgctaatgtgctaatatcagtgtaaccatagctgtggagatgtcatcattgttcctgtggagatgaacactggttgccttctttctgaatgtgtacaagttccgaagttgattgctcaccgtggccttgtctttctg

SEQ ID NO: 914 - DNA, 1519 bp, Triticum aestivum
cgctttcgtgcccctcgcaaaccttcttccaaattccaccaacctcgagcctccgccctatatatcgccctccggcgccaattcggcgacccaccagccacctctgactctgagcgcatcgaacaaaggagtcgcgcccagtcttcgctagcggccaatcacatcagcggccgccgcagcaggaggcgggggatcaggtggtggggaaaccgcagcggcggcatggagagctcgacctcgaggacgagcctgaattgcatcagcctggcggaccccgacacccagagatcggtcgcgctcctcaagcaggcatgcttggattcaggcttcttctatgtgctggatcatgggataagccaggaattcatggatgaggtttttgccgaaagcaagaagttctttgaacttccaaacagtgagaaaatgaagcttctccgaaatgagaagaatcgagggtatacacctatgctagatgagattcttgatccagaaaaccaagtgaatggtgactacaaggaagggtattatattggtgttgaggtacctgcagaggacccacagtcaaatagaccattttatggtccaaaccagtggcctcctgaagaagtattgcccaaatggagggaggtgatggagcaatatcacagggaagcattgagagtagccaaatcagttgcaaggatcattgctcttgctttgaacctagacgaggacttctttgataggcctgaaatgcttggcgattcgatagccacattaaggctcttgcactatgaaggtggacaaaaaacaggtcaagtgtcaaatccttctaagggagtttatggagctggtgcacattcggattatggcctgatcactctcttagcaactgatgatgtagttggtctccaaatttgcaaggacaggaatgctcagcctcaagtatgggaatatgtagctcctgtgaaaggcggctttattgtcaatcttggtgatatgctcgaacgctggagtaactccattttcaggtcaactttacatcgagtggtccttgatgggcaggagcgttactccattgccttcttcgtggaaccaagccacgactgcgtagtcgagtgcctgccaacctgcaaatccgagacgaatccgccaaagttccccccaatcacttgctcggcgtacctatcccagcgctacaaggacacacacgcagatctgagcacttacagcgacggcaaagcctgaaagaagaagctctggtttttgccctgttcctttttttgccttcccatctatctagtatgacgtgtaatgttgcgagtggcaataagaatgcccttagcaaggaggatggtaatgttgtactgctaatgtgctaatatcagtgtaaccatagctgtggagatgtcactcattgttcatgtagacatgaacaacatgaacaatggttrccttctttctgaatgtgtacaagttccgaagtttattgctcaccgtggccttgtctttctgagtttttgggatgataaaaaaaaaa

SEQ ID NO: 915 - DNA, 891 bp, Amborella trichopoda
tcactcgcgccggaggcagcctgcgaaaccctaatccttagttcgttcccctgcaaatcaacgatgtccggaagaaagaaaaccagggaacctaaagaggaaaatgtgactttgggaccaactgttcgagaaggtgaacatgtctttggggtggctcatgtatttgcctcgttcaatgacacattcgtgcatgtcactgatctatctgggagagaaacacttgttcgaattacaggtgggatgaaggttaaggcagatagggatgaatcgtccccttatgcggccatgcttgctgctcaagatgttgcacaaagatgcaaggagcttggcatcactgctcttcatatcaagcttcgtgccactggaggaaacaagaccaagacacctggtcctggagctcagtctgcacttcgagcgctagctaggtctgggatgaggattggacgcatagaggatgtgactccaattccaaccgacagcacccggagaaagggtggtcgaagagggcgcaggctgtgatttcttgagcctttttataatccttttgggcttgagatccatctatgcggaagagttttgcaaacttatatttctttttctgttttctgtggattttgaagagaaacaggtggtaatgatgcagattttgtgtgctatgaatcattcgtgaggaaaaattttagctgaaatttagatgaagtcttacttatagattgttttawtgttggttcttggattagcaaaagggatatgaagtcttggagacctttaaacaaattaccaaaatgaattttgaaattgtataatctgtagacttggctgcctaaatagcaataagttataaccactagggttgacgggccgtagagattaggcttctaatggaataat

SEQ ID NO: 916 - DNA, 839 bp, Amborella trichopoda
atcgtgttggtgctttgagctcgcctcaggggagtacctcgaagaggaggggcagtttgttcgttccaacagtctctgcaatcatgtcgggtagaaagaagaccagggagcccaaggaggaaaatgtcactctaggaccaactgttcgagaaggtgaatacgtttttggtgtggctcacatatttgcctcattcaatgacacgtttgtgcatgtcacagatttgtctgggagagaaactcttgtacgaattaccggtggcatgaaggtaaaagctgatagggatgagtcttccccttatgcggctatgcttgcwgcacaagatgttgcccaaagatgcaaggaacttggcattactgctcttcatatcaagctccgagctactggaggcaacaagacaaagacacctggtcctggggctcagtctgctcttagagcccttgctagatctggaatgaggattggtcgcattgaggatgtgactcctattcccactgatagcacgcgtagaaagggtggacgacgagggaggaggctttgagcttttctagctttctgtctggtatttgggctcagcacctccctataaccgtgaattttctctcttccttatcatgtggattgtgatcgaatgcttgataaacaattttgttgcycaggttttttccctcttaaattttcatttgagctatagtattagattagctaaacctaaacttggtttgtttcttgtgagatgttctttttgataatattgtgataatatgttgaagatttagttttggtctgaattgcaccaagtttgtagaatgatattttaaatgcagtggtgtattgtagt

SEQ ID NO: 917 - DNA, 744 bp, Antirrhinum majus
  misc_feature (17)..(17): n is a, c, g, or t
tacaacttgcaccgagntctacagtaagyagctcagtcgccgaagctatgtcgaagagaaggaccagagagcctaaggaagacaatgtcactctcggacctgcaactagagacggcgagctagtctttggtgtggcccatatttttgcctcattcaacgacaccttcattcatgtgactgatttgtctggaagggaaaccatggttcgtataacaggtggtatgaaggtgaaggctgatagggatgaatcatcaccctatgcagctatgcttgcagcacaggatatatcccagagatgcaaggagctaggtctaaatgctctgcatattaagcttcgtgctactgggggtaataagaccaagacccctggccctggtgctcagtctgcacttagagcccttgctcgttcagggatgaagattggtcgtatagaggacgtgactccaattccaactgacagcactcgacgaaagggtggccgaaggggaagaaggctgtaacttgttatatcatgttggcaggagacttggatttttggttggatgtttctcttgtattagagatttttgtgatttaatatttgcatcatttggagtttgagcatgaattattttgatgtctgatgaagaatagcggaagagtatgagaaarkttctgtttgacaaatataaagcgtaatattttgtgctttatattaaatctttagttttgaatacttgcatgatatgatggaatatttgcatt

SEQ ID NO: 918 - DNA, 717 bp, Antirrhinum majus
aaaagttatcactctagctcagtagccgcaatcatgtcgaggagaaagaccagagagcctaaggaagacaatgtaactcttggaccagccactagggatggtgagctagttttcggtgtggcacacatctttgcgtcatttaacgacacgttcattcacgtgactgatttatctgggagggaaacaatggttcgcataacaggtggtatgaaggtgaaggcagatagagatgaatcctcaccatatgctgctatgcttgctgcgcaagatattgctcaaagatgcaaggaactgggtattaatgctcttcatattaagcttcgtgctactgggggcaacaagactaagacccctggtcctggtgctcagtctgcacttagagcccttgctcgtacaggcatgaagattggtcgtatagaggatgtgactccaattccgaccgacagcactaggaggaagggtggtagaaggggaagaaggttgtaatttgtcatttgttgtcatcaggagaacccgggtggaggttcagatgtttttccaaatttgccgattttttttaactagtatttgaactacattgtagtttgaaagattaatttgttttaatgtttaatcatcaagcggattaaaagattatgaattgttttttcgtgttgtgacatcattcctggcactctcaaagcaagctagaactcgcaagaaaataccatgatttct

SEQ ID NO: 919 - DNA, 814 bp, Antirrhinum majus
ggctttttcacattgtatctcttcctcaactctttattctgaaaccctaattcccttctcagttcatcgcacatcacattcctcctcttctcaattctcacattgccactgtaatttcttccacaattcaacggcatcatgtcgaggagaaagaccagagagcctaaggaagacaatgtgacactcggaccagccactagagatggtgaactcgtgtttggtgttgcgcacatcttcgcttcgttcaatgacactttcatccatgttactgatttatctggtagagaaaccatggttcgtatcacaggtggtatgaaggtgaaggctgacagggatgaatcctcaccgtatgctgctatgcttgctgcacaagatattgctcaaagatgcaaggaactcggcattaatgctcttcacattaagctccgtgctactgggggcaataaaactaagacccctggccctggtgctcaatctgctctcagagcccttgctcgtactggcatgaagattggtcgtatagaggacgtgactccaattcctactgacagcactcgccgaaagggtggtagaaggggaaggaggctgtaatttgtcgattgcagtcaggattacttgcagttatggttgggatgcttttccagtgttgcaaattttgttattttaaattcgaaaagctttcagtttgatgttcgaacttttttgactttgatatttgattgcttagagcatgattaactataagagtattttggtcgaacaagcttaagcatggtacacttctgctttttaatggaatcctcgtcttttttct

SEQ ID NO: 920 - DNA, 1009 bp, Antirrhinum majus
agcttttgatcaaagaaaaaagaaagaaagaacttgctacctacgtaccaatgaagcctccaagcatttcatcttcccttgtatttgttttcctagtgatcatcctttcttgcttccgtccctctcattccctcggccctcatggttttcttcaatgcctagacgaattgggactttctagattagtttacaccccaagaaacccgtcctactttccaatcctcgatgtagagattgataatcgaagatatgcaaccccctcaactcctaaaccatttctcattgttacaccagaggaagaacttcryatcymgmtaatccctctccgttccacaatcgccttaagccatgtcgaggagaaagaccagggagcccaaggaggacaacgtaaccctaggacctgcaactagggatggtgaattagtgtttggtgtggctcatatctttgcctcgtttaacgataccttcattcatgtaactgatttatctggaagggaaacgatggttcgtattacaggtggtatgaaggtgaaggctgatagggatgaatcctcaccatatgctgctatgcttgcagcacaagatatatctcaaagatgcaaggagttgggtatcaatgctcttcatattaagctccgtgccactgggggtaacaagaccaagacccctggtcctggtgctcaatctgcacttagagccctcgctcgttcaggcatgaagattggtcgcatagaggacgtgactccaattccaactgacagcacccgcagaaagggtggaagaaggggaaggaggctgtaagttgttatttgtggtcaggagcagttgggatggttctatatattgcaaattttgttatattttactatttaagaaacttgtagtttcagcatggagttgttttgatttttgatcacctgatttaccattttgatatagaatgttgctgaaaacaaactttttaagtgcatcagtttttctcttaaatgttgagaccaaaaaaaaaaaa

SEQ ID NO: 921 - DNA, 809 bp, Malus domestica
cgcctactcacgcccctcagtcttctctgcttagggtttttacagtcggccaaagcaaccagcagccacctccaaaccctagcacycaatctctccgtttcgcagccatgtcgaagaagaaggttagagagccaaaggaagacaatgtcacccttggtcccatcctcaaggatggagaacatgcctttggtgttgcacacatttatgcgtcattcaatgacacattcattcatgtgactgatctgtcaggaagagaaacccttgtgcgtatcaccggtggtatgaaggtgaaggctgacagggacgagtcttccccatatgctgctatgcttgcagcacaggatgttgcgcagagatgcaaggaattgggcattactgcacttcatattaagctccgtgccactggcgggaacaaaacaaaaacacctggtccaggtgcccagtctgccctccgtgctcttgctcgttctggaatgagaattggtcgtatagaggatgtgactccaattccaactgacagcacccgtagaaagggtggaaggagaggaaggaggctgtaagctttgcacctcttatctggtcagaactgcttgtcagggtggtcgctgtgcctcagttggattatgttacttcgaaattaggcgctgttactttcggtttcgaaactctctagttttttactatgtttttcgaaagttttatttccaattaattcggaaagagttctgctactcttttaagttttgttttgttatttatactgttattctggtctgcaatgaagtatcttttggtctaataaaaaaaaa

SEQ ID NO: 922 - DNA, 565 bp, Malus domestica
tgccggagcgtcgtcgttctaaataatctgtgacctcttaccaaatcatttgctcgcagccatgtcgaggaagaagaccagggagcccaaggaggataatgttactcttggacctgtgctccgcgacggagagcatgctttcggtgttgctcatatttttgcctcgtttaatgataccttcattcatgtgactgacttgtccggtagggagactcttgttcgcatcaccggtggtatgaaggtgaaagctgatagggatgaatcatctccttatgcagctatgcttgccgctcaggatgtttctcaacgctgcaaggagcttggcattactgctctacatataaagctccgggctactggagggaacaagaccaagactcctggtccaggtgcccaatcagcactcagagcccttgctcgttctggcatgagaattggccgcattgaggatgtgactccgattcccaccgatagtactcgaaaaaaaggtggtagaaggggaagaaagttgtaatttcttcctcgccttcaactgcgtctcgttcctgctgctgctgctcggttt

SEQ ID NO: 923 - DNA, 882 bp, Malus domestica
ctctaacacaatggaatccattgtgttggggtttttccagtcggccaaagcaaccagcagactcctccaaaccctacccccccaattctccccgtttcgcagccatgtcgaagaagaaggttagggagcctaaggaagacaatgttacccttggtcccattctcaaggatggagaacatgcctttggcgttgcacacatttatgcgtcattcaatgacacattcattcacgtaactgatctgtcaggaagggaaacccttgtgcgtatcactggtggtatgaaggttaaggctgacagggatgagtcttccccatatgctgctatgcttgcagcacaagatgttgcacagagatgcaaggaattgggcattactgcacttcatattaagcttcgtgctactggcggcaataaaactaaaacacctggtccaggtgctcagtctgccctccgtgctcttgctcgttctggaatgagaattggtcgtatagaggatgtgactccaatacctaccgatagcacccgtagaaagggtggcaggagaggaaggaggctgtaagcttgcccctgttatctggtcagaactgcttgtcacggtggtcgccgtgcctcggttggattatgttactccgaaataggcgctgttgctttctgtttcgaaactatgtagcttttgacttaagtttcttcaaaagatttattttcaattaattcggaaagagttttgcgactcttgaagttttgttttgttatctactctgctattgtggtctgcaacgaagtatcttttggtctatttcattttagggttaatctctgtttattactctcatgtttcttggttttcaatgtttagtacatcaagtttttttagttccagagtc

SEQ ID NO: 924 - DNA, 777 bp, Prunus armeniaca
ccacgagggttttgaaagcgctgagcttgagcgcccacagttgtgaataacctctaagtaatcgcctgcttgtagccatgtcgagaaggaagaccagggagcccaaggaggaaaatgtcactctcggacctgctctccgagatggagagcatgcttttggtgttgctcatatttttgcctcatttaatgatacattcattcatgtaactgacctgtctggaagggagacacttgttcgtatcactggtggtatgaaggtgaaagctgatagagatgaatcatcgccatatgcagccatgcttgcggctcaggatgtttctcaacggtgcaaggagcttggcattactgctttacatataaagctccgggctactggagggaacaagactaagactcctggtcctggtgcccaatcagcactcagagccctggctcgttctggcatgagaattggtcgtattgaggatgtgactccaattcccactgacagtactcgtagaaagggtggcagaaggggaagaaggttgtgattgcttacaattgtgtggtttcagctggcgatgtggtttctgggatatttttgttttggataaaaaaaatttattatcagccttgctatcggcttggacgtagttttaaacctagttagattattgtgccagaaaagagaactagaatttgatttggttggcaattatcatttgagctttacacatcaaatgctgttattcacttgttttttcaaggtttttaatcggatgctggattttatgttta

SEQ ID NO: 925 - DNA, 761 bp, Prunus armeniaca
ttttatagctgacaaargckcaccaagagcctcctcgaaaacctagcacccaatctcatcacttcgcagccatgtcaaggaggaaggttagggaaccaaaggaagaaaacgttactcttggtcctaccctcaaggatggagaatatgcctttggtgtggcacacatttttgcgtcatttaatgatacattcattcatgtgacagatctgtcaggaagagaaaccttggtgcgcatcactggtggtatgaaggtgaaagctgacagagatgagtcttcaccatatgcagctatgcttgcagcacaggatgttgcacagagatgcaaggaattaggtattaccgctcttcatatcaagctccgtgctactggtggtaacaaaaccaaaacacctggtccaggtgcccagtctgccctccgtgcccttgctcgttctggaatgagaattggtcgtatagaggatgtgactccaattcctactgatagcacccgtagaaagggtggccgaagaggaaggaggctgtaaagcctgcacttcttatctggtcagacctgtatgtcatggtggttgctggattatgggtctctgaaactaggagctgttactttcagttttgagactagcttttgactgtgtttgcaaaagatttatattttcaattaatttagaaagagttgatgagactcttgaagtttttgtttgttatccgtactatgttaatgtggtctacaatgagctattttatggcacgtttatggacta

SEQ ID NO: 926 - DNA, 810 bp, Aquilegia formosa
ctttctacaggttgggcaactgaaactatctctctgctctttctatctctctctctctctctctctcactccaaccatgtcgaagaagaagactagagagcccaaaacagagaatgtaaccaaccttggacctgctgtacgagaaggcgagcatgtttttggtgtggctcacatctttgcatcatttaatgataccttcattcatgtcactgacttgtctggaagagaaaccatggttcgtatcactggtggaatgaaggttaaagctgatagggatgaatcttcgccatatgcagccatgcttgcttcacaggatgttgcacagcgatgcaaggaacttggtattactgctttgcacattaagcttcgtgccactggaggaaacaaaactaagacccctggtccaggtgctcaatctgcactcagagcccttgctaggtctgggatgaaaattggtcgcattgaggatgtgacacctattcctactgacagcactcgtcgaaagggtggcagaagaggaagaaggctctaaggtcctggatgtggggtggttatggtggtggatcatctagttttggaggagtcttttctttacttatttggatgaacattattgtagttggcctggactgctggttgacataagattgttaagctcctattggtactgaagggtaacaggataaccaacatttctgtgtttttgcactttcataaatttattttatgttgtttattcatagatagtgaatggggaaactctgaattccaattcttgtgccttaacaatatttgatagctttggttaat

SEQ ID NO: 927 - DNA, 754 bp, Arabidopsis thaliana
gatttctgattcttccatcgtttctctcttgcaaaactctgtgtgtaggcggaactacagaaccaagagcctctttctaatcggagttactttaatccccttgaaccatgtcaaagagaaagactaaagagccaaaggtcgatgttgtgactcttggaccatctgttcgtgagggagagcaagttttcggtgttgtccacatctttgcttcattcaacgacactttcattcatgttactgatttgtctggtcgtgaaactcttgtccgtatcaccggtggaatgaaggtgaaagctgatagagatgagtcctcaccttacgcagctatgcttgcagcacaggatgttgctcagcgatgcaaggaacttggtatcactgccatgcatgtgaagctccgtgccacaggtggaaacaagaccaagacacctggtcctggagcacagtctgcccttagagcccttgctcgttccggcatgaaaataggccgtattgaggatgttactcccatcccaacagacagtacccgcagaaagggtggtagaagaggaagaaggctctgagtttttctcgcattgtgggatgttttctatttagctccatgtgtttcattttgtctgaaccatttttgtttgtgttagattgttgaagagctttggagtttaacactttttgttaatttaatcaacatttttctactttgatatgtgagtttggccttaaattagtataattggcttccatgattgctatgatg

SEQ ID NO: 928 - DNA, 827 bp, Arabidopsis thaliana
tgtccttcttgtttacactgagcagaatctaaaaacacttatcgtttcgtctcttctctgatccattgttgaagatgtcgaagagaaaaactaaggagccaaaggttgagactgtgactcttggaccttctgttcgtgaaggagagcaagtttttggtgttgttcacatctttgcatctttcaatgacactttcattcatgtgactgatctctccggtagagaaactctcgtccgcatcaccggtggcatgaaggtgaaggctgaccgtgatgagtcctctccttatgctgctatgcttgcagctcaagatgttgctcaaagatgcaaggagcttggcatcactgccatgcacgtgaagctccgtgctactggaggaaacaaaaccaagactccaggtcctggtgctcagtctgctcttagagcccttgctcgttctggcatgaagattggtcgtattgaggatgtgactccgattcccacagacagtacacgccgaaagggtggacgaagaggaagaagactctgattgcacgatgaggctcatcatcgttgcaatgtgctcttgagactgtgggtattttcttgggtacacttcgaagttagttttgtctctctccaatttatctttccagttgctttgagaacattataagctgtgtttttttgtatttggagtttttggtattgagaaaaaaaatgttaagttactgatcgcgtcgtgttactgttagttggcttattgatattttacattttctctctttttaactttggcgaatggatactttatcgagatatttaatgctatggttgctcatcagaatca

SEQ ID NO: 929 - DNA, 826 bp, Arabidopsis thaliana
ttaaagcaaattctgatccgtctctttcgctagctaaaggtaaaaggcggaacaacaaaagaaaccctagcttccctttgtacctctctctgttccaaaccatgtcgaagagaaagaccaaagagccaaaggttgagaatgtgactcttggaccagctgttcgtgaaggagagcaagtctttggagttgttcacgtctttgcttcattcaacgacactttcattcacgtgactgatttgtctggacgggaaacacttgttcgcatcactggtggaatgaaggtgaaagccgacagagatgagtcctcaccttatgctgctatgcttgcggcacaagatgttgctcagcgatgcaaggaacttggaatcactgccatacatgtgaaactccgtgccactggtggtaacaagaccaagacccctggacctggtgctcagtctgctctaagagcccttgcccgttctggcatgaaaattggtcgcattgaggatgtgactccaatcccaaccgacagtacccgcagaaagggtggaagaagaggaaggaggctctgagttatttggcctctcgttggatctccttatgtagctttctcaatgtttcattttgttttttcttagtttgaaaagagttttggaattactatgctttgttatagtctcaactctgaacagctttggatctttttctgtatgaccataagatattcaaaaattggtagtcattttatctcacaaaaaaaccttgaatttgtgctgtatgattttgtaaagtcttaggtgccaaatctttgattggagttgataaaatatttttatttggttgt

SEQ ID NO: 930 - DNA, 695 bp, Artemisia annua
cttttctgctgccatattatttcacaccgccggcagacaaaacacacacacaaacaccaaaacacacaccaaacaacaacaacatgtcgaagcgaaaggttagagagccaaaggaagacaatgtcactcttggaccagctacccgtgaaggagagcttgtatttggtgttgctcacatctttgcttctttcaatgataccttcattcacgtgactgatatctctggacgtgaaaccatggttaggattactggtgggatgaaagtgaaggctgatagggatgagtcatctccctatgctgctatgcttgctgctcaagatgtttcaacccgatgcaaggagcttggtgtcaatgctcttcacatcaagttgagggcaacaggaggaaacaagactaagacacctggtcctggtgcccagtcagcactcagagctcttgctcgttctggcatgaagattggtcgcattgaggacgtgactccaattccaacagacagcactcgtcgcaagggtggtaggagaggaaggaggttgtaagctgttggtctactattctgcaaatttgcatcatgtttgcattttcggttgtttaatgttttggcaacttttagaggttattatgtttttgtcgacatttaatatcattaagaatcgttatggatctctggatgttttaatgacatgaatttttggtca

SEQ ID NO: 931 - DNA, 908 bp, Artemisia annua
actcatcaccattttgcagcacaaaactccacgccacgccaccatgtcgaagagaaagaatagggagcctaaggaagatgtcactcttggacctgctactcgtgagggagagcttgtgtttggggttgcacacatctttgcgtcgtttaacgacacattcattcatgtgactgatatctctggacgtgaaactatggtcagaattacaggtgggatgaaggtgaaggctgacagagatgaatcttctccttatgctgctatgcttgctgctcaagatgtttctacccgatgcaaggagcttggtgttactgctcttcacattaagttgcgagctactgggggtaacaagaccaagacacctggtccaggtgcccaggctgctctcagagctcttgctcgttctggcatgaaaattggtcgcatagaggatgttaccccgattccaactgatagcactcgcagaaagagtggtagaaggggaagaaggctctgatctcgcaataccgagctgcattttcatatggattatcggatggagttatgttcaccaagtttcggttttctgttgccattcgatagtttagataatttcaagcattgtggcaaacaatttacagttatcgtcgttctttttggatagagtatatgacgctttctacaagctttactgccttactgtttgacttttgttttggtaatatcgttgaatatggtaaaagaatgtgcaagactggccatatgaacttggtaggtctggctcggcttaacctgttggcattgctggttttgttacgacctcatggttctttctgccacaataacacagaaaatgaagagactatgaaagtaactaaactgtactaatacggttttaaaaatcytggcttgttcagattagaaaattgtca

SEQ ID NO: 932 - DNA, 713 bp, Artemisia annua
accctaatctgcaccaccttactctcatcagcagcagcagcagcagcaaacaacaacaacacaaggccgccatgtcgaagcgaaaggttagagagcctaaggaagacaatgtgacccttggacctgccactcgtgagggagagcttgtttttggtgtggcacatatctttgcgtcgttcaacgacacattcattcatgtgactgatatttctggaagagaaaccatggttcgcataacaggtgggatgaaggtgaaggctgacagagatgaatcttctccttatgctgctatgcttgctgctcaagatgtttccactagatgcaaggagcttggcgtgaatgctcttcacataaagttgcgggctactggaggtaacaagaccaagacacctggtccaggtgcccagtcagctctcagagctcttgctcgttctggcatgaaaattggccgcattgaggacgttactccaattccaactgacagtactcgcagaaagggtggtagaagaggaaggaggttgtaatttggatcagcaaagctgcatgtgtcgatggatcatcgtcttttcatgtttgaactagttttgctctatagttacagttgacagtttgatgttactgcgacgtttatctgattgttgtctgaatggattgatgattctgaattatttatgtgttgggccgttatggaaattggaaaagccagtttatat

SEQ ID NO: 933 - DNA, 575 bp, Persea americana
actctttccaaggtctgcgagggaagcaacgattcttcttcttctccaaacaatctgatccgcagccatgtcgaaaaggaagacaagggaggtgaaggaggataacgtgacacttgggccgactgttcgagagggagagcatgtattcggtgtagcccacatcttcgcatcatttaatgacactttcattcatgtaactgatctgtctggaagagaaacaatggttcgcattactggtgggatgaaggtcaaggccgatagggatgaatcttctccttatgctgccatgcttgcagcacaagatgtggctcaacgatgcaaggagcttggaattactgctttgcacattaagcttcgggccactggtggaaacaagacaaagacaccgggtcctggtgctcaatcagctcttagagcccttgctcgatctggaatgagaattggtcgcattgaggatgtgactccaattcccactgatagcacccgcagaaagggtggtagaagagggaggaggctgtagaggatggcagaacagsgaggaggttgtgtgtwytggttacgaaggaccwtgyttt

SEQ ID NO: 934 - DNA, 524 bp, Brassica juncea
ttaacaatgtcgaggagaaagacgagagagcccaaggaggagacagtgacacttggaccagctgttcgcgatggagagcaagtcttcggtgttgtccacatcttcgcttccttcaacgacactttcatacacgttactgatttgtctggacgtgaaacccttgtccgtatcactggtggaatgaaggtgaaagctgacagagatgagtcatcaccttacgcagctatgcttgctgcgcaagatgttgctcagcgatgcaaggagcttggaatcaccgctatgcacgtgaagctccgtgccactggtggaaacaagaccaagacacctggtcctggtgctcartctgctcttagagctcttgcccgttctggcatgaaaattggccgcattgaggatgttactccaatcccaacggacagtacccgccgaaagggtggtagaagaggaaggaggctctaagcttttggctatttagctcatttgtttcattttgtcataacaatgttttcttgaattttgtgaaa

SEQ ID NO: 935 - DNA, 690 bp, Brassica juncea
cccaaaaacacacagcatttccgtctcttctcatacgttggtgaacatgtcgaggagaaagaccagagagcccaaggaggaaaccgtcactctaggacctgctgttcgtgacggagagcaagttttcggtgttgttcacatctttgcttctttcaacgacactttcattcatgttactgatctgtcgggaagagaaactctcgtccgtatcaccggtgggatgaaggtgaaggctgaccgtgatgagtcctctccttatgctgctatgcttgcagctcaagatgttgctcaaagatgcaaggagcttggcatcacagccatgcacgtgaagctccgtgccactggaggaaacaaaaccaagactccaggccctggtgctcagtctgctctcagagcccttgctcgttccggcatgaagattggtcgtattgaggatgtgactccaattcccaccgacagtacgcgtagaaagggtggacgaagaggaagaagactctgattgccgcccgatgaccctcatggtggttgtgctcttgactcgagtcgtttcttgggtacacacatttgaagttagttttgtctctctttgattatctttcgaaaactttataagctttgcgtctttcttcagcattgtaaacttttgcatttgatgtcttgggaatgagaaaaagtgaccatgtgttattg

SEQ ID NO: 936 - DNA, 493 bp, Brassica juncea
acacttggaccagctgttcgtgatggagagcaagtcttcggtgttgtccacatcttcgcttccttcaacgacactttcattcacgttactgatctgtctggacgtgaaacccttgttcgtatcactggtggaatgaaggtgaaagctgacagagatgagtcctcaccttacgcagctatgcttgctgcacaagatgttgctcagcgatgcaaggagcttggaatcaccgctatgcacgtgaagctccgtgccactggtggaaacaagaccaagacacctggtcctggtgctcagtccgctcttagagctcttgcccgttccggcatgaaaattggccgcattgaggatgttactccgatcccaacrgacagtacccgccgaaagggtggtagaagaggaaggaggctctaagtatttttttttggctatttaagctctcatgtgtttcattttgtctgaacaatgtttcttcaagttttgttaaagggattta

SEQ ID NO: 937 - DNA, 654 bp, Brassica juncea
ggctagctgaaggcggaaacacacaagagaaacccaagattcgaaaccatgtcgaggagaaagacaagagagccgaaggaggagacagtgacacttgggccagctgttcgtgacggagagcaagtctttggtgttgtccacatctttgcttctttcaacgacactttcattcatgtgactgatttgtctggacgggaaacacttgttcgtatcactggtgggatgaaagtgaaagctgacagagatgagtcctcaccttatgctgctatgcttgctgctcaagatgtcgctcagcgttgcaaggaacttggtatcacagccatgcatgtgaagctccgtgccactggtggtaacaagaccaagacccctggccctggtgctcagtctgcactcagagcccttgcccgttctggcatgaaaattggtcgcattgaggatgtgaccccagtcccaacagacagtacccgcagaaagggtggaagaaggggaaggaggctttgagtactttctggccttaggtggaagatcctatatgggctgggctcatccctatgtgtttcattttgttttgtttggtacattttgaaaaagagtttttgattactatatgcgacgctgttgttgtctaaactcacatatttatgttcctcctga

SEQ ID NO: 938 - DNA, 686 bp, Brassica juncea
ttcctttcgaaaccatgtcgaggagaaagacgagagagccgaaggaagagacagtgactctcggtcctgctgttcgtgatggagagcaagtctttggtgttgttcacatctttgcctctttcaacgacactttcatccatgtgactgatttgtctggacgtgagacacttgttcgtatcactggtgggatgaaagtgaaggccgacagagatgagtcgtcaccttatgctgctatgcttgctgcacaggatgtcgctcagcgttgcaaggaacttggaatcactgcgatgcatgtgaagctccgtgccactggtggtaacaagaccaagacacctggtcctggtgctcagtctgcactcagagctcttgcccgttctggcatgaagattggtcgcattgaggatgtgactccaatcccaaccgacagtacccgcagaaagagtggaagaagaggaaggaggctttgagtttctttttatgggatgggctcatctctatgcgtttcattttgttttgtttggtagattgaaaaagagtttttgattactatatgcggcgctgttgttgtctaaactcttcacatatttacgttcttcctagatgtaccatcacatatccataataattgggttgatttatgctatattgtctttcttaaaaaattaatcatcagtattcagtgattt

SEQ ID NO: 939 - DNA, 702 bp, Brassica juncea
ctctctctcttgtttccgctgccagcttcccgcaagccctatagcaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgacactttcattcatgtgactgatctgtctggaagagaaactctcgtccgtatcaccggtgggatgaaggtgaaggctgatcgtgatgagtcctctccttatgctgctatgcttgcagctcaagatgttgctcaamgwtgcaaggagcttggsattacagccatgcacgtgaagctccgtgccactggaggaaacaaaaccaagacaccaggccctggtgctcagtcagctctcagggcccttgctcgatcaggcatgaagattggtcgtattgaggatgtgactccaattcccaccgacagtacacgtagaaagggtggacgaagaggaaggagactttgatttctcaatgagcctcatcattgttcagttgtgcccttgactcttgtgggtacacacttcgaagttggtttttgtctctgtctctctctctagtttttctttcaagttgcttcgtaaaacattataagctgtgtctttcaacgttgtaaacttttgcatttggagttctgggaa

SEQ ID NO: 940 - DNA, 714 bp, Brassica juncea
accgccacagcttccagagaagagcagcttccaaaagccttagcatttcgtctcttgtcatccattgctgaatatcatgtcgaggagaaagacgagagagcccaaggaggaaactgtcactctcggacctgctgttcgtgacggagagcaagttttcggtgttgttcacatctttgcatctttcaatgacactttcattcatgtgactgatctttcaggaagagaaactctcgttcgtatcacaggtgggatgaaggtcaaggctgaccgtgatgagtcctctccttatgctgctatgcttgctgctcaagatgttgctcaaagatgcaaggagcttggcattacggccatgcacgtgaagctccgtgccaccggaggaaacaaaaccaagactccaggccctggcgctcagtctgctctcagagcccttgctcgttctggcatgaagattggtcgtatagaggatgtgactccaattcccaccgacagtacacgtagaaagggtggacgtagaggaagaagactttgatttccccatgagcctcatcactgttcagttgatgtgcccttgactctggtggtttcttggctacacacaccgaatttagatttgtctccttccattttatcttttcattttgcttcgaaaacattataagttgtgtctttcttcaacgtttgtaactttttcatttggtgttttggtaatgagaa

SEQ ID NO: 941 - DNA, 733 bp, Brassica oleracea
gactgccacagcttccagagacgagcgtccttaatccctagcatttcgtcttttgtctcatccattggtgaacatgtcgaggagaaagaccagagagcccaaggaggaaacggtcactctcggacctgctgttcgcgacggagagcaagtgttcggtgttgttcacatctttgcttctttcaatgacactttcattcatgttactgatctgtcgggaagagaaactctcgtccgtatcaccggtgggatgaaggtgaaggctgaccgtgatgagtcatctccttatgctgctatgcttgccgctcaagatgttgctcaaagatgcaaggagcttggcatcacagccatgcacgtgaagctccgtgccactggaggaaacaaaacaaagactccaggccctggtgctcagtctgctctcagagcccttgctcgttctggcatgaagattggtcgtattgaggatgtgactccggttccaacagacagtacacgtagaaagggtggacgaagaggaagaagactctgattgctcaatgagcctcgtcatcgttcagttgttgtgcccttgactcgagtagtttcttgggtacaagttagtcttgtctctctctccgatttatctttcaagttgcttcgaaaactttataagctttttgcgtttttcttcatcattgtaaacttttgcatttgggaatgagaaaaaaatgacgttgtgttatctttatcgctattt

SEQ ID NO: 942 - DNA, 695 bp, Brassica oleracea
gctctccctcttgccaaatctctgcatcggcggcgcaactacaggaagaaagacgatctttcacatccatttcttgccctaaaacatgtcgaggagaaagacgagagagccaaaggaagagacagtgactcttggaccagctgttcgtgatggagagcaagtcttcggtgttgtccacatcttcgcttccttcaacgacactttcattcacgttactgatttgtctggacgtgaaacccttgtccggatcactggtggaatgaaggtgaaagctgacagggatgagtcctcaccttacgcagctatgcttgctgctcaagatgttgcccagcgttgcaaggagcttggaatcaccgctatgcacgttaagctccgtgccacgggtggaaacaagaccaagacacctggtcctggtgctcagtccgctcttagagctcttgcccgttctggcatgaaaattggccgcattgaggatgttactccgatcccaacggacagtacccgccgaaagggtggtagaagaggaaggaggctctgagtttttggctttttttgctctttatttcattttgtcagaacaatgttttcttgagttttctgaaacagtttcgaagttgaatgctttttgttaattggaacaacaatttttctgctctgattagtcgcattcgcgaatgacttcaattgttattttt

SEQ ID NO: 943 - DNA, 714 bp, Brassica oleracea
attaaagccaattctgatcttgtcgtctccttcgctagctgaaggcggaaacacacaagagaaaccctagattcgaaaccatgtcgaggagaaagacaagagagccgaaggaggagacagtgacacttgggccagctgttcgtgacggagagcaagtcttcggtgttgtccacatctttgcttctttcaacgacactttcattcatgtgactgatttgtctggacgggaaacacttgttcgtatcactggtgggatgaaggtgaaagctgacagagatgagtcctcaccttatgctgctatgcttgctgctcaagatgtcgctcagcgttgcaaggaacttggtatcacagccatgcatgtgaagctccgtgccactggtggtaacaagaccaagacccctggccctggtgctcagtctgcactcagagcccttgcccgttctggcatgaaaattggtcgcattgaggatgttaccccagtcccaacagacagtacccgcagaaagggtggaagaaggggtaggaggctttgagtactttctggcctcaggtggaagatcctttatgggctgggctcatcccttgtgtgtttcattttgttttgtttggtacattgaaaaagagtttttgattactatatgcggcgctgttgctgtctaaacaaatattcattgaatttggttgatttattctatgaagcaatcaaaattcatt

SEQ ID NO: 944 - DNA, 664 bp, Brassica oleracea
gactctcttcctctaagccaaggcggaaactacagaaggaagaagtgaccttgctgtgatctttaacaatgtcgagaagaaagacgagagagcccaaggaggagacagtgacacttggaccagctgttcgcgatggagagcaagtcttcggtgttgtccacatcttcgcttccttcaacgacactttcattcacgttactgatttgtctggacgtgaaacccttgtccgtatcactggtggaatgaaggtgaaagctgatagggatgagtcctcaccttacgctgctatgcttgctgcgcaagatgttgctcagcgatgcaaggagcttggaatcaccgcaatgcacgtgaagctccgtgccactggtggaaacaagaccaagacacctggtcccggtgctcagtccgctctcagagctcttgcccgttccggcatgaaaattggccgcattgaggatgtgactccgatcccaacggacagtacccgccgaaagggtggtcgaagaggaaggaggctctgagttttctatggctatttaagcactcatgcgtttagaacaatgtttctttgagttttgtgaacgagtttcggattgaatgcttttttgttaaattgaacaacatatatctactgccattagtctatgtcctttgtgaatgacgc

SEQ ID NO: 945 - DNA, 719 bp, Brassica oleracea
ggagtgttagacgcgcatcccacaagccctataacaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgatactttcattcatgtgactgatctgtctgggagagaaactctcgttcgtatcaccggtgggatgaaggttaaggctgatcgtgatgagtcttctccttatgctgctatgcttgccgctcaagatgttgctcaaagatgcaaggagcttggcatcacagccatgcacgtgaagctccgtgccactggagggaacaaaaccaagactcctggccctggtgctcagtcagctctcagagcccttgctcgttcgggcatgaagattggtcgtatagaggatgtgactccaattcccaccgacagtacacgtagaaagggtggacgcagaggaagaagactttgatttctcaatgagcctcatcattgttcttttgtgtccttgactcctcttgtggtttatttggtacacacttcgaagttagtttttgtctctctcccgtttatctttcaagttgcttcgtaaaaacattataagctgtgtctttcttctacgatgtaaacttttgcattggagttttgggaattataaaaactgttagtgact

SEQ ID NO: 946 - DNA, 619 bp, Brassica oleracea
gaaactctccgtyggcggaaactacaggaacaagaggctcttccatatcctttacttgccatgtcgaggagaaagacgagagagccaaaggaggagacagttacacttggaccagctgttcgtgatggagagcaagtcttcggtgttgtccacatctttgcttcattcaacgacactttcattcacgttactgatttgtctgggcgtgaaacccttgtccgtatcaccggtggaatgaaggtgaaagctgacagggacgagtcgtcaccatacgcagctatgcttgctgcgcaagacgttgctcagagatgcaaggagcttggaatcactgctatgcacgtgaagctccgtgcgactggtggaaacaagaccaagacacctggtcctggtgctcagtctgctctcagagctcttgcccgttccggcatgaaaattggccgtattgaggatgttactccgatcccaacagacagtacccgccgaaagggtggtagaagaggaaggaggctctgagtttctggcttgtttcttttttgtctgaacaatgttttcttgagctttagctttgtttcattttgtcagaacaatttcttttgaataacatttttctacaatggcg

SEQ ID NO: 947 - DNA, 701 bp, Brassica rapa
aagccaaggcggaaactacagaaggaagaagtgaccttgctgtgatctttaacaatgtcgaggagaaagacgagagagcccaaggaggagacagtgacacttggaccagctgttcgcgatggagaacaagtcttcggtgttgtccacatcttcgcttccttcaacgacactttcattcacgttactgatttgtctggacgtgaaacccttgtccgtatcactggtggaatgaaggtgaaagctgacagagatgagtcatcaccttacgcagctatgcttgctgcgcaagatgttgctcagcgatgcaaggagcttggaatcaccgctatgcacgtgaagctccgtgctacgggtggaaacaagaccaagacacctggtcccggtgctcagtccgctcttagagctcttgcccgttccggcatgaaaattggccgcattgaggatgtgactccgatcccaacggacagtacccgccgaaagggtggtagaagaggaaggaggctctgagctttctatggctatttaagctctcatgcgtttcattttgtcagaacaatttgtttttttaagttttgtgaactaagtttcgaagttgaatgctttttttttttgttaaattgaacaacatatatcctacgatcattagtctatggccttggtgaatgactttattggtgttatcttcgaaagtcacttataca

SEQ ID NO: 948 - DNA, 763 bp, Brassica rapa
ggtctctctctctctctctcttgtttccgctgccatcttcccacaagccctatagcaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgacactttcattcatgtgacggatctgtctggaagagaaactctcgtccgtatcaccggtgggatgaaggtgaaggctgatcgtgatgagtcctctccttatgctgctatgcttgcagctcaagatgttgctcaacgttgcaaggagcttgggatcacagccatgcacgtgaagctccgtgccactggaggaaacaaaaccaagactccaggccctggtgctcagtctgctctcagagcccttgctcgttcaggcatgaagattggtcgtatagaggatgtgactccaattcccaccgacagtacacgtagaaagggtggacgcagaggaagaagactttgatttctcaatgagtctcatcattgttctgttgtgcccttgactctcgtgggtacacacttcgaagttggtttttgtctctctcagtttgcttcgtaaaaacattataagctgtgtctttcttcaacgttgtaaacttctgcatttggagttttgggaatgagaaaaagtgttagtgactaaatgacgtttgtgttattgttaattggcttatatagctattttgc

SEQ ID NO: 949 - DNA, 626 bp, Brassica rapa
aactacaggaacaagaggctcttccgtatcctttacttgccctaaaccatgtcgaggagaaagacaagagagcccaaggaggagacagtgactcttggaccagctgttcgtgatggagagcaagtcttcggtgttgtccacatcttcgcttctttcaacgacactttcatccacgttactgatttgtctggacgtgaaacccttgtccgtatcaccggtggaatgaaggtgaaagctgacagggatgagtcgtctccatacgcagctatgcttgctgcgcaagacgttgctcagagatgcaaggagcttggaatcacagctatgcacgtgaagctccgtgcaactggtggaaacaagaccaagacacctggtcctggtgctcagtctgctctcagagctcttgcccgttccggcatgaaaattggccgtattgaggatgttactccaatcccaactgacagtacccgccgaaagggtggtagaagaggaaggaggctctgagtttttggcttgtttcttttttgtctgaacaatgttttcttgagttttagcttgtttcattttgtcagaacaatgcttttgaaccacatttttctacaatgattaatctatgacttttggaaatt

SEQ ID NO: 950 - DNA, 1406 bp, Brassica rapa
aacttggatcatcctcgagaagacctcagcgacactcgggagtggagatcatacaaacagctctctgcactttggcaagatcacctcccggaaccccagagacgagcaacatccaaacgcccctagcatttcgtcgctcgtcatccattgctgaacatgtcgaggagaaagaccagagagcccaaggaggaaaccgtcactctcggaccagctgttcgtgacggagagcaagtgttcggtgttgttcacatctttgcttctttcaatgacactttcattcatgtgactgatctttcgggaagagaaactctcgttcgtatcaccggtgggatgaaggtgaaggcagaccgtgatgagtcctctccttatgctgctatgcttgctgctcaagatgttgctcaaagatgcaaggagcttggcattactgcgatgcacgtgaagctccgtgccactggaggaaacaaaaccaagactccaggccctggtgctcagtctgctctcagagcccttgctcgttccggcatgaagattggtcgtatagaggatgtgactccagttcccaccgacagtacacgtagaaagggtggacgtagaggaagaagactttgattacctaatggtacttcaagttgtgcccttgactctgtggtagtttcttgggttcacacttcgaagttagtttgcgtctcgttccattttatctttcatgttacttctaaaacatcataagttgtgtctttcttyaacgttgtaacttttgcatttgcagttttgggaatgagaaaaagttaagccttcctgactgaactgggaaacaggctagacaaactactactaactcactggcagaagttcacattcaatcccagtggaggactgcggctgaagcgtgatataaacgagtatggagattttgtaaagagattcagtgttccatctgtggaggagaaatttgagcttctgggcataatggcgaatgtattcatcgttgctccagaaagtctggcgacattgttcgagggtagtccaagcattcgcaaagacgcgcaaaggtttatacaactgcgggaagactataagagtgcaaagctggcaacaagactcagctcgttgtggccaagcttgagctgatgatacmartgtttaaagacamtrcttgaaccagtcctctactgccagagatatttatgtatattacttgaataaatcatatgccctcaactccctttgyyctcttcctatstatgagtcaatcaaacactttgaaccartcactcctttgtttttttttttaaactaattcactcckttgttagttrattctatarccagttaacaaatttggaaatttttgtyacactttgawmcagtttmatcctkgttaatgcatgattagyttkccctcc

SEQ ID NO: 951 - DNA, 757 bp, Brassica rapa
gctgactattaaagccaattctgatcttgtcgtctcctccgcwagctgaaggcggaaacacacaagagaaacccaagattcgaaaccatgtcgaggagaaagacaagagagccaaaggaggagacagtgacacttgggccagctgttcgtgacggagagcaagtctttggtgttgtccacatctttgcttctttcaacgacactttcattcatgtgactgatttgtctggacgggaaacacttgttcgtatcactggtgggatgaaggtgaaagccgacagagatgagtcctcaccttatgctgctatgcttgctgctcaagatgtcgctcagcgttgcaaggaacttggtatcacagccatgcatgtgaagctccgtgccactggtggtaacaagaccaagacccctggccctggtgctcagtctgcactcagagcccttgcccgttctggcatgaaaattggtcgcattgaggatgtgaccccagtcccaacagacagtacccgcagaaagggtggaagaaggggaaggaggctttgagtactttctggcctcaggtggaagatcctatatgggctgggctcatccctatgtgtttcattttgttttgtttggtacattttgaaaaagagtttttgattactatatgcggcgctgttgttgtctaaactctttacatatttatgttcctcctacatgaacatcaaatctatattattaaaactgaagtaccttttggtactgtttggaaacttag

SEQ ID NO: 952 - DNA, 794 bp, Brassica rapa
acgcactctcttcctctaagccaaggcggaaactacagaaggaagaagtgaccttgctgtgatctttaacaatgtcgaggagaaagacgagagagcccaaggaggagacagtgacacttggaccagctgttcgcgatggagagcaagtcttcggtgttgtccacatcttcgcttccttcaacgacactttcattcacgttactgatttgtctggacgtgaaacccttgtccgtatcactggtggaatgaaggtgaaagctgacagggatgagtcatcgccttacgcagctatgcttgctgcgcaagacgttgctcagcgatgcaaggagcttggaatcaccgctatgcacgtgaagctccgtgccactggtggaaacaagaccaagacacctggtcccggtgcgcagtccgctcttagagctcttgcccgttccggcatgaaaattggccgcattgaggatgttactccgatcccaacagacagtacccgccgaaagggtggtagaagaggaagaaggctctgagttttctatggctatttatttaatctcatgcgtttcatttcataacaatgtttttttttttgagttttgtgaacgagtttcggattgatcgctttttgttaaattgaacaacatatatctaytatcattagtctatggccttggtgaatgacttcattgctgttatcattattgtcaaaagtcacttattcaaagtcttcatcatttttgtttagagatctgtggtactgtggttatttaaatgtgataaagtaaaatcgttgcccttct

SEQ ID NO: 953 - DNA, 694 bp, Brassica rapa
ggttcttgtcaaacactttgtcggcggaaactacaggaacaagaggctcttccgtatcctttacttgccctaaaccatgtcgaggagaaagacgagagagcccaaggaggagacagttacacttggaccagctgttcgtgatggagagcaagtcttcggtgttgtccacatcttcgcttctttcaacgacactttcattcacgttactgatttgtctggacgtgaaacccttgtccgtatcaccggtggaatgaaggtgaaagctgacagggacgagtcatcaccatacgcagctatgcttgctgcgcaagacgttgctcagagatgcaaggagcttggaatcactgctatgcacgtgaagctccgtgccactggtggaaacaagaccaagacgcctggtcctggtgctcagtctgctctcagagctcttgcccgttccggcatgaaaattggccgcattgaggatgttactccagtcccaacagacagtacccgccgaaagggtggtagaagaggaaggaggctctgagtttttagcttgtttcttttttgtctgaacaatgttttcttgagttttagcttgtttcattttgtcagaacaatgcttttgaaccacatttttctacaatgattaatctatgacttttggaaattacttaataagttactttataagactgccatattttcttcg

SEQ ID NO: 954 - DNA, 706 bp, Brassica rapa
gatcactgccacagcttccagagacgagcaacatccaaaagcccctagcatttcgtctcgcgtcatccatagttgaacatgtcgaggagaaagaccagagagcccaaggaggaaactgtcactctcggacccgctgttcgtgacggagagcaagtgttcggtgttgttcacatctttgcttctttcaatgacactttcattcatgtgactgatctttcgggaagagaaactctcgttcgtatcaccggtgggatgaaggtgaaggcagaccgtgatgagtcctctccttatgctgctatgcttgctgctcaagatgttgctcaaagatgcaaggagcttggcattaccgcgatgcacgtgaagctccgtgccactggaggaaacaaaaccaagactccaggccctggtgctcagtctgctctcagagcccttgctcgttccggcatgaagattggtcgtatagaggatgtgactccagtacccaccgacagtacacgtagaaagggtggacgtagaggaagaagactttgatttccttattggttgtgcccttgactctgtggtagtttcttgggttcacacttcgaagttagtttgcgtctcgttccattttatctttcatgttacttctaaaacattataagttgtgtctttcttcaacgttgtaacttttgcatttggagttttgggaatgagaaaaaagtta

SEQ ID NO: 955 - DNA, 836 bp, Brassica rapa
gaatataaattcgatatctgattactctccctcttgccaaatctctgcatcggcggcgcaactacaggaagaaagacgatctttcacatccgattcttgccctaaaacatgtcgaggagaaagacgagagagccaaaggaagagacagtgacacttggaccagctgttcgtgatggagagcaagtcttcggtgttgtccacatcttcgcttccttcaacgacactttcattcacgttactgatttgtctggacgtgaaactcttgtccgtatcactggtggaatgaaggtgaaagctgacagggatgagtcctcaccgtatgcagctatgcttgctgctcaagatgttgctcagcgttgcaaggagcttggaatcaccgctatgcacgtgaagctccgtgccactggtggaaacaagaccaagacacctggtcctggtgctcaatccgctcttagagctcttgcccgttctggcatgaaaattggccgcattgaggatgttactccgatcccaacggacagtacccgccgaaagggtggtagaagaggaaggaggctctgagtttttggctttttctttgctctttatttcatttcgttagaagaatgttttcttgagttttctgaaagagtttcgaagttgaatgctttttgttaattgtggaacaacatttttctgctatgattagtcgcattcgcgaatgacttcaattgttattttaaaatgccataattttcatctctgaattagtgagacaaaatatcggttcaataccagccatttgcatgtactcttcaatttctgttagtgtttcaatggtgagctcatgattggta

SEQ ID NO: 956 - DNA, 748 bp, Brassica rapa
ccaaaaaccctagcagcatttcgtcttttgtctcatccattggtgaacatgtcgaggagaaagaccagagagcccaaggaggaaaccgtcacactcggacctgctgttcgtgacggagagcaagtgttcggtgttgttcacatctttgcttctttcaatgacactttcattcacgttactgatttgtcgggaagagaaactctcgtccgtatcaccggtgggatgaaggtgaaggctgaccgtgatgagtcctctccttatgctgctatgcttgccgctcaagatgttgctcaaagatgcaaggagcttggcatcacagccatgcacgtgaagctccgtgccactggaggaaacaaaaccaagacgccaggacctggtgctcagtcagctctcagagcccttgctcgttctggcatgaagattggtcgtattgaggatgtgactccggttcccaccgacagtacacgtagaaagggtggacgaagaggaagaagactctgattgctcaatgagcctcatcatcgttcacttgttgtgcccttagtttcttgggtacaagttagtcttgcctctctctctctctccggtttttctttcaagttgcttcgagaacttttataagcttttgcgaacttcttcagcattgtaaacttttgcatttgggaatgagaaaaaaagtgatgttgtgttattgttattttggattttctttataccatagtctttcctattactctattagtataaa

SEQ ID NO: 957 - DNA, 714 bp, Musa acuminata
ggctctcgttctccgtacttctcgccgtcgccctcaccctcgcctcccgtgcttcaaccatgtctggaagaaagaagactagggagcccaaagaagacaatgtgacgcttgggccagccgtacgggaaggggagcaagtgtttggtgttgctcacatctttgcgtcgttcaatgatactttcattcatgttacagatttgtctgggagggaaacactcgtycgtattacaggtggtatgaaggtcaaagctgacagggatgaatcatctccatatgcagccatgcttgcagcacaagatgttgcacagagatgcaaggaattggggattactgctttgcacattaagttgcgggctactggtgggaataagacaaaaacgcctggtcctggtgctcagtctgctctcagggcacttgctcgctctggaatgaaaattgggcgtattgaggatgtaactccgattccaacagacagcacccgcagaaagggtggaagaagaggaaggagactgtagttcatcaacttcatctgcatcaagttcattcccagtggttttgggacgtagtttggtcgttataaacagttatgtagctttgaatggtgaattgctttatctgtcattttgccgaaaaataacttatgaatgtgctttgctacttttgaggtgaacattcagcttttattatgatgaaagctacaggaattgctttgag

SEQ ID NO: 958 - DNA, 733 bp, Musa acuminata
tttttccaatccaaacgaaaccctagttttcgcggcgccgccctgccctcgccttcttccgcgcccaccatgtctggaagaaagaagaccagggagcccaaggaggataacgtgacacttgggccggctgtacgagaaggggagcaagtgtttggtgttgctcacatctttgcatcgttcaatgacactttcattcatgtcacagatttatctggcagggaaacgctggttcgcattacaggtggcatgaaggtcaaagctgacagggatgaatcatcaccttatgcagccatgcttgcagctcaagatgtggcacaaagatgcaaggaacttgggattactgctttacacattaagttgcgagcgactggtgggaataagacgaaaacacccgggcctggagctcaatctgctctccgagcgcttgcccgttctgggatgaaaattggccgtattgaggatgtgacgccgattccaacagacagcacccgcagaaagggtggaagaagagggaggagactgtagttcacccaaatgctgcggaaagaaccgtttattctgccattgtaggctttgaatctatgctgcatttgaggttcattctaattttgttaggatcgaagctacagcggtggctctatgttaatttactgtgattgagatttgagtgcatgatttctgttaagatgatatcttctagtatcatttacattaattatgttatatcttttga

SEQ ID NO: 959 - DNA, 770 bp, Musa acuminata
tttttccaacccaaacgaaaccctagttgtcgcgccgccgccgtcgcctcttccgcgcccaccatgtctggaagaaagaagaccagggagcccaaggaggataacgtgacacttgggccggctgtacgagaaggggagcaagtgtttggtgttgctcacatcttcgcatcgttcaatgacactttcattcatgttacagatttatctggcagggaaacgctggttcgcattacaggtggcatgaaggtcaaagccgacagggatgaatcatcaccttatgcagccatgcttgcagctcaagatgtggcacaaagatgcaaggaacttgggattactgctttacacattaagttgcgagcaactggtgggaataagacgaaaacacccggtcctggtgctcaatctgctctccgagcgcttgcccgctctgggatgaaaattggtcgtattgaggatgtgacgccgattccgacagacagcacccgcagaaagggtggaagaagagggagaagactgtagttcatccaaatgctacggaaagaacagtttattctgccattgtaggctttgaatctatgcttgcatttgaggttcattctaattttgttaggatcgaagctacagcggtagctctatgttaatttactgtgattgacatttgagtgcatgatttctgttaagatgatatcttctagtatcatttatattaattatgttatatcttttgactatctcatctggagattttctaatacatgtttatctcatct

SEQ ID NO: 960 - DNA, 739 bp, Musa acuminata
ggctgcggacggggggatatctcgcagccgttctctactgctcccacttcgaccatgtctggacgaaagaagaccagggagcccaaggaggagaatgtgacactagggcctgcagtccgcgaaggggagcaagtatttggtgttgctcatatatttgcatcattcaatgatacctttattcatgttacagatctttctgggagggaaaccttggttcgaattacaggwggtatgaaggttaaagctgatagggatgagtcatctccttatgcagctatgcttgcagcgcaagatgtggcacagcgatgcaaggaacttgggattactgctctgcatattaagctgcgagctactggcgggaataagacaaaaactcctggccctggtgctcagtctgcccttagggcacttgctcgctctggaatgaaaatcgggcgtattgaggatgtgacgccaattcctactgacagcacacgcaggaagggcggcagaagaggaaggcggctttaaactatttgtgcattgttttttcacccagttgccgtgaacaatttttaagactcatatttagctgttgaacagtgctcttaagctatgttctgactccacagttttctttggccaaattctgttcttgaggctgaggatatacaaacgtaatgctattacgatgttggttgtttcgaactataatttcacttgcttccatgcaagtcattgctgtgctattggcttgaac

SEQ ID NO: 961 - DNA, 630 bp, Musa acuminata
gggagcccaaagaggaaaatgtgacgcttgggccggctgtacgagaaggggagcaagtgtttggtgtcgctcacatctttgcatcattcaacgacactttcattcatgttacagatctgtctgggagggaaacactcgttcgtattacaggtggtatgaaggttaaagctgacagggatgaatcatctccatatgcagccatgcttgcagcacaagatgtttcacagagatgcaaggaacttggtattactgccttgcatattaagctgcgagcaactggtgggaataagacaaaaactcctggtcctggtgctcaatctgctctcagagcacttgctcgctctggaatgaaaattggccgtattgaggatgtaaccccgatccccacagacagcacccgcagaaagggtggaagaagaggaaggagactgtagttcatcagcatatctgcagcaaattctttcccttgccatttttgttgtcacaaacagttcggttgtttgttcaagatgaacagtttaatctcgcctttatttagctgaggatattcctgaatgcatgtttctcacggtactgctttcccacttttgagatttgcatgttaatttatattggctgaagattcctccc

SEQ ID NO: 962 - DNA, 961 bp, Hordeum vulgare
cggcacgaggctgagctttcggcggcggcggcgcagcactcgcgatctcaaccaggcgcgctctcctcctccccctcgccgtcgtcgtcgtctccgttccaccgccgctccgcgcaaccatgtcttcgaagaggaagaccagggagcccaaggaggagaacgtcacccttggaccggctgtccgtgagggggagcatgtctttggcgttgctcacatctttgcatccttcaatgacaccttcattcatgtcactgacttgtctgggagggaaaccctggtgcggatcactggtggcatgaaggtcaaggctgatcgtgatgaatcttcaccctacgctgctatgcttgcatctcaggatgtcgctacccgttgcaaggagcttggtatcaccgcactgcacattaagctccgtgctactggaggcaacaagaccaagacacctggacctggagctcagtctgctctcagggctcttgctcgttctgggatgaaaatcgggcgcattgaggacgtgactccagttcccactgacagcacccgccggaagggaggaaggaggggaaggaggctgtaggctatctttcaactctactggtggcaatcaagaaacttgctcctctctgggtagtcctgctgtttctatgaatgtcaagatgagctttaattttgctctgttgaggatcatttactgttagtccaactatgaatgttgcgtggatcctatttttggttcagaaactcggtatttatgcgtaaaactagcttttcagtctatggaaaaccttgaaatggagtgatatctttggtcacatggatgtttagtccttttggtgctgcgatgctggttggaaaagtacaccccttgtgcccaacgctttgaaatcactgtcttagatgcgttgctctactccaggttcccaacgctttgaaataattgtctttgatgcgttgctctgctcc

SEQ ID NO: 963 - DNA, 975 bp, Hordeum vulgare
cggggggctttatctttgcccactcctccacttcctccccgcagctctcgttcacttcaaaccctagcctcctcctcctcctcgccgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacactttcatccatgtcacggatctgtccgggagggagacgctcgtccgcatcaccggtgggatgaaggttaaagctgatcgtgatgaatcatccccttatgcagctatgcttgcatcacaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgcattgaggatgttactccagtcccaactgacagcactcgccggaagggtggtagaagaggaaggaggctgtaattccatgctcgttcaaggatggaacaataccaagctatcgatatcctgtgtcttgcaactttttctgtactattccgtttatgatgttaagtcggatcttgtggatttatagattttgagcgatattgtgttgcatgcttagaaatgacccattttccctttcaaatcaagtggtcgtcatctattattactcttcttctgctatggatgcactgggatgtgaaattcaaatttttgtttcatttaaaaaaaaaaaacttggggggggcggggaccatgtgcccttgggagcgattacaatacctggccggggttacaagcgggacgggaaaaccggggttaccactaatggcgtgaaacaatcccttctccgggggtaaacaaaagagcccccatcccttccaagttt

SEQ ID NO: 964 - DNA, 613 bp, Hordeum vulgare
gccaaatcccacacccaacagccacgaaatagttgtcaacatggctcccaagaaggccccccgcgctccccaggagaacatctcccttggcccccaggccagagaaggcgagctcatcttcggcgttgcccgcatcttcgcttccttcaatgacaccttcgtccacgtcactgatctcagtggccgcgaaaccatctgccgtgtcaccggtggcatgaaggtcaaggctgatcgtgacgagtcctccccctacgctgccatgttggccgctcaggacgtcgccatccgctgcaaggagctcggtatcaacgctctgcacatcaagatccgtgccactggtggtaacggcaccaagacccctggccccggtgcccagtctgcgctccgtgcccttgcccgttccggcatgaagatcggccgcatcgaggacgtcaccccaaccccctctgacagcacccgcagaaagggtggtcgccgtggtcgtcgtctctgagcgcatcattatatggagtgctcaattcaccaagactcctgggtgggaggatgctggggttgtgtttgtacagcacatctcatcggttttttcctggccatcagacttgggaggatcaca

SEQ ID NO: 965 - DNA, 611 bp, Hordeum vulgare
gcacgaggcagtcccttaacaccggccgaagcaaaaccacgaaattccttcgacgtgaccatcatgcctcctaagaaagccgcgagacctgcgcaggagaacatttctctcggtccccaattgcgtgaaggggaatcaaacgtattcgctactgctcgtatctttgccagtttcaatgacacctttgttcacattaccgatttgtccggccgggaaaccatcactcgcgttactggaggcatgaaagtcaaggctgaccgcgatgaatcctcgccatacgctgccatgttggcagcccaggatgtagccacaagatgcaaggaattaggcattaatgctctccacatcaagatccgcgcgacgggaggcaatggaaccaagacccctggcccaggcgctcagtcggctctacgtgcccttgctcgatcaggtatgaagattggaaggatagaagatgtgacgcccaccccgtcagactcgacccgtcgtaaaggtggtcgccgtggtcgtcgtctatgattttactgcgttgcgtatgggaatggattagcttgggcgagctgggagatgtacgcgagaatattttcatatcttaacctagtttcatgctc

SEQ ID NO: 966 - DNA, 657 bp, Ocimum basilicum
ctcgtgttagggtttaaacactcgagcttcacctatccccctgttctctccgtcgcagtcgaaagccatgtcgaaaagaaggaccagggagcctaaggaagagaatgtcacacttggacctgcgaccagggatggtgaactggtttttggcgttgcacayatatttgcttcattcaatgacacctttattcatgtgactgatttatctgggcgtgaaacaatggtccgyattacaggtggtatgaaggtcaaagctgacagggatgagtcttctccctatgcagctatgcttgctgcacaagatgtttctcaaagatgcaaggaattgggtataaatgctcttcacattaagctccgtgccactgggggaaataagaccaagacacctggtccaggtgctcagtctgcacttagagcccttgcacgttcaggcatgaagattggacgcatagaggatgttactccaatcccaactgacagcacsaggagaaagggcggcagaaggggaaggaggctgtaatttgtttgctactcgtagtttggcatttgtggtttggatgtgcttttttgaagttgaggattttactttcactatgagagtttcttttgtttgatcatctggataccgattgctcaacacagatattttttgggacg

SEQ ID NO: 967 - DNA, 682 bp, Ocimum basilicum
cgttcaatagccgccgaaagccatgtcgaagagaagaaccaccgttccgaaggaagagaacgttacacttggacctgctaccagggatggtgaacttgtttttggtgttgcacacatatttgcctcattcaatgacaccttcatccatgtgacagatttatctgggcgtgaaaccatggttcgtattacaggtggaatgaaggtcaaagctgacagagatgaatcctctccctatgcagctatgcttgcagcacaagatgtttctcaaagatgcaaggaattgggaatcaatgcacttcacatcaagctccgtgctactggtggaaataagaccaagactccgggtcctggtgcacaatctgcacttagagcccttgctcgttcaggcatgaagattggacggatagaggacgttacaccaatcccaactgacagcaccaggagaaagggtggcagaaggggaaggagattgtaagttgttccccatcaggaatctggcaattgtggtttgggttgctttcttgaagtcgaaagttttgttgccaagtttttgaacaattttattttaatgacgagaatttcttatgtttgatcatccgaacatcaacagttcaatcagggttttattatcttcaactattttgagttctagttatcatttataccgaagttgggtggcttc

SEQ ID NO: 968 - DNA, 820 bp, Phaseolus coccineus
cgcctatttattggccggggctagcgcttctatctttttcgtttttgtagaagcagcgtgaaacttgcgaagctcttcatcatgtcgaggagaaaagttagagagccaaaggaggaaaacgtgactctgggtccagctgttagagacggtgaacacgtctttggtgtcgctcgcatatttgcctctttcaatgacaccttcattcatgtcactgatttgtctgggagggaaacccttgtccgcatcacgggtggaatgaaggttaaagctgacagagatgaatcatctccatatgctgccatgcttgcagcacaggatgttgctgccagatgcaaggaactgggcataactgcactccatatcaggctccgtgcaactggtggaaacaagaccaaaacacctggtcctggtgctcaatcagctcttagggctcttgctcgttcaggaatgaaaatcggtcgtatagaggatgtgacacccattccttcggatagcactcgtagaaagagtggtagaagaggtagaaggctctaaatacaggggatgctatattttactttccatccgaaactgaactatggcattttgaaattttgctatcagaacttctaatgtatttgtttagcatattgaacactgttttaatggataacagacattttcttctttttttgttgaaagttctgcttgtttctgcttagcttgcaacgatgctgaatcgtctacttttgctaaaatgtttctaacgtttgattgattattgtacggaaatgggttattcgtgattgtactatttgccctgcaattgacttcacttttc

SEQ ID NO: 969 - DNA, 794 bp, Phaseolus coccineus
aagcagtggtatcaacgcaaagagtggcattatggccggggactttgctgcagcgacaacttcaaacggccgaaggttcatctaatctccgaatctaacgctgcgttgcaaaaatcatgtcgaggagaaaggttagagagccaaaagaagaaaatgtgactcttggtccagctgttagagacggtgaacatgtctttggcgtcgctcgcatctttgcctccttcaacgacaccttcattcatgtcactgatttgtctgggagggaaacacttgtccgcatcactggtgggatgaaggttaaagctgatagagatgaatcatctccctatgctgctatgcttgcagcacaggatgttgctgccagatgcaaggaactgggcataactgctcttcatatcaggcttcgtgccactggtggaaacaagacaaagacacctggtcctggtgctcaatcagctcttagagcccttgcacgttcagggatgaaaattggccgcatagaggatgtgactcccattccttccgacagcacacgtagaaagagtggaaggaggggtagaaggctttaagcttatactatatgactggagtcgccatgtttttatttgcaagtcaattagaatttgccatttcgaaattttgttttagttcatatcagaacttttattgtatttcttgaggtttcgaacacaatttaagttacgtgtagacattattgttaaaggtttttgaaagttctgaatgttgcttggtgtcttggaaagcttgctaattatccacttgatagaatatta

SEQ ID NO: 970 - DNA, 764 bp, Beta vulgaris
gggattcggccattacggccgggggagcttccagggttttccgcaccatcttctcattcacaaaaaccctaaccctaattctcacttttctctctcttccgtctactctgtaaccatgtcgaggagaaagaccaaagaacctaaggaagagactgttactcttggtcctactgttaaagagggagaacacgtttttggtgttgcgcacatttttgcctctttcaatgatacttttatccatgttactgatttgtctggaagagaaacccttgttcgtattacaggtggaatgaaggtgaaagctgacagggatgaatcttccccctatgctgctatgcttgcagctcaagatgtttctcaacgatgcaaggaacttggaattactgctctccacattaagctccgtgctactggaggaaacaagaccaagactcctggacctggtgctcagtctgctttgagagcccttgctcgttcaggcatgaaaattggccgtattgaggacgtgactcccatcccaacagacagtacccgcagaaagggaggaagaaggggaaggaggctgtgaattatcttggtcaaatactggtcatattgtcttatttctatggcttgagtagactagtttgctgttaaagcctttccttttcatttttgaagtcgaacttattgtagtttcgaattacccttatgcattatggaggtttgtttgaaagatgcaattttgaagatgtttgagattaaatacaaatctttatagttta

SEQ ID NO: 971 - DNA, 453 bp, Brachypodium distachyon
tccgggaggaagaagatgcgggagcccaaggaggagaacgtgacgctcggccccgccgtccgcgagggcgagcacgtcttcggcgtcgcccacgtctttgcctccttcaacgacaccttcatacatgtgaccgatctgtccgggagagaaacgctcgtacgcgtcactggtggcatgaaggttaaagctgaccgtgatgaatcctcaccttatgcagctatgcttgcatcaccggattttgctcaaagatgcaaggagctttgaattactgctttgcatattaagctccgtgctactggtggaaacaagacaaaaactcctggccctggtgctcagtctgcccttagagcacttgctcgatctggcatgaagattggtcgtattgaggatgtcactccagtaccgactgacagcacccgcaggaagggtggtagaagaggaaggagactgtaa

SEQ ID NO: 972 - DNA, 670 bp, Brachypodium distachyon
cgtctacacgtcccactccaaaccctagcctcctcctctacccctcgccgccgccgccgccgccgccgcgagcacgtccgggaggaagaagacgcgagagcccaaggaggagaacgtgacgctcggccccgcggtccgcgagggagagcacgtcttcggtgtcgcccacatcttcgcctccttcaacgacaccttcatccacgtcacggatctgtcagggagggaaactctcgttcgcatcaccggtggcatgaaggttaaagctgaccgtgatgaatcatccccatatgcagccatgcttgcatctcaggatgttgcagcacgatgcaaggagcttggaatcactgctctgcacattaagctccgtgctactggtggaaacaagacaaaaaccccaggtcctggtgctcaatctgcacttagagctcttgcacgttctggcatgaagattggacgcattgaggatgttactccagtcccaactgacagcactcgcagaaagggtggtagaagaggaaggaggctgtaatttctctgttacaaggatggaaccatactgttatcgattccttgtttggcaacttctgtactctgttgatgatggttaagtcggtcttgtggatttatagtttttgagctatattgtgttggatcgttagaaaatgaccct

SEQ ID NO: 973 - DNA, 762 bp, Brachypodium distachyon
ggcggcggcggcgaactcgtgatctgaaaacaagcaggcgccctctcatctcgtctacgattcgccgccgcttcacgcaaccatgtcgaaaaggaagaccagggagcccaaggaggagaacgtcacccttggcccagctgtccgtgaaggagagtttgtcttcggtgttgctcacatctttgcgtccttcaatgacactttcattcatgtgactgacttgtctgggagggaaacactggtgcggatcactggtggcatgaaggtcaaggctgaccgtgatgaatcttcaccttatgctgctatgcttgcgtctcaggatgttgctgcacgctgcaaggagcttggtattactgcactgcatattaagctccgtgccactggaggcaacaaaaccaagacccctggacctggtgctcaggctgctctcagggctcttgctcgttctgggatgaaaattggacgcattgaggacgtgactccagttcccactgacagcacccgcaggaagggtggaaggaggggaaggaggctgtagatgtcaccatccgttaccctcttgctatggcaaccaacaacttgctcctctgtgggtgtactgctgtttctctctttgtcagagaagctttgattttgctctgttgaggatcatttactgttagtcgaaacctatcatgttgcgtggatcgtatttttggttctgaaatttgtcatatttatgcgaaaactagcttttcagtctgaaaccttgcaatgttgtgatct

SEQ ID NO: 974 - DNA, 736 bp, Brachypodium distachyon
ggcagcggcgagctaaccacctgaatcacaaggagaggaagcaccggcgctcgtctcgatctcccgtctcctcgtaccaccatgtcgaagcggaaaaccagggagcccaaggaggagaatgttactcttggacccactgtccgtgaaggggagcatgtcttcggagttgctcatatctttgcatcattcaatgacacattcattcatgtcactgacttgtctgggcgggagacccttgttcgcattactggtggaatgaaggtcaaggctgatcgtgatgagtcatcaccatatgcagctatgcttgcttctcaagatgttgctacacgttgcaaggagcttggtatcactgctttgcacattaagctccgtgccactggaggcaacaagaccaagactcctggacctggtgctcaatctgctctcagggctctcgcccgttctggcatgaaaattggacgcattgaggacgtgacccctgttcccactgacagcactcgccgtaagggtggcaggagaggaaggaggctgtagacgccttttttccgtcgtctttcgatgtcgtcatcaagacttttaattactattttgataacctcgtagattcgatgggtcgtctgttcatgactttcagtttactctgagttcagagctgttaacttttagtttattgagagttatatttgtgtactgaattgcctgtcgtatttatgtgaaaaaagatcctatccaagca

SEQ ID NO: 975 - DNA, 737 bp, Bruguiera gymnorhiza
ccatccaaagtctccccctttctcagtcatgtcgaagagaaagactagggcacctaaggaagaaactgtgacacttggcccccaagtgagggaaggggagtatgtttttggagtggcccatatctttgcgtcattcaatgatacattcattcatgtgacagatctttctggaagagaaacccttgttcgtataactggtggaatgaaagtgaaagctgacagagatgagtcttcaccgtatgctgccatgcttgcagcacaggatgttgcgcagagatgcaaggaacttggcattactgctcttcacatcaagctccgtgctactggcggcaataagacaaaaacacctggtccaggtgctcagtctgctcttcgygcycttgctcgytctggaatgagaattggtcgtatagaggatgttactccaattccaactgatagcacccgtagaaagggtggcagaagagggcgaggctgtgaaagttggcttcagttgggtcagatctgtttctgtcctggttattcccatggatgcacgccaacttggtggaattcagctagaattcatcaaaataatttaatagtttctattggcttgccctgcccatcaaacaatttacgtttgaacacttgttgcaacagttaggtttcggttaaccggttaattttggcctcccggtcttggacctcaaacactgcatttatggatgtgttaaaaattgatttaaaaacccttt

SEQ ID NO: 976 - DNA, 852 bp, Theobroma cacao
acgcggggcttcgaaagccagagtccttggaggctaaagcatcagctaaagcgctctcagaaaccctagtttctccagctctcattcattagccggaagccatgtcaaggagaaaggttagggagcccaaggaggagaatactaatcttggacctgctgtacgagagggcgagcatgttttcggggtggctcacatttttgcytcatttaatgacacatttatccatgtgactgatttgtctgggagggaaacaatggttcgcatcactggtggcatgaaggtgaaagctgatagggatgagtcttccccttatgcagccatgcttgcagcacaagatgttgctcaacgttgcaaggagttgggtattactgccttgcatatcaagctccgagcaactggagggaacaagaccaagacacctggtcctggtgcccagtcagcacttagagctcttgctcgttcagggatgaaaattggtcgcatagaggatgtgactcccattcccactgacagtacccgtagaaagggtggtagacgtggaagaaggctgtgattcattgcttcctatctttttctcagctgctgctcctatgctggaagttttctttctttttttaaaacaattttctgattagattcaagcttgttttgccctgttctcttgttgcacatttgtagttctggaatggattttgatctgaatttacaaagacaaaagttgtggaactgttccatccaactttaaagataagcttataattattgttcttggttttccatgtggaggtgtaggaacgcccctyttataattaatttttatggttatggcaccttttgtttaatagcagtta

SEQ ID NO: 977 - DNA, 880 bp, Theobroma cacao
cgggagacatcacaaatgcagatgttgccgacaaatgctgagatgttctcttgggaaagctttaagcattgttcatcttctccgtcattttgaagtccactctccttaacgctctaaccctctcatcttctgccaacttcgaaccatgtcgaggagaaaggttagagagccaaaggaagataatctgaaccttggacctgctgtacgagaaggagagcatgtttttggtgttgcccacatatttgcttcatttaatgacactttcattcatgtgactgatttgtctggaagagaaactatggttcgtattacaggaggtatgaaggtgaaagctgacagggacgaatcttcaccttatgcggctatgcttgcagcacaggatgtttcccagagatgcaaggaacttggaatcactgcccttcacatcaagttacgtgctacaggagggaacaaaaccaagacccctggtccaggtgctcagtctgctctcagggctctcgctcgctctggaatgaaaattggtcgtattgaggatgtgactcctattcccaccgacagcacccgtagaaagggtggtagaagaggaagaaggctgtaaactagcaccttctattatagcaacctatccttcagttttggtggtagtgcttctgtttacttggtaatggttgttcattgtgactcttttttgtagttttaaccgacttggtagccctgggatttatatttgagtagtacaaatgaatggctctaaatctatcctggcatttttttatgttccaattactttttagtatgaatctcctgttataaggagagatgctttatgaaaggagtattatcgttgattatcaatcgtggatgctttagcattgtggta

SEQ ID NO: 978 - DNA, 757 bp, Brassica napus
ggagattctgtctattaaagccaattctgatcttgtcgtcaccttcgctagctgaaggcggaaacacacaagagaaacccaagattcgaaaccatgtcgaggagaaagacaagagagccaaaggaggagacagtgacacttgggccagctgttcgtgacggagagcaagtctttggtgttgtccacatctttgcttctttcaacgatactttcattcatgtgactgatttgtctggacgggaaacacttgttcgtatcactggtgggatgaaggtgaaagccgacagagatgagtcctcaccttatgctgctatgcttgctgctcaagatgtcgctcagcgttgcaaggaacttggtatcacagccatgcatgtgaagctccgtgccactggtggtaacaagaccaagacccctggccctggtgctcagtctgcactcagagcccttgcccgttctggcatgaaaattggtcgcattgaggatgtgaccccagtcccaacagacagtacccgcagaaagggtggaagaaggggaaggaggctttgagtactttctggcctcaggtggaagatcctttatgggctgggctcatcccttgtgtgtttcattttgttttgtttggtacattgaaaaagagtttttgattactatatgcggcgctgttgctgtctaaacaaatattcattgaatttggttgatttattctatgaagcaatcaaaattcatttctttaaatttatatattacattcgcgcta

SEQ ID NO: 979 - DNA, 748 bp, Brassica napus
aatcacgggaatctacacatagtgttcggggcacccaaaaaccctagcatttcgtctcttgtctcatccattggtgaacatgtcgaggagaaagaccagagagcccaaggaggaaacggtgactctaggacctgctgttcgcgacggagagcaagtgttcggtgttgttcacatctttgcttctttcaatgacactttcattcatgttactgatctgtcgggaagagaaactctcgtccgtatcaccggtgggatgaaggtgaaagctgaccgtgatgagtcatctccttatgctgctatgcttgccgctcaagatgttgctcaaagatgcaaggagcttggcataacagccatgcacgtgaagctccgtgccactggaggaaacaaaacaaagactccaggccctggtgctcagtctgctctcagagcccttgctcgttctggcatgaagattggtcgtattgaggatgtgactccggttcccacagacagtacacgtagaaagggtggacgaagaggaagaagactctgattgctcaatgagcctcgtcatcgttcagttgttgtgcccttgactcgagtagtttcttgggtacaagttagtcttgtctctctctccgatttatctttcaagttgcttcgaaaactttataagctttttgcgtttttcttcatcattgtaaacttttgcatttgggaatgagaaaaaaatgacgttgtgttatctttatcgctattttgcattttc

SEQ ID NO: 980 - DNA, 791 bp, Brassica napus
ccgggactcggccttatggtcgggggacgcgcatcccacaagccctatagcagcaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgatactttcattcatgtgactgatctgtctgggagagaaactctcgttcgtatcaccggtgggatgaaggttaaggctgatcgtgatgagtcttctccttatgctgctatgcttgcagctcaagatgttgctcaaagatgcaaggagcttggcatcacagccatgcacgtgaagctccgtgccactggagggaacaaaaccaagactcctggccctggtgctcagtcagctctcagagcccttgctcgttcgggcatgaagattggtcgtatagaggatgtgactccaattcccaccgacagtacacgtagaaagggtggacgcagaggaagaagactttgatttctcaatgagcctcatcattgttctgttgtgcccgtgactcctcttgtggtttatttggtacacacttcgaagttagtttttgtctctctcccgtttatctttcaagttgcttcgtaaaaacattataagctgtgtctttcttcaacgatgtaaacttttgcattggagttttgggaattataaaaactgttagtgactaaatgacgtttgtgttattgttaattggcttatttagctattttgcattttct

SEQ ID NO: 981 - DNA, 738 bp, Brassica napus
ggatcacggccacagcttccagagacgagcaacatcccaaagcccctagcatttcgtctctcgtcatccattgttgaacatgtcgaggagaaagaccagagagcccaaggaggaaactgtcactctcggacccgctgttcgtgacggagagcaagtgttcggtgttgttcacatctttgcttctttcaatgacactttcattcatgtgactgatctttcgggaagagaaactctcgttcgtatcaccggtgggatgaaggtgaaggcagaccgtgatgagtcctctccttatgctgctatgcttgctgctcaagatgttgctcaaagatgcaaggagcttggcattactgcgatgcacgtgaagctccgtgccactggaggaaacaaaaccaagactccaggccctggtgctcagtctgctctcagagcccttgctcgttccggcatgaagattggtcgtatagaggatgtgactccagtacccaccgacagtacacgtagaaagggtggacgtagaggaagaagactttgatttccttatggttgtgcccttgactctgtggtagtttcttgggttcacacttcgaagttagtttgcgtctcgttccattttatctttcatgttacttctaaaacattataagttgtgtctttcttcaacgttgtaacttttgcatttggagttttgggaatgagaaaaagttagcgactctaatcacgttgtgttattattactta

SEQ ID NO: 982 - DNA, 720 bp, Brassica napus
atcaacgcagagtacgcggggatctttcgtttccactaaaccttaaccatctgcagctatgtcgaggagaaagacaagagarccmaaggaggaractgtsactctaggaccagctgtycgygatggtgagcargtytttggagttgttcatatctttgcttccttcaatgacacattcattcatgtgactgatctgtctggaagggaaactctcgttcgtatcactggtggaatgaaagtaaaggctgaccgtgatgagtcctctccttatgctgctatgcttgctgctcaagatgttgctcaaagatgcaaggagcttggcatcacagctatgcatgtgaaactccgcgccactggaggaaacaagactaagaccccaggtcctggtgctcagtctgccctcagagctcttgctcgttctggcatgaagattggtcgcattgaggatgtgactccaattccaaccgatagcacccgtagaaagggtggtagaaggggaagacgtctttgatttgtttctttctcacaatctctcattttttggtgcttcttctaaatgccccacaattcttgttgctattgttttaaaagctttgcatttcatttcttttatacgatacatcactgaagatgtttaattaaagataaactatttttatgaagcaatcaaattagtctgtgaaaatcgtcgcattgaggatgtgactccaattccaaccg

SEQ ID NO: 983 - DNA, 755 bp, Brassica napus
atcaacgcagagtacgcggggactgccacagcttccagagacgagcgtccttaatccctagcatttcgtctctcgtcatccattgttgaacatgtcgaggagaaagaccagagagcccaaggaggaaaccgtcactctcggacccgctgttcgtgacggagagcaagtgttcggtgttgttcacatctttgcatctttcaatgacactttcattcatgtgactgatctttcgggaagagaaaccctcgttcgtatcaccggtgggatgaaggtcaaggctgaccgcgacgagtcctctccttatgctgctatgcttgctgctcaagatgttgctcagagatgcaaggagcttggcattaccgcgatgcacgtgaagctccgtgccactggaggaaacaaaaccaagactccaggccctggtgctcagtctgctctcagagcccttgctcgttctggcatgaagattggtcgtatagaggatgtgactccaattcccaccgacagtacacgtagaaagggtggacgtagaggaagaagactttgatttcctaatggttcaagttgtgcccttgactctggtagtttcttgggttcactcttcgaagttagttgtgtctcgttccattttatctttcatgttgcttctaaaacattataagttgtgtctttcttcaacgttgtaacttttgcatttggagttttgggaatgagaaaaacttatagtgactctaatcgcgttgtattactaatactta

SEQ ID NO: 984 - DNA, 746 bp, Brassica napus
gcaggacgaaagggctcactcacaaaccctaattataaaaatcaatttcatttttatccctgcacgcactctcttcctctaagccaaggcggaaactacagaaggaagaagtgaccttgctgtgatctttaacaatgtcgaggagaaagacgagagagcccaaggaggagacagtgacacttggaccagctgttcgcgatggagagcaagtcttcggtgttgtccacatcttcgcttccttcaacgacactttcattcacgttactgatttgtctggacgtgaaacccttgtccgtatcactggtggaatgaaggtgaaagccgacagggatgagtcatcaccttacgcagctatgcttgctgcgcaagatgttgctcagcgatgcaaggagcttggaatcaccgctatgcacgtgaagctccgtgccactggtggaaacaagaccaagacacctggtcctggtgctcagtccgctcttagagctcttgcccgttccggcatgaaaattggccgcattgaggatgttactccgatcccaacagacagtacccgccgaaagggtggtagaagaggaagaaggctctgagttttctatggctatttatttaatctcatgcgtttcatttcataacaatgtttttttttttgagttttgtgaacgagtttcggattgatcgctttttgttaaattgaacaacatatatctattatcattagtctatggccttggtgaatgacttcattg

SEQ ID NO: 985 - DNA, 659 bp, Brassica napus
tctagccaaactctccgtgacggcgtaagctacaagaacaagaggctctttcatatcctttacttgccctaaaccatgtcgaggagaaagacgagagagcctaaagaggagacagttacacttggaccagctgttcgtgatggagagcaagtcttcggtgttgtccacatcttcgcttctttcaacgacactttcattcacgttactgatttgtctggacgtgaaacccttgtccgtatcaccggtggaatgaaggtgaaagctgacagggacgagtcgtcaccatacgcagctatgcttgctgcgcaagacgttgctcagagatgcaaggagcttggaatcactgctatgcacgtgaagctccgtgccactggtggaaacaagaccaagacacctggtcctggtgctcagtctgctctcagagctcttgcccgttctggcatgaaaattggccgcattgaggatgttactccaatcccaactgacagtacccgccgaaagggtggtagaagaggaaggaggctctgagtttttggcttgtttcttttttgtctgaacaatgttttcttgagttttagcttgtttcattttgtcagaacaatgcttttgaaccacatttttctacaatgattaatctatgacttttggaaattacttaa

SEQ ID NO: 986 - DNA, 781 bp, Brassica napus
actctcttcctctaagccaaggcggaaactacagaaggaagaagtgaccttgctgtgatctttaacaatgtcgagaagaaagacgagagagcccaaggaggagacagtgacacttggaccagctgttcgcgatggagagcaagtcttcggtgttgtccacatcttcgcttccttcaacgacactttcattcacgttactgatttgtctggacgtgaaacccttgtccgtatcactggtggaatgaaggtgaaagctgatagggatgagtcctcaccttacgctgctatgcttgctgcgcaagatgttgctcagcgatgcaaggagcttggaatcaccgcaatgcacgtgaagctccgtgccactggtggaaacaagaccaagacacctggtcccggtgctcagtccgctctcagagctcttgcccgttccggcatgaaaattggccgcattgaggatgtgactccgatcccaacggacagtacccgccgaaagggtggtcgaagaggaaggaggctctgagttttctatggctatttaagcactcatgcgtttagaacaatgtttctttgagttttgtgaacgagtttcggattgaatgcttttttgttaaattgaacaacatatatctactgccattagtctatgtcctttgtgaatgacttcattggtgttatcattatcgtcaaaagtcgcttatacaagtttgcagcatttttattttgagatctgtggagttgttatttcagtttgatgaattaaatcgttgctcttctatcaatc

SEQ ID NO: 987 - DNA, 759 bp, Brassica napus
gggcacccaaaaaccctagcagcatttcgtcttttgtctcatccattggtgaacatgtcgaggagaaagaccagagagcccaaggaggaaaccgtcacactcggacctgctgttcgtgacggagagcaagtgttcggtgttgttcacatctttgcttctttcaatgacactttcattcacgttactgatctgtcgggaagagaaactctcgtccgtatcaccggtgggatgaaggtgaaggctgaccgtgatgagtcgtctccttatgctgctatgcttgctgctcaagatgttgctcaaagatgcaaggagcttggcatcacagccatgcacgtgaagctccgtgccactggaggaaacaaaacaaagactccaggacctggtgctcagtcagctctcagagcccttgctcgttctggcatgaagattggtcgtattgaggatgtgactccggttcccaccgacagtacacgtagaaagggtggacgaagaggaagaaggctctgattgctcaatgagcctcatcatcgttcagttgttgtgcccttagtttcttgggtacaagttagtcttgcctctctctctctccggtttttctttcaagttgcttcgagaacttttataagcttttgcgaacttcttcagcattgtaaacttttgcatttgggaatgagaaaaaaagtgacgttgtgttattgttattttggattttatcttctctcgcttcagcagcttcatctaatgcaagtttgataattt

SEQ ID NO: 988 - DNA, 754 bp, Brassica napus
gggcagtggtatcaacgcagagggcccattacggccggggctcttgccaaatctctgcatcggcggcgcaactacaggaagaaagacgatctttcacatccgtttcttgccctaaaacatgtcgaggagaaagacgagagagccaaaggaagagacagtgactcttggaccagctgttcgtgatggagagcaagtcttcggtgttgtccacatcttcgcttccttcaacgacactttcattcacgttactgatttgtctggacgtgaaactcttgtccgtatcactggtggaatgaaggtgaaagctgacagggatgagtcctcaccttacgcagctatgcttgctgcacaagatgttgctcagcgttgcaaggagcttggaatcaccgctatgcacgtgaagctccgtgccactggtggaaacaagaccaagacacctggtcctggtgctcaatccgctcttagagctcttgcccgttctggcatgaaaattggccgcattgaggatgttactccgatcccaacggacagtacccgccgaaagggtggtagaagaggaaggaggctctgagtttttggctttttctttgctctttatttcattttgtctgaacaatgttttcttgagttttctgaaagagtttcgaagttgaatgctttttgttaattgtggaacaacatttttctgctatgattagttgcattcgcgaatgacttcaattgttatttttaaatgccataattttcatctctg

SEQ ID NO: 989 - DNA, 796 bp, Brassica napus
ggtctctctctctctcttgtttccgctgccagcttcccgcaagccctatagcaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgacactttcattcatgtgactgatctgtctggaagagaaactctcgtccgtatcaccggtgggatgaaggtgaaggctgatcgtgatgagtcctctccttatgctgctatgcttgcagctcaagatgttgctcaacgttgcaaggagcttgggatcacagccatgcacgtgaagctccgtgccactggaggaaacaaaaccaagactccaggccctggtgctcagtctgctctcagagcccttgctcgttcaggcatgaagattggtcgtatagaggatgtgactccaattcccaccgacagtacacgtagaaagggtggacgcagaggaagaagactttgatttctcaatgagtctcatcattgttctgttgtgcccttgactctcgtgggtacacacttcgaagttggtttttgtctctctcagtttgcttcgtaaaaacattataagctgcgtctttcttcaacgttgtaaacttctgcatttggagttttgggaatgagaaaaagtgttagtgactaaatgacgtttgtgttattgttaattggcttatatagctattttgcattttctatacgaataacccataggctacttcctgaa

SEQ ID NO: 990 - DNA, 734 bp, Brassica napus
aaactctccgtcggcggaaactacaggaacaagaggctcttccatatcctttacttgccctaaaccatgtcgaggagaaagacgagagagccaaaggaggagacagttacacttggaccagctgttcgtgatggagagcaagtcttcggtgttgtccacatctttgcttcattcaacgacactttcattcacgttactgatttgtctgggcgtgaaacccttgtccgtatcaccggtggaatgaaggtgaaagctgacagggacgagtcgtcaccatacgcagctatgcttgctgcgcaagacgttgctcagagatgcaaggagcttggaatcactgctatgcacgtgaagctccgtgcgactggtggaaacaagaccaagacacctggtcctggtgctcagtctgctctcagagctcttgcccgttccggcatgaaaattggccgtattgaggatgttactccgatcccaacagacagtacccgccgaaagggtggtagaagaggaaggaggctctgagtttctggcttgtttcttttttgtctgaacaatgttttcttgagctttagctttgtttcattttgtcagaacaatttcttttgaataacatttttctacaatggtgaatctctgtccttgcgaatactataccgagacgctcgggttgtgggatggctcccatcggttgttccttgttaacacagtcagcttgattaaataaaaacaccactcac

SEQ ID NO: 991 - DNA, 671 bp, Brassica napus
cactctcatcctctaagccaaggcggaaactacagaaggaagaagtgatcttgctgtgatctttaacaatgtcgaggagaaagacaagagagccgaaggaagagacagtgacacttggaccagctgttcgtgatggagagcaagtcttcggtgttgttcacatcttcgcttccttcaacgacactttcattcacgttactgatttgtctggacgtgaaacccttgtccgtatcactggtggaatgaaggtgaaagctgacagggatgagtcatcgccttacgcagctatgcttgctgcgcaagacgttgctcagcgatgcaaggagcttggaatcaccgctatgcacgtgaagctccgtgctacgggtggaaacaagaccaagacacctggtcccggtgctcagtccgctcttagagctcttgcccgttccggcatgaaaattggccgcattgaggatgttactccgatcccaacagacagtacccgccgaaagggtggtagaagaggaagaaggctctgagttttctatggctatttatttaatctcatgcgtttcatttcataacaatgtttttttttttgagttttgtgaacgagtttcggattgatcgctttttgttaaattgaacaacatatatctactatcattagtctatggccttggtgaatg

SEQ ID NO: 992 - DNA, 712 bp, Brassica napus
ccctctggccaaatctctgcatcggcggcgcaactacaggaagaaagacgatctttcacatccatttcttgccctaaaacatgtcgaggagaaagacgagagagccaaaggaagagacagtgactcttggaccagctgttcgtgatggagagcaagtcttcggtgttgtccacatcttcgcttccttcaacgacactttcattcacgttactgatttgtctggacgtgaaactcttgtccggatcactggtggaatgaaggtgaaagctgacagggatgagtcctcaccttacgcagctatgcttgctgctcaagatgttgctcagcgttgcaaggagcttggaatcaccgctatgcacgttaagctccgtgccacgggtggaaacaagaccaagacacctggtcctggtgctcagtccgctcttagagctcttgcccgttctggcatgaaaattggccgcattgaggatgttactccgatcccaacggacagtacccgccgaaagggtggtagaagaggaaggaggctctgagtttttggctttttttgctctttatttcattttgtcagaacaatgttttcttgagttttctgaaacagtttcgaagttgaatgctttttgttaattggaacaacaatttttctgctctgattagtcgcattcgcgaatgacttcaattgttatttttaaatggcataattttcatctct

SEQ ID NO: 993 - DNA, 808 bp, Manihot esculenta
gaagcgcagccgatacagagctcctcggtgctctctagggttttcgcacttgggacgcacgtcttctcctaaacatttccttcgctatctccgtctcaatctcatatcctcgtagccatgtctaaaaagaagactagagagccaaaggaagaaaatgttacccttggacctgcagtcagggagggtgagcatgtttttggagtggcccacatctttgcatccttcaatgacacattcattcatgtgactgatctctctggaagagaaacccttgttcgaataacaggaggcatgaaggtgaaagctgacagagatgagtcttcaccatatgctgctatgcttgcagcacaggatgtctcacagagatgcaaggaacttggtattactgctcttcatattaagctccgtgctactggtgggaacaaaacaaaaactccaggtccaggtgcacaatctgccctgcgggcacttgctcgttctggaatgaaaattggtcgcatagaggatgtgactccaattcccactgatagcacacgcagaaagggtggcagaagagggagaagactctgagcttgtggctcgttttccagctgttatgggtcgtgttttattttaggttattattcccaatttgacactatgtggtccagccgaagtcagaattcagttttggatctaaattctagcttttatcatacgtttcctgatggttttaatttatgttgaagtcgtgtagaagaaagatgttattattggatatgagggatttttggtttatcgcaatgcattgcgtggttgactttgctgc

SEQ ID NO: 994 - DNA, 821 bp, Manihot esculenta
gtatttagcaattgaagcttcctctgccattcgctacccaccggtgatccacttccaggctcagcagcgactatcgtcgtcttatctactccttttgacatgtcgaagaagaagacaagagaaccaaaggaagagaatgtcacccttgggcctgctgtaagagaaggggagcatgtttttggggttgctcatatctttgcttcttttaatgatacattcattcatgtcactgatttgtctgggagagaaaccctggttcgcattacaggtgggatgaaagttaaagctgacagggatgaatcttcaccctatgctgctatgcttgcagcacaggatgtttctcagagatgcaaggaacttggcattactgctcttcatatcaagctccgtgctacaggaggtaacaaaaccaagacacctgggccaggtgcccaatctgccttaagggcacttgctcgttctggaatgaaaattggtcgcattgaggatgtgacaccaattccaactgacagcacccgtagaaagggtggtagragaggaagaaggctgtgaagtgtgttacacatggaattgaattcctgtttggtggtggtgcttttattaattggtcttgtttagtagtactcgttaggtcagctggggcacaaggtctttcaagtggtgaaattttttttttttgtgtagtgtttgtgttggtggtttcgttgttctcgaattgatatttaaaccttgtagaaacatggggatatgaattttgttggtgaggtaatgttttgaagtcacatcattataaatttaattatcaattatgawttttcttg

SEQ ID NO: 995 - DNA, 769 bp, Manihot esculenta
gcagccgatacagagcttctagctgctctttagggttttcgcactctgccccctgaacctttccctctgaacctttccctctgattatctccgtagcaatctcgtatccttgcaaccatgtcgaagaagaagactagagagccaaaggaagaaaatgtgacacttggacctgcagtgagggagggtgagcatgtatttggagtggcccacatctttgcgtcattcaatgacacattcattcatgtgactgatctctctggaagagaaacccttgttcgaataacaggaggcatgaaggtgaaagccgacagagatgaatcttcaccatatgctgccatgcttgcagcacaggatgtttcgcagagatgcaaggaacttggtattactgctctacatattaagctccgtgctactggtgggaacaaaacaaaaacaccaggtccaggtgcacagtctgcccttcgtgctcttgctcgttctggaatgaaaattggtcgcatagaggacgtgactccaattcctactgatagcactcgcagaaagggtggtagaagagggagaaggctgtaagcttgtgtttttcaagccattatggcttgcgttttcattttgtgactattcccaattggatactgttttgatctcagctgaagttacattccagtttttggaccaactttttagctcttacaaatatgctatgccaatcatttatgttgaactcttgtagaagaaagatgttattgaatatcaggaatttttggttcat

SEQ ID NO: 996 - DNA, 451 bp, Ricinus communis
gtctaaaaagaagactagagagccaaaggaggaaaatgtaacacttggacctgcagttagggagggtgaacatgtttttggagttgctcacatctttgcatcattcaacgacacattcattcatgtgactgatctctctggtagagaaacccttgttcgtattactggtggaatgaaggtgaaagctgacagagatgagtcttcaccttatgctgctatgcttgcagcacaggatgtcacgcagagatgcaaggaacttggtattactgctctgcatattaagctccgtgctactggtgggaacaaaacaaaaacccctggtccaggtgcacagtctgccctgcgtgcccttgctcgttctggaatgagaattggtcgcattgaggacgtgacaccaattccaactgatagcacccgcagaaagggtggtagaagaggtagaaggctgtga

SEQ ID NO: 997 - DNA, 756 bp, Ricinus communis
tgacagccactggtaatacaatccggtagcatctctcagcgtatactctgatcaaataatataaaaccctcgaagccatgtcgaagaagaagacaagagagccaaaggaagaaaatgtcacccttggtcctgctataagagaaggagaacatgtttttggagtggcccatatttatgcttcttttaacgacactttcattcatgtcactgatttgtccggtagagaaactatggttcgcattactggtggaatgaaagttaaagctgacagggatgaatcttcaccatatgctgccatgcttgcggcacaggatgttactcagagatgcaaggaacttggaattactgctcttcatattaagctccgtgctacaggagggaacaaaaccaaaacacctggtcctggtgcccagtcagccctaagggcacttgctcgttctggaatgaaaattggtcgcattgaggacgtgacaccaattcctactgacagcactcgcagaaagggtggtagaaggggaagaaggctgtaaaatgttttcaaactattccagtttgtgggtattggtgcttcgatagtcgcattcactaccattttaggtctgcctggatctggatttttgaagtttgcgccatttttgtagtttttttctctggtttaatctacctggaattgatatttaagcttttgtagaaacataatgatacgttagtatgaattttctttcaggtgatgttcagaatcacaatattatgatc

SEQ ID NO: 998 - DNA, 715 bp, Catharanthus roseus
ccaaagaattcggcacgaggcaactcatcagctcaacgacatgtcgaggaggaagacaagagagccaaaggaaraaaatgtgacattggggccttctgtgagggatggggagattgtctttggtgtagcccatatttttgcctcatttaatgacactttcattcatgtaactgatttgtcaggaaragaaamcatggtccgcattacgggaggtatgaaagtaaaagctgatagggatgaatcatctccttatgctgctatgcttgcagcacaggatattgctcaaagatgcaaggaactcggcataaatgctcttcatattaaacttcgtgcaactggtggaaacaagacaaagactcctggccctggtgctcagtctgctctccgtgcccttgctcgttcaggaatgaaaattggccgcatagaggatgtcaccccaatcccaactgatagtactcgtaraaagggtggaargagaggaaraargttgtaagtttatatacttytccagtcaatgcccatttgttttgggtgtaattgtcattttcggctatggtactatattagctcaagcgatagaaactttttgcttatgttggcttggtcgaggactattatttttagttgcggtttccaatattgaagctcttgagctatatacatggaagtttttgatattgtagtggtaactggttttgagtctatggataaaaaa

SEQ ID NO: 999 - DNA, 761 bp, Catharanthus roseus
gatccaaagaattcggcacgagggttttgtgaagacacaagcagcagctacgcctcttctgtcaccgttcctccgccgtccgccaccgcaactatgtcgaggagaaagaccagagagcctaaggaagaaaacgttacccttggaccttcaacaagggaaggagagttggttttcggtgtcgcccacatttttgcttcattcaatgacaccttcattcatgttaccgatttgtctggaagagaaaccatggtccgaattactggtggcatgaaagttaaggctgacagagatgaatcatctccttatgctgcaatgcttgctgcacaggatgtctcccagagatgcaaggaacttggaattaatgcccttcatattaaactccgtgctactggagggaacaagaccaagactcctggtcctggtgcccaatcagctctcagagctcttgcacgttctggcatgaaaattggtcgcatagaggatgtgactccaatcccaaccgacagtacccgcagaaagggtggcagaaggggaaggaggctgtgatttcttggctccagacttacatgctgttttggcttgagatattctgtttcgatgcatgcaacattggtcttggtttaaatgttcaaacagttttgtagttttctatgttatctttgtccgacttgtgattttctggattttcttataatatggcgagatagtgaattttctgctttcaagtccatgcatatatatattcattctgcattttgctg

SEQ ID NO: 1000 - DNA, 786 bp, Cenchrus ciliaris
cccgggctgcaggcgccaccgccaccgccaccttgtcgccgtccatcctcgctaaccctaaaccgttctcctygccgccgcagccatgtccgggaggaagaagacccgggagcccaaggaggagaacgtgacgctcggcccggccgtccgcgagggggagtatgtttttggcgttgcgcacattttcgcctctttcaacgataccttcatccatgtgacggatctgtccgggagggagacgctcgtccgcatcactggtggaatgaaggttaaagctgatcgtgatgagtygtcaccttacgstgctatgcttgcttcacaggatgttgctcaaagatgcaaggagcttgggattactgctytgcacattaagctccgtgctactggtggaaacaagaccaaaactcctggtcctggtgctcagtttgcttttagagctcttgctcgatytggcatgaagattggtygtattgaggatgtcaccccagtcccaacggacagcacacgcagaaagggtggcmggaggggaaggaggctgtaatttcaagtctatygggtgtgctgtcggttgtagcagttttatactgttttcatctcgtatactgtgcaagtttttgcaacatgtattgaagttttgaggtgtcaacttgtggacatgtttttatttaatccttgtcgacgaagtttgttcccttygacgtagcaaaacaaaaacgcaggagctcgcttttgataatttgccagcttgttggcttgagaaatagttatccttagattytggaaaaa

SEQ ID NO: 1001 - DNA, 747 bp, Cenchrus ciliaris
gccccagcggcgtgctcgtgatctccacatccaggcgcgctcggctccggtcacccgccgctcaacgcaaccatgtcgaggagaaagaccagggagcccaaggaggagaatgtcacccttggccccactgtccgtgaaggagagtttgtctttggtgtcgctcacatctttgcatccttcaatgacactttcattcatgtcactgatttgtctgggagggaaactctggttcggatcactggtggcatgaaggtcaaggctgatcgtgatgaatcatcaccttatgctgctatgcttgcagctcaagatgttgcacagcgttgcaaggagcttggaatcactgcactgcacattaagcttcgtgcaactggaggcaacaagaccaagactcctggacctggtgctcagtctgctcttagggctctcgctcgttctggcatgaaaatcgggcgcattgaggatgttaccccggttcccactgacagcactcgcagaaagggtggtaggaggggaaggaggctgtaggcttcttctcctggctatttgccatctcttggcgcaaatcatcaagaaacttgtcctctgggtagaattgctgtttgtatgcttgtcaagaggagctttagttttgctctatgttgaggatcatttgccgttagtggagtctatgatgttgcatggataatattttggttgaggaattgacttgtcatatttatcctaagacgtgcgttttcaaaaaaaaaa

SEQ ID NO: 1002 - DNA, 688 bp, Centaurea maculosa
ggcgggggcgcatccgtatcccatcccaactctgagaactccggaggaaaacgaagaagaagccacaccatgtcgaagaggaaggttagagagccaaaggaagaaaatgttactcttggacctgctacccgtgaaggagagctagtatttggtgtggcacatatctttgcgtcattcaatgatactttcattcatgtcaccgatatatctggaagagaaacaatggttcggattactggtgggatgaaggtgaaggctgatagggatgaatcatctccctatgctgctatgcttgctgcacaagatgtttctcagcgatgcaaggaacttggcatcaatgctcttcacataaagttgcgggcaaccggagggaataagaccaagacacctggtccaggtgctcagtccgccctcagagctcttgctcgttctggcatgaaaattggtcgcatagaggatgtgacaccaattccaacagatagcactcgtcgaaagggtggtagaaggggaaggaggctgtgattcatttgcattttcgattattattactcttttatgatgatgacctctgtaggatatttgcgtttttggtaccaatgcctgtgacaattttcgttgcaaattcttcaactttgtgttttggtcgtcgtcattaatgaatgagagaacactggtgtttcaccggatc

SEQ ID NO: 1003 - DNA, 791 bp, Centaurea maculosa
gcggggatcacaacaccagttgccgctgctgcagagatcaaacctttcaacacaccaattcactttcgtcacagtagcagccatgtcgaagagaaaggttcgagagcccaaggaagaaaatgtcactcttggaccagctacccgtgaaggagagcttgtatttggtgtggcacatatctttgcttccttcaacgatactttcattcatgtgactgatatctctggaagagaaaccatggttcggattactggtgggatgaaggtgaaggctgatagagatgaatcatctccctatgcagctatgcttgctgcccaagatgtttcccagcgatgcaaggaacttggcatcaacgcccttcacattaagttgcgggcaactggagggaacaagaccaagacacctggtccaggtgcccaatctgccctcagagctcttgctcgttctggcatgaagattggtcgcattgaggatgtgacaccaattccaacagatagcactcgccgaaagggtggtagaaggggaaggaggctgtgagtggtctgcttcattcatttgcagggtttggtttactactgttctatgtttttaatgacttttgtaggttatatttgtgtttttgttgacatttgatgtcttggatcttgtcatatgtttattgtcctttctggatggatgtttgaatgacatgcatttttggtgcctttgcaatcgttttttgtgtttttgataatgaaatcttgatacaaagccatttgacaagagatggtatgcagaattatattctgttgcc

SEQ ID NO: 1004 - DNA, 780 bp, Centaurea maculosa
ccttaatacgcccaaccctagcttctgcagaagccccaattctgcgaccttctttcttagcgcgcaacaccatcgccataccaacgaagaaactccgccgcagctgccgccatgtcgaagtcaaggaaggttagggagccaaaggaagacaatgtcactcttggacctgctacccgggaaggagagcttgtatttggtgtggcacacatctttgcgtcattcaatgacacatttatccatgtgactgatatctctggaagagaaaccatggtccggattacaggtgggatgaaggtgaaggctgacagggacgaatcctctccttatgcagctatgcttgctgcacaagatgtttctcagcgatgcaaggagcttggcattaatgctcttcacataaagttgcgggcaacgggaggtaacaagaccaagacacctggcccaggtgcccagtctgctctaagagctcttgctcgttctggcatgaaaattggtcgcatagaggatgtgaccccgattccaactgatagcacccgtagaaagggtggtagaagaggaaggaggctgtaatttcagcaaaatggattattatgctgttgttcaagttttgttttttggtcgacagttttgaggattttatggtattgttttacggttagcgtttttcattgatggagtattattattatatgaagtgaatttgcttctgttttgtcattgcacaaagactgaatgtatccctttatttacccccaacaaaatggaagtattaccatagaatat

SEQ ID NO: 1005 - DNA, 677 bp, Centaurea maculosa
tatagcatacgaactctgagaacgacgaaggaaaaccaatagaagcagccacaccatgtcgaagaggaaggtcagagagccaaaggaagagaatgttactctaggccctgctacacgtgaaggagagctagtatttggtgtggcacatatctttgcgtcattcaatgatactttcattcatgtcaccgatatatctggaagagaaacaatggttcggattactggtgggatgaaggtgaaggctgacagggatgaatcctctccctatgctgctatgcttgccgcacaagatgtttctcaacgatgcaaggaacttggcatcaatgctcttcacataaagttgcgagcaaccggaggaaataagaccaagacacctggtccaggtgcccagtccgccctcagagctcttgctcgttctggcatgaaaattggtcgcatagaggatgtgacaccaattccaacagatagcactcgtcgaaagggtggtagaaggggaaggaggctgtgattcatttgcattttcgattattattattactcttttatgatgatgacctctgtaggatgcttgcgtttttggtactaatgcctgtgactattttctttgcaaattcttcaactttgtgttttggtcgtcgtcattaatgaatgagagaacactggtgtttcaccggacc

SEQ ID NO: 1006 - DNA, 677 bp, Centaurea maculosa
ccgcctcgcatcgaactctgagaacgacgaaggaaaacgaagaagaagaagccacaccatgtcgaagaggaaggttagagagccaaaggaagaaaatgttactcttggacctgctacacgggaaggagagctagtatttggtgtggcacatatctttgcatcattcaatgacactttcattcatgtcaccgatatatctggaagagaaacaatggttcggattactggtgggatgaaggtgaaggctgacagggatgaatcctctccctatgctgctatgcttgccgcacaagatgtttctcaacgatgcaaggaacttggcatcaatgctctccacataaagttgcgggcaaccggagggaataagaccaagacacctggtccaggtgctcagtccgccctcagagctcttgctcgttctggcatgaaaattggtcgcatagaggatgtgacaccaattccaacagatagcactcgtcgaaagggtggtagaaggggaaggaggctgtgattcatttgcattttcgattattattactctgttatgatgatgacccctgtaggatgcttgcatttttggtactaatgtctgtgacaattttctttgcaaattcttcaactttgtgttttggtcgtcatcattaatgaatgagagaacactggtgtttcaccggatc

SEQ ID NO: 1007 - DNA, 602 bp, Prunus cerasus
  misc_feature (594)..(594): n is a, c, g, or t
gaaagcgctgagcttgagcgccacagttgtgaataacctctaagtaatcgcctgcttgtagccatgtcgagaaggaagaccagggagcccaaggaggaaaatgtcactctcggacctgctctccgagatggagagcatgcttttggtgttgctcatatttttgcctcatttaatgataccttcattcatgtaactgacctgtctggaagggagacacttgttcgcatcactggtggtatgaaggtgaaagctgatagagatgaatcatcaccatatgcagccatgcttgcagcccaggatgtttctcaacggtgcaaggagcttggcattactgctttacatataaagctccgggctactggagggaacaagactaagactcctggtcctggtgcccaatcagcactcagagccctggctcgttctggcatgagaattggtcgtataggatgtgactccaattcccactgacagtactcgtagaaagggtggcagaaggggaagaaggttgtgattgcttacaattgtgtggtttaactggcgatgtggtttctgggatgtttttgttttggataaaaaaaatttattatcagncttgctat

SEQ ID NO: 1008 - DNA, 723 bp, Castanea mollissima
ttttgaaggccgagtctagctctcatttgctctctgcactcgaactcgcttttgcactcgcagcagccatgtctagaaggaaaactagggagcccaaggaggagaatgttaccctaggacctgctacacgcgaaggagagcaggtttttggtgtggcccatatttttgcatcgttcaatgacacattcattcatgtaactgatttgtctggaagggaaacacttgttcgcattactgggggcatgaaggtgaaagctgatagggatgaatcatcaccatatgcagccatgcttgcagctcaagatgtttctcaaagatgcaaggagcttggcatcactgctctgcacataaagctgcgtgctactggagggaacaagactaagactcctggtccaggtgcccagtcagcactcagagcccttgcacgttcaggcatgaaaattggtcgcatagaggatgtgaccccaattcccagtgacagtactcgcagaaagggtggcagaaggggtagaaggctgtgattccttgtcatatcagatcaagttgattaagcctctatgtttgcttggactatgttagtctaaatgcaaccatattcttgacttccttagacaacactttgtagttttgaattttgatttgtttgcatcttatcatttagttgaagcaaaagagatttttttctcaagttccatttaatattttaccatatgattttgtaag

SEQ ID NO: 1009 - DNA, 814 bp, Castanea mollissima
tcgtctcgaagccaaagccgcactcctcagcccatcaaccgctctctgcacactcttttcatctgcacgaagcagccatgtcgaggcgaaagcaaagggaaccaaaagaagaaaatgtgacacttgggcctgcaacacgtgaaggagaacaagtttttggagtggctcacatttttgcatcttttaatgatacattcattcatgtaactgatctgtctggcagagagacacttgttcgcatcactggtggtatgaaggtaaaggccgatagggatgagtcttcaccttatgcggctatgcttgcagcacaggatgtatcgcagagatgcaaggaacttggcatcactgctcttcatatcaagctccgtgctactggaggaaataaaaccaagacacctggtcctggtgctcagtctgcactccgggcccttgctcgttctggaatgaagattggtcgcatagaggatgtgactcccatccctagtgacagcactcgaaggaagggtggtagaagaggtagaagactgtaggctggcttgtgtcgaccatctcattattcaactctggtgctggttatgaagttgcctggctacatcttggaagggtattagttggcatatttttgtagtttttgaaaatggttgacttttgctttatatcaagcttattactgtagaatcagaagggtgtgagattatctatggagtttgtgttcacataaatgaagtttttgactcggtgtttccaattagtttaagtttctctactgcttagtccatgctccattgttgtgcattcatcatgaaatacaatg

SEQ ID NO: 1010 - DNA, 736 bp, Castanea mollissima
tagggttttcgcagctgaaagaacaaacagagcctcctcaaaaaccctagagctctcaatcccatcacttcgaagccatgtcgaagaggaagactagggaaccaaaagaagaaaatgttactcttggacccgctgtcagagaaggagaacaagtttttggtgtcgcccacatttttgcatcatttaatgacaccttcatacatgtgaccgatctgtcaggaagagaaacactagttcgcattactggtgggatgaaggtgaaagctgacagagatgagtcttcaccatatgctgccatgcttgcagcacaggatgtttctcagagatgcaaggaacttggcatcactgccttgcatatcaagctccgtgctactggtgggaacaagaccaaaacacctggtcctggggcacagtctgctctccgtgcacttgctcgttctggaatgaaaattggacgcatagaggatgtcactcctattcctagcgatagcactcgtagaaagggtggtagaagaggaagaaggctgtgagcttgcttttcttattcagtcaggtgttcttgttttgcaatggttgtgatttccaaatgagttttgggacattggaaattagatacaattactacccaattttgaaactaatttgtacttttctatgtgacttgcgaaagatttattttgagttgtttgaaaacaaattttataagacttggctaaaattatgacttctagctttt

SEQ ID NO: 1011 - DNA, 804 bp, Chlamydomonas reinhardtii
caaaacagcagcagccatggcccccaagaaggccgccaagggtgatgaggcccccaaggaggtggtgagcctgggccccaccgtccgcgagggcgagcacgtcttcggcgttgctcacatcttcgccagcttcaacgacacgttcgtgcatgtgaccgacctgtcgggccgggaaactatttcgcgcgtcaccggcggcatgaaggtcaaggccgaccgcgacgagtcgtcgccctacgcggccatgcttgccgcgcaggacgtggcccagaagtgcaaggagctgggcatcactgccctgcacatcaagctgcgcgccaccggcggcaaccggaccaagacccccggccccggtgcccagtccgccctgcgtgccctggcccgcgcgggcatgaagattggccgcatcgaggacgtgacccccatccccaccgactccacccgccggaagggtggtcgccgcggtcgccgcctgtaggcgcgcggcgtcgcgatatgccggtgtgccgcaacagcgcggcggccgtcatggccgcagcagcagccggtggtggttttggtggcggagcgagcccagccggaattgcagcagcagcggtggcagcagcagcagcctagcaagcggcagtggcggaggaggagggcgcagcgattttaggtggcggcggcgggcgcgcccgcctggcggctggcggcgggtgcatcgccgcggcggaggaggcctcgctgggtctgtccagccactgcgctggttgcgtcgttgtctcgctagtagcgttgctgtaacgtgaagagtacgtgatt

SEQ ID NO: 1012 - DNA, 492 bp, Cichorium intybus
ctgcgcaatcggaaactaaagccatgtcgaagagaaaggtkmgagagccaaaagaagaaaatgtcaccctyggrcctgcaacccgtgagggagagcttgtatttggtgtggcacacatctttgcatccttcaatgacaccttcattcatgtaaccgatatctctggaagagaaaccatggtccggattacaggtgggatgaaggtgaaggctgacagggaygagtcttctccatatgcagctatgcttgctgcacaagatgtgtcccagcgatgcaaggaacttggtatcaatgcacttcacataaagttgagggcaactggaggtaacaaaaccaagacacctggaccaggtgcccagtcagccctcagagctcttgctcgttctggcatgaaaattggtcgtatagaggacgtgacacccattccaacggatagtacaygtagaaagggtggwagaagaggaaggmggytgtgattggtgtsttttcmaa

SEQ ID NO: 1013 - DNA, 708 bp, Cichorium intybus
gggggcgcacctctaatagtgtacgaattckctcaacttcaaaggaaaaactaaaccagagaagccgcaccatgtcgaagagaaaggttcgagagcccaaggaagaaaacgtcactcttggacctgctacccgtgagggagagcttgtatttggtgtggcacacatctttgcatcattcaatgacactttcattcatgtgactgatatctctggaagagaaaccatggttcggatcactggtggtatgaaggtgaaagctgacagagatgaatcatctccctacgcagctatgcttgctgcacaagatgtttcccagcgttgcaaggagcttggaattaatgcccttcacataaagttgcgggcaactggaggcaacaagaccaagacaccgggtcccggtgcccagtctgcccttcgtgcacttgcgcgttcaggcatgaaaattggacgcattgaggatgtgactccaattccaacagatagcactcgccgaaagggtggtagaaggggaaggaggctgtgattggttgggtcatttctggaattttacttatttccaattttggattattgttatttctatgttttggcaacttatttaggatctttttttattgtggttgacatctaaaaaatgttttgggatatgttttgttgtcctttatggattgttgtttgagtgacatgtgcctgttcgaatcgaaaaa

SEQ ID NO: 1014 - DNA, 897 bp, Cichorium intybus
gcgggggacgcaattaacagatacataataacacataaatatgttagtgttcgagagagggtgtgtgtggttaacgacgtgaatgttaacgtgaacgctgccctatcctcgtccgggccaaaggcctttcaattaggcccaaagtagtccatgctcctcgatttaaaaggcgcactgccataaaccctagggggcgcacctgtatcagtgcacgaattctctcaactccgaaggaaaaactaaaccagagaagccgcaccatgtcgaagagaaaggttcgagagcccaaggaagaaaatgtcactcttggacctgctacccgtgagggagagcttgtatttggtgtggcacacatttttgcatcattcaatgacactttcattcatgtgactgatatctctggaagagaaaccatggttcggatcactggtgggatgaaggtgaaagctgacagagatgaatcatctccctacgcagctatgcttgctgcacaagatgtttcccagcgatgcaaggagcttggaattaatgcccttcacattaagttgcgggcaactggcggcaacaagaccaagacacctggtcccggtgcccagtctgcccttcgtgcacttgcacgttcaggcatgaaaattggacgcattgaggatgtgactccgattccaacagatagcactcgccgaaagggtggtagaaggggaaggaggctgtgattggttgggtcttttctggagatttacttatttccaattttggattattgtcatttgctaacactattttgtttccaaatattgctaaatcctcaccatggtttgcgaaatccttagggtggtttgttaaatgctcatagaacgactataaaaaaaattcgaaatctcatttctttggaaaaaa

SEQ ID NO: 1015 - DNA, 708 bp, Cichorium intybus
gggggcgcacctctaatagtgcacgaattctctcaactccgaaggaaaaactaaaccagagaagccgcaccatgtcgaagagaaaggttcgagagcccaaggaagaaaacgtcactcttggacctgctacccgtgagggagagcttgtatttggtgtggcacacatctttgcttcattcaatgacactttcattcatgtgactgatatctctggaagagaaaccatggttcggatcactggtgggatgaaggtgaaagccgacagagatgaatcatctccctatgcagctatgcttgctgcacaagatgtttcccagcgctgcaaggagcttggaattaatgcccttcacattaagttgcgggcaactggcggcaacaagaccaagacacccggtcctggtgcccagtctgcccttcgtgcacttgcgcgttcaggcatgaaaattggacgcattgaggatgtgactccgattccaacagatagcactcgccgaaagggtggtagaaggggaagaaggctgtgattggttgggtcttttctggactttacttatttccaattttggattattgttatttctatgttttgatgaattatttaggatctttttatattctggttgacatctaaaaaatgttttgggatatgttttgttgtcctttatggattgttgtttgagtgacatgtgcctgttcgaatcgaaaaaa

SEQ ID NO: 1016 - DNA, 954 bp, Citrus sinensis
ccacgcgtccgcggacgcgtccgaccagctgctgcttctgtatttcgaggcttttgtgatcaactctccgtgtcatcagcagccatgtcaagaagaaagaccagagagcctaaggaggaaaatgttactcttggacctgccgttagagatggcgagcatgtatttggcgttgcccacatttttgcgtcgtttaatgacactttcattcatgtgactgacttgtctggaagagaaactcttgtgcgcattactggtggtatgaaggttaaagctgacagggatgaatcctccccttatgcagctatgcttgcagcacaagatgtttctcaacgatgcaaggagcttggcattactgctcttcatattaagctccgggctactgggggtaacaaaactaaaactcctggtccaggtgctcagtcagcacttagagctcttgctcgttctggaatgaagattggccgcatagaggatgtgactccaattcccaccgacagtacccgcagaaagggtggtagaaggggtagaaggttgtaattcttttcctcacacccatccataacgttcaagatgatgccgtggttacagagagtttcactctcttctgttagatgcaagagttatttcccaattttgttgtttggaatgtctgtagtcttggattcctttgtgttagcctttccgatcaattaagtttatacagtggcaagactaatcatttctccatgagtttctgaattttattgtttatctacatttacaagtattgtgttaagtggtaaagtatgatggtagtggttatgattagatgttgatcaattcgcccctttttatatccctttttatatttaatctacctttttcattgcctatcttattctctcttgattgtgtattgggcaatgggagataactgtgctattaagacgggtgtttgttcgtatttgatttaaa

SEQ ID NO: 1017 - DNA, 815 bp, Citrus sinensis
atagagagaccgagtgcatcagtctattgtttagggttttcacattttcctttcgtctaggaacaaaccctagccttctcaatccatctcgtgttttcgcaggcatgtcgaggagaaagaatagggagcctaaggaagagaatgtgactctaggacctgctgtgagagatggggagcatgtttttggagttgcccacatctttgcatcgttcaatgatacatttattcatgtgactgatctgtcaggcagagaaacccttgtccgtatcactggtggtatgaaggtgaaagctgaccgagatgagtcctctccatacgctgccatgcttgcagcacaagatgtttcaaccagatgcaaggagcttggaatcactgctcttcatattaagctgcgtgctactggtgggaacaaaaccaaaacacccggtccaggtgcccagtctgctcttcgtgcccttgctcgttctgggatgaaaattggtcgcatagaggatgtgacccctattcccactgatagcacacgcagaaagggtggtagaagaggaagaaggctttaagctgtcttgtttgtccgattgtttgtttgtccgattgtcttgttttatgcgggcattctgaatgggacagttgttccttaaagttagttgaagttacttttcaattttggaactaatttatagttttatctgtcgctattaaaagattttattttcctgctttttgtaaaaacaataggcggccttgagagcatatggcattactggtgtcttgcattgcgtgttatgtcattgaattaattttgaaattttcaagtg

SEQ ID NO: 1018 - DNA, 790 bp, Coffea canephora
tttgaaaccctacccatttgccgtctttctgcttccattttctttcactccctcggaccccgcacccgcacccgcaccaagcttcgtcgtctcgaaatcatgtcgaagaggaggacaagggagccaaaggaagagaacgtgacccttggccctgctgtgagggacggagagcaagtttttggggttgcccacatttttgcttcattcaatgacacctttattcatgttactgatttgtctggaagagagactttggtccgtatcactggtggcatgaaagtgaaggctgatagagatgaatcatccccatatgccgctatgcttgcagcacaagatattgctcaaagatgcaaggaacttggcatcactgcccttcatattaagctccgagccactggtggtaacaagacaaagactccagggcctggtgctcagtctgctcttcgcgcccttgctcgttctggaatgaaaattggtcgtatagaggatgtgactccaattcctactgatagcactcgcagaaagggtggtagaaggggaagaaggctgtaaagctttgtactgtgataagagcaaaacttgtcatttctgcagtaaccgtcaccctcgtttttaatggtgctgcagtaactttgagcatgacagaattttgattgtgaaattggcgagaccaaattatttttagatattgttagttgcttcgatcatggacatcgtctctcctgcacttattctattttttttttttcgtattgcattgctcagaaattaaagtatttcgaatttactt

SEQ ID NO: 1019 - DNA, 828 bp, Coffea canephora
tgcatttgctagggttttgtatccgttcccacktctcagtcggcagctcaattttcagtctctctctctccctcccgctctctcagccgccgtcgttgaaaatgtcgaagagaaggcaaagggagccgaaggaggagaatgtgaccttgggccctgctaccagggacggagagcaagtttttggggttgcccacatttttgcctccttcaatgacacctttattcatgtgactgatctatctggacgagaaacactcgtacgcattactggaggcatgaaagttaaggctgatagagatgaatcatccccatatgcagctatgcttgcagcgcaagatattgctcaaagatgcaaggaacttggcatcactgcccttcatattaagctcagagccactggtggtaacaagacaaagactccaggccctggtgctcagtctgctctccgtgcccttgctcgttcaggaatgaagattggtcgtatagaggatgtaactccaattcctactgatagcactcgccgaaagggtggtagacgtggaagaaggctgtaagctagacttcatcacatcagcagggaccctgatttttcgttggacatggtagtattgtagcttgaggtgacagaatttaggttgtatggaaatgagggatactcattcctgcctttttgtttccgtggtgaaattggcctggctggttctcctttgagtctgttggttgcttagatcatggatacttcacctgttaaaatgtatttggtttttcaacttattcggttggcaaragatatcagctttgagacctttgcgtcgtgctttaaaattt

SEQ ID NO: 1020 - DNA, 782 bp, Gossypium hirsutum
cttttgaaagctagagtcgctggaggctgaagctcagtcaaagtgctgtcttaaaaccctagttttcgagctctctttcagttttcccggaatccatgtcaaggaggaaggttagggagcccaaggaggagaatactaaccttggacctgctgttcgagagggtgagcatgtttttggggtggctcacatttttgcttcattcaatgacacatttattcacgtgactgatttgtctggaagggaaacaatggttcgaatcactggtggtatgaaggtgaaagctgatagggatgagtcttccccttatgcagccatgcttgcagcacaagatgtttctcaacgctgcaaggagttgggtattactgcccttcatataaagctccgagctactggaggaaacaagacgaagacccctggtcctggtgctcagtctgcacttagagcccttgctcgttcaggcatgaaaattggtcgaatagaggatgttactcccattcccactgatagtactcgtagaaagggtggcagacgtggaagaaggctgtgattctttgctttatatcaattactcactcagctactactgctgtggtgcttggagttttctttgttaaacagttttctttacattcaagtgtgttttgctcggttctcttgctgcacatttagtttttggaatggattttagatcttttatctagacaggaaaaagttgtggaactatttaatgcagcttcaaagttaagcttttatattattgaggtttttataaatattttat

SEQ ID NO: 1021 - DNA, 962 bp, Gossypium hirsutum
  misc_feature (3)..(4): n is a, c, g, or t
  misc_feature (27)..(27): n is a, c, g, or t
tcnngcgcctgcaggtcgacattctcnggatccaaagaattcggcacgaggtcgtcggaggccaaagcatcaacgaaagctttcacaaaaccctagtctctaactacttcgttttgcctaagccatgtcgagaaggaaggttagagagcccaaggaggagaatactaacctaggacctgctgttccagagggcgagcatgtttttggggtggctcacatctttgcttcatttaatgacacattcattcatgtgactgatttgtctggaagggaaacaatggttcgcattactggtggcatgaaggtgaaagctgatagggatgagtcttccccttatgcagccatgcttgcagcccaagatgtttctcaacgctgcaaggagttgggtattactgcccttcatataaagcttagagctactggagggaataagaccaagacaccaggtcctggtgcacagtcagcacttagagcccttgctcgttctggcatgaaaattggacgcatagaggatgttacccccattcccactgacagtacccgtagaaagggaggcagacgtggaagaaggctgtgattcttcgcttcgtatctgttgctcactgttgctgctcctccaatatgcttggagtttcttttttaaacaatttttggtttagattgaagattgttttgccctgttatgttgttgcacattagttccagaatggattttgatcgtaatttacatgtggaactcttggaagttaatctttttattgattttgattttcctttggagtcagtaatgaagttatgacagataagaatgaattccctgcatggtttgaatacctgtaggaaatctaatcttttaagataaatattctttccccttgtcctagttttttagtttctgatcttcagcaggttaaaaaaatttataaacaatggtatattgttttgattttaataaatttcat

SEQ ID NO: 1022 - DNA, 755 bp, Gossypium hirsutum
cgagctgaaattggaaaagccctaatttgacagctctctcagtctctcattttgcctgaaaaccatgtcgaggagaaaggttagggagcccaaggaggagaatactacccttgggccggctgtacgagacggcgaacatgttttcggggtggctcacatttttgcttcatttaatgacacatttattcatgtaacagatttgtctggaagggaaacaatggttcgcattacgggtggtatgaaggtgaaagctgatagggatgagtcttccccttatgccgccatgcttgcagcacaagatgtttctcaacgctgcaaggagttgggtattacagcccttcatataaagcttcgagctactggagggaacaaaaccaagacacctggtcctggtgcccagtcagcacttagagccctcgctcgttctggcatgaaaattggacgcatagaggatgtcacccccattcccaccgatagtactcgtagaaagggtggcagacgcggaagaaggctgtgattctttgcttcatatctgctactcagccgctgctgctggcggtttgacattaggaattctctttgcttttgaaacaattttctgattagattcaagtatgctttgctctgttcttatgttgcacacttgtagttcctgaatggattttgatccttgaatcttaaattggacaaaatgttgtggaactcttcaaattttttggctaaagggggtatataagccctcaactttgactaaa

SEQ ID NO: 1023 - DNA, 804 bp, Gossypium hirsutum
atctcgttccccatcgacgcctctgcttatcgcatcatcagccatgtcgaggagaaaggttagggagccaaaggaagagactacaacccttgggcctgctgtacgagacggagagcatgttttcggtgttgcccacatttttgcatcttttaatgacactttcattcatgtgactgatttgtctggaagagagactatggttcgtattacaggtggtatgaaggtgaaagccgacagggatgaatcttcaccttatgctgctatgcttgcagcacaagatgtttcccagagatgcaaggaacttggaatcacggccctccacatcaaattacgtgccacaggaggtaacaaaaccaagacccctggtccgggtgctcagtcagctctcagggctcttgctcgctccgggatgaaaattggccgtatcgaggatgttacacccattccgacagatagcacccgaagaaagggtggtagaagagggagaaggctataaactagcacattatgttctagcaaatctatccttcagtgttttttcggtggtattggaatttggttatttggtaataactgttctttatgagccctttttcatagttttatattggtatattttatattgcagtaatgttttatatgaatctcatgtcataagtagaaatgtttaatgaatggtgatatttttattaaaaatttgtgggttttatcgttgttgttcatatcataggtagtccctaaacaaaaattgtaacttgtgatgttatttttacaagttaatgctcatgtggaatttatttatta

SEQ ID NO: 1024 - DNA, 639 bp, Gossypium hirsutum
ccacgcgtccgcatcccttcaaaatttgtcccaagaagaccaccacccgcgctccccaggagaacatctccctcggaccctccgttcgcgatggcgagctggtcttcggcgttgcccgtatcttcgcctccttcaacgataccttcgtccacgtcaccgatctgagtggccgtgagaccatcacccgtgttactggtggtatgaaggtcaaggccgatcgtgacgagtcctccccctacgctgccatgttggctgcccaggacgtcgctgcccgctgcaaggagcttggcatcaacgctcttcacatcaagatccgtgccactggtggtaacggtaccaagacccccggtcccggtgcccagtccgctctccgtgccctcgcccgtgctggcatgaagatcggccgaattgaggacgttacccctactccctccgactctacccgcagaaagggtggtcgccgtggtcgtcgtctctaagctgctcgcacatgggtggcttggatcggacaggagattcgctatctggtttctctgtggcgttgagaatcacgaggagaacggctttttcgcctggtctccagtctacactgcagagcctggtcaggttatgggttaggacgcagtagacagttatgat

SEQ ID NO: 1025 - DNA, 942 bp, Gossypium hirsutum
agctgaaattggaaaagccctaatttgacagctctctcagtctctcattttgcctgataaccatgtcgaggagaaaggttagggatcccaaggaggagaatactacccttgggccggctgtacgagatggcgagcatgttttcggggtggctcacatttttgcttcatttaatgacacatttattcatgtgacagatttgtctggaagggaaacaatggttcgcattactggtggtatgaaggtgaaagctgatagggatgagtcttccccttatgctgccatgcttgcagcacaagatgtttctcaacgctgcaaggaattgggtattacagcccttcatataaagcttcgagctactggagggaacaaaaccaagacacctggtcctggtgcccagtcagcacttagagcccttgctcgttctggcatgaaaattggacgcatagaggatgttacccccattcccaccgatagtactcgtagaaagggtggcagacgcggaagaaggctgtgattctttgcttcatatctgctactcagccgctgctggtggcggtttgacattaggaattctcttttgcttttgaaacaattttctgattagattcaagtttgctttgctctgatcttatgttgcacacttgtagttcctgaatggattttgatccttgaatcttaaattggacaaaatgtcgtggaactctttcaactttttggtaaaggggtatataagcccttacctttgactaaagccctttccgcgaaaaacacagttaattaagtcctcaatctattgcggcaattaagccctttgattggtacggtgctgatgtggctgttaatggtgctaacatggccctccatgttagtgacagttgctgatgtggcagtgttagattagttgccgtgttagcaaaagaaataaaaaaattcaaaaattt

SEQ ID NO: 1026 - DNA, 741 bp, Gossypium hirsutum
catcgacgcctctgcttatcgcatcgtcgccatgtcaaggagaaaggttagggagccaaaggaagagactacgacccttgggcctgctgtacgagacggagagcatgttttcggtgttgcccacatttttgcatcttttaatgacactttcattcatgtgactgatttgtctggaagagagactatggttcgtattacaggtggtatgaaggtgaaagccgacagggatgaatcttcaccttatgctgcgatgcttgcagcacaagatgtttcccagagatgcaaggaacttggaatcacggccctccacatcaaattacgtgctacaggaggtaacaaaaccaagacccctggtccgggtgctcagtcagctctcagggctcttgctcgctccgggatgaaaattggccgtatcgaggatgttacacccattccgactgatagcacccgaagaaagggtggtagaagagggagaaggctataaactagcacattatgttctagcaaatctatccttaagtgtttttttggtggtattggcatttggttatttggtaataactgttctttatgagagccctttttcatagttttatatcggtatattctatattggagttgtagaacataatgaactatgaatctatcaatcgcatttttcatgtttttggtaatgttttatatgartctcatgttatagtagaaatgttyaatgaaatagtgtggtgatatttttttttt

SEQ ID NO: 1027 - DNA, 789 bp, Vigna unguiculata
tcaccttgcagcagacaaccctaaactaccgagaagggtcatctaatttccacatctctacgctgcgttgcaacaaacatgtcgaggagaaaggttagagagccaaaagaagaaaatgtgactctgggtccagctgttagagacggtgaacacgtgtttggcgtcgctcgcatctttgcttccttcaatgacaccttcattcatgttactgatttgtctgggagggaaacacttgtccgcatcactggtgggatgaaggttaaagctgatagagatgaatcatctccctatgctgctatgcttgcagcacaggatgttgctgccagatgcaaggaactgggcataactgctcttcatatcaggctccgtgccactggtggaaacaaaacaaagactcctggtcctggtgctcaatcagctcttagagcccttgctcgttcaggaatgaaaattggtcgcatagaggatgttactcccattccttccgacagcacgcgtagaaagagtggaaggaggggtagaaggctttaagcttctactatatggctggagttgctctgctttatttccatgtcaagtagaattgtgctgtttcgaaattttggtttagtttcatattaaactgttattgtatttcttaagctttctcgaacataattgaagtttacatgctgacattaatgttaaaggcttttgaaagttctgaatgttactttggtgtcttagaaaactgctaattatctacttgataaaacattcgtattttattatttaattattgtttgttta

SEQ ID NO: 1028 - DNA, 503 bp, Vigna unguiculata
cagttccgcgatgtcaaagagcaaaaaggttaagcaagagaaagttgaagaagtcgtcagtttaggccctcaagttgccccaggaacaaacgtcttcggtgttgcacacatctatgcttccttcaatgacactttcgttcacgtcaccgatctttctggaagagaaaccattgctaaagtgactggtggtatgaaagtcaaagccgacagagacgagtcatcgccttatgctgctatgctcgctgctcaagacgtcgctgaaaagtgcaagtccttgggaatcaacagccttcacattaaactccgagccaccggaggaaacagaaccaaaacccctggacctggtgctcaatccgctcttcgtgcacttgctcgtagtggaatgaaaatcggcagaatagaggatgttactcccattcccaccgattctactagaagaaaaggaggacgtcgtggtagaagattataaacgctgcttgttataataataaattacacatctt

SEQ ID NO: 1029 - DNA, 828 bp, Vigna unguiculata
gcaacaacaaattcaaacggcaggttcatctgatctctcaatctctacactgcgttgcaacaaacatgtcgaggagaaaggttagagagccaaaagaagaaaatgtgactctgggtccagccgttagagacggtgaacatgtctttggtgtcgctcgcatctttgcttccttcaacgacaccttcattcacgttactgatttgtccgggagggaaacacttgtccgcatcactggtgggatgaaggttaaagctgatagagatgaatcatctccctatgctgctatgcttgcagcacaggatgttgctgccagatgcaaggaactgggcataactgctcttcatatcaggctccgcgccactggtggaaacaagacaaagacacctggtcctggcgctcaatcagctctcagagcccttgctcgttcaggaatgaaaattggtcgcatagaggatgtgactcccattccttccgacagcacccgtagaaagagtggaaggaggggtagaaggctttaagcttctactatattactggagtgtttatgtttttatttccatgtcgagtagaattgtgccatttcgaaatttttgcttagtttcatatcaaacttttattttatttgttatggtttctcgaacatagttgaggattacatgcagacactattgttaaaggctttttgaaagttctgaattttgcttcgtgtattagaaagctgctaattatttacttgatatgttttttgttttttggttttttagattggtatccctcccgacttttataagagtttagttttataaatttaaattttaacatgatcca

SEQ ID NO: 1030 - DNA, 647 bp, Vigna unguiculata
gggtttcctgtcgaagcagtttgcaaggaataaaatttgtgtaaacaatggctccacgcaaaaacaaagttcaaaaagaggaagttcaagtatcccttggaccacaagttcgtgaaggcgaaaatgtattcggcgtagcgcatatctttgctagtttcaacgataccttcgtccatgtaacagatttatctggacgtgaaacaattgctcgggtcaccggtggcatgaaagtcaaggctgatcgtgatgaagcttctccctatgctgctatgttggccgcccaagacgttgccgaaagatgtaaagtgttgggaatcacagctttgcacattaaactacgcgccactggtggtaacaaaacaaaaacaccaggacccggtgctcaatcggcattacgtgctttggcccgttcatcgatgaaaattggtcgcattgaagatgttacacccattccatcagacgccacacgccgaaagggaggacgacgtggtcgtcgtctataaattgcaatttgtatacacactggttatgtatgcgaggcgatttttatttttttttttggctttgttttcaaccacgaaagtgacttttgtgtgaaatatttagacactgaaaataaaatggccaactcttggttgaaataattg

SEQ ID NO: 1031 - DNA, 695 bp, Vigna unguiculata
acgctgctccttcttcgttttcgcagtaacaactgtaaaacctacgaagctcttcatcatgtcgaggagaaaggtcagagagccaaaagaggaaaacgtgactcttggaccagccgttagagacggtgaacacgcctttggtgtcgctcgcatctttgcctctttcaatgacaccttcattcatgtcactgatctgtctgggagggaaacccttgtccgcattactggtggaatgaaggttaaagctgacagagatgaatcatctccatatgctgccatgcttgcagcacaggatgttgctacccgatgcaaggaactgggcataactgctcttcatatcaagctccgtgcaactggcggaaacaagaccaaaacacctggtcctggtgcccaatcagctctcagggccctttctcgttcaggaatgaaaattggtcgtatagaggatgtgacacccattccttcggatagcactcgtagaaagagtggcaggagaggtagaaggctctaagtactggagttgctatattttattttccataccaaactgaaatgccatgttgatattttgctatcagaactcctagtgtttttctttagtcatattgaacagtgttttaattgataacaaatatttggaaattctggttgtttcttcgtagcttgcaatggkgactaattatcttcttttgcta

SEQ ID NO: 1032 - DNA, 806 bp, Cryptomeria japonica
tgcagggtttctaggattttagttcaacgctgkaaggaagaagcagcggcggagttacagtaggcactcagagttctcagatcgagaggcttcaaacaacttacaatgtctgggaagaagaagaccagagaagttaaggaggaaaatgttactctaggacctgcagttagggaaggagaacatgtgtttggtgtagcccacatatttgcttctttcaatgatacgtttgtgcatgtgactgatttgtccggaaaggaaactcttgcccgtgttactggtggcatgaaggtcaaagctgacagagatgaatcatcaccatatgctgcaatgcttgcagcacaagatgttgcacaaagatgcaaggagcttggcataactgccttgcatattaagcttcgtgcaacaggagggaataagacaaagactcctggacctggagcacaatcagctcttcgtgctcttgctcgatctggaatgagaattggtcgcatagaggacgtgactcccattccaacagacagtaccagaagaaagggtggacgaagaggaagaaggctgtagtattcttgttggatgctattatttgttttgacagcttataagtcagtgttttttggcggaacatgaggtcaagaggacttttctaagtttactctttagcacattgcatgagttgcaaatacaagagtacatgatttaatttcagtactttggccgacttttgcatgattcagttgtatgattggtatttaattttattctgtagaagaactgggaaatatggtgtttagttatagaacaacttt

SEQ ID NO: 1033 - DNA, 773 bp, Cryptomeria japonica
agaagcggcggacagcagatactcagagatctcagatttggaggcttggagcaacttacaatgtctgggaagaagaagaccagagaagttaaggaggaaaatgttactctaggacctgcagttagggaaggagaacatgtgtttggcgtagcccacatatttgcttctttcaatgatacatttgtgcatgtgactgatttgtctggaaaggaaacacttgcccgtgttactggtggcatgaaggtcaaagctgacagagatgaatcatcaccatatgctgcaatgcttgctgcacaagatgttgcacaaagatgcaaggagcttggcataactgccttgcatattaagcttcgggcaacaggagggaataagacaaagactcctggacctggagcacaatcagctcttcgtgctcttgctcgatctggaatgagaatcggtcgcatagaggatgtgactcccattccaacagacagtaccagaagaaagggtggacgaagaggaagaaggctgtagtatttttgttggatgctattatttgttttggcagtttataagtaagtgttatttggtggaacatgaggtcaagaggacttttctgttcttaagtttactctagcacattgcatgatttgcaaatacaagagtacatgatttgatatcggtactttgggcctatttttgcataattcagttgtatgagtggtttttaattttattctgtaaaagaactaggaaatatggtgtttagttatagaacaacttttttgtgc

SEQ ID NO: 1034 - DNA, 725 bp, Cycas rumphii
ccgttttgctgttttatcgtctcgtccaagtttgtgattccgctcagtcgatccaaaggcctgtatacctcgtcaaaatgtctggcaagaagaaagtcagagaagtgaaagaggaaaacgttactctagggcctacagtcagagacggagagcatgtttttggtgttgctcacatatttgcgtcttttaatgacacttttgtgcatgtgactgatttgtctggaaaggaaactcttgcccgagttactgggggtatgaaggttaaagctgatagagatgaatcttcaccttatgctgctatgcttgcagcacaagatgttgcacaaagatgcaaggagctgggtataactgctctacatattaagctccgtgcaacaggaggcaataagacaaagactcctggacctggagcacaatctgctcttcgtgcacttgctcgttctggaatgaggattggtcgcattgaggatgtgacacctatacccactgatagcaccagaagaaagggtggacgaagaggaaggaggctgtgattttttgggatgctattgtttcttggcagctcgttgaattttctgcctggaacattgaatctatagagcatttgtgtagactaagtcttgttctgataacatactttggagatgcatctgacattttctagtttgagttattgtgcccaaatggtattatttaggcgccctgtttttgcctcaagctgactg

SEQ ID NO: 1035 - DNA, 714 bp, Cycas rumphii
gcaggcttccgattccttagagttgattcaaaggcctgtatgcctggtcgaaatgtctggcaagaagaaagtcagagaagttaaagaggaaaatgttaccctaggtcctacagtcagagaaggagaacatgtttttggggttgcccacatatttgcatctttcaatgatacttttgtgcatgtgactgatttgtctggaaaggaaacacttgcccgtgttactggggggtatgaaggttaaagctgatagagatgaatcttcaccttatgcagctatgcttgcagcacaagatgtggcacaaagatgcaaggagctgggcataactgctctgcatattaagcttcatgctacaggaggcaataagacaaagacacctgggcctggggcacaatctgctcttcgtgcacttgctcgatctggaatgaggattggtcgtattgaggatgtgactccaatccccactgacagcaccagaagaaaggggggatgaagaggaaggaggctctgattttttggggtgctattatttcttggcagcttgttgcatttcctgcccataaccttagatttatagagcatatgtgttgactgattttaattctgatcacatgaccagaggcatgtctgacaggttaaaatttgagctgttttggcaaaatggtattatttaggcatccctctttattgtcttggttttgcctgtaatggactgc

SEQ ID NO: 1036 - DNA, 696 bp, Cynara scolymus
ctcgcgggggcgcaatccgtatcgaactttgaacgccggaggagagcaaagagaagccacacgcccacaccatgtcttcgaagagaaaggttagagagccaaaggaagaaaatgttacccttggacctgctacccgtgaaggagagctggtgtttggtgtggcacatatctttgcatcattcaacgatactttcattcatgtcactgatatttctggaagagaaaccatggttcgaattactggtgggatgaaagtgaaggctgatagggatgaatcatctccctatgcagctatgcttgctgcacaagatgtttctcagcgatgcaaggaacttggcatcaatgctcttcacataaagttgcgtgcaaccggagggaataagaccaagacgcctggtccaggtgcccagtctgccctcagagctcttgctcgttctggaatgaaaattggtcgcatagaggatgtgacaccaattccaacagatagcacccgtcgaaagggtggtagaaggggaaggaggctgtgattcatttgcattttggattgttactgttttatgatgacttttgtaagagaggttatttgatagcctggatatgtttctctgtatttttggtattaatatttcgtgctaattcggcaacttcggtttttgaaagaaatattgaagtttcacctaattgtttagtttttag

SEQ ID NO: 1037 - DNA, 683 bp, Cynara scolymus
cggggaacacttggtgccgctgcaatcagacctttgaagacccaaatcactttcgacgcattagcagccatgtcgtcgaaaagaaaggttagagagccaaaggaagaaaatgtcactcttggaccagctacccgtgaaggagagcttgtttttggtgtggcacatatctttgcgtcattcaatgatactttcatccatgtgactgacatctctggaagagaaaccatggtccgaattactggtggcatgaaagtgaaggcagatagagatgaatcatccccctatgcggctatgcttgctgcacaagatgtttcccagcgatgcaaggaacttggcatcaatgctcttcacattaagttgcgggcaactggagggaacaaaaccaagaccccaggtccaggtgcccagtctgccctcagagctcttgctcgttcaggcatgaagattggtcgcatagaggacgtgacaccaattccaacggatagcactcgccgaaagggtggtagaaggggaaggaggctctgattggtgtggtcactattcatttgcaggttttggattactgttctatgttgagacttttgtaggttatatttgtgtttcatgtgttggatcttgtcatgtttatcatcctttctggatggatgtttgaatgacatgcatttttggtgccttttgtgtcg

SEQ ID NO: 1038 - DNA, 649 bp, Cynara scolymus
actgtgtgtgaccttattcttgcaccatcaccatactatcgmagagacgccgccatgtcgaagtcgagaaaggtcagggagccaaaggaagaaaatgtcaccctyggacctgctrcccgtgaaggagagcttgtatttggtgtggcacacatctttgcatcgttcaatgacacatttatccatgtgactgatatctctgggagagaarccatggtccgaattacaggggggatgaaggtgaaggccgacagggatgaatcctctccctatgcagytatgcttgctgcacaagatgtttctcagagatgcaaggagcttgggattaatgctcttcacataaagttgcgggctacaggaggtaacaagaccaagacacctggtccaggagcccagtctgctctaagrgctcttgctcggtctggcatgaaaattggtcgcattgaggaygtgactccgattccaactgatagcacccgtagaaagggcggtagaaggggaagaagactgtgatctcggcaaaatggattattatgcaattgttcaagttttgttttttggtcgacagttttgatgatttcgatatcgtgtttctttgatggagtattttatataaagtgaattggaatttacttgtgttctgttaytgcgg

SEQ ID NO: 1039 - DNA, 731 bp, Taraxacum officinale
  misc_feature (729)..(730): n is a, c, g, or t
cgggggctatcggacgatcagtttcgtgatccagagaggaagaagagcaggctgaaggaaaccgccgccatgtcgaagagaaaggttagggagccaaaagaagaaaatgtcacccttggacctgcaacccgtgagggagagcttgtatttggtgtggcacacatctttgcatcgttcaatgataccttcattcatgtaactgatatctccggaagagaaaccatggtccggattactggtgggatgaaggtgaaggctgacagggatgaatcctcaccctatgcagctatgcttgctgcacaagatgtgtcccaaagatgcaaggaacttggtatcaatgctctgcacataaagttgagggcaactggaggtaacaagaccaagacacctggtccaggtgcccagtctgccctcagagctcttgcacgttctggcatgaaaattggtcgcatagaggatgtgactcccattccaactgatagcacacgtagaaagggtggaagaaggggaagaaggctctgagtttcttatggagttatgttttctttttgggttcagattgaatgataattgtagcattttggtagacatgttttgctgttattctcctatctatggattatcagatgttctattacattaaatattttacttatatccttttaagtaaacttttacctagatgtttcatatcctttaaaagttttgtggaataaattattcctagtnna

SEQ ID NO: 1040 - DNA, 979 bp, Taraxacum officinale
cggccgggggctatcggacgtcagttttgtgatacagagaggaggaagagcagagtgaaggaaaccgccgctatgtcgaagagaaaggttagggagccaaaggaagaaaatgttacccttggacctgcaacacgtgagggagagcttgtatttggtgtggcacacatctttgcatccttcaatgataccttcattcatgtgactgatatctccggaagagaaaccatggtccggattactggtgggatgaaggtgaaggctgacagggatgaatcttcaccctatgcagctatgcttgctgcacaagatgtgtcccaaagatgcaaggaacttggtatcaatgctcttcacataaagttgagggcaactggaggtaacaagaccaagacacctggaccaggtgcccagtctgctctcagagctcttgcacgttctggcatgaaaattggtcgcatagaggatgtgactcccattccaacggattccacacgtagaaagggtggaagaaggggaagaagactctgagtttcttatggagttatgttgggaacaagttttgttattgggttgacctttttggacctttttagtgtgttttgattattggatatgtcgtttaaaacatttgggtctgttgaattttgggggtaacatcatgtttagttgcttttttacattgtgtttgtcaagtacgaccagtatttaaatttattctcaacttggacaaatataccaattacttgtttaaaaacttttttggccttttccaaacccctaaaaaagggccaaaaagggttttcctttggggaatttttttcccaaaaaaagtcggggagaaattttaaaggtttttcccctttcccccccctttggaacgggggaaacatttgggggggaaaaaaaaaagccccccccccaatttttttttccaaaatttgcaaaaccttaaaaaaaaagggggcccacggggaaatttttt

SEQ ID NO: 1041 - DNA, 745 bp, Eucalyptus gunnii
cggccggggctggcctgacatttttgctgccgtcgtccccgaagccgtgagcactcgagatctcagttcgacgcatctgcaaccatgtcgaagaggaaggtcagagagccraaggaagaaaacgttacccttggtcctgccgttagagagggagagtatgtctttggygtcgctcacatttttgcctccttcaatgacacattcattcatgtgactgatttatctggtagggagaccctcgtccgtattactggtggtatgaaggtgaaagctgatagagatgagtcttctccatatgctgccatgcttgcagcccaggatgttgcccaaagatgcaaggagcttggtgtcactgcccttcatattaagctccgtgcaactggtgggaacaagacaaaaactcctggtcctggtgcccagtctgcccttcgagccttggctcgttctggaatgaaaattggtcgcatagaggacgtgacaccaatcccgactgatagcaccagaagaaagggtggtagaagaggaagaaggctgtaggcaatgtctttcgccttttatcaagcttcagtgtttcagtatctcatattagccccgattctggggccggaacagttttgctcttagaaactatttttgtacttccgaaaaacggctagctggaatacttacagatggaagtttctggagaattatggcatttgtggttcgtgataattgcatttgagattctcaattatggattgac

SEQ ID NO: 1042 - DNA, 897 bp, Eucalyptus gunnii
  misc_feature (885)..(886): n is a, c, g, or t
tgggggaccttttagaacaagtttcgggtccgggattcccgggatgtcgcagcttcttccgcaggcgttcgagatctctccttcgactctcctccgctgttgcccgaccccaattctccgtcatgtctaagagaaaggtcagggagcccaaggaggagaacgtcacgctcggcccggccgtgcgcgagggcgagtacgtcttcggggtcgcccacatcttcgcctccttcaacgacaccttcatccacgtgaccgacctctccgggagggagaccctcgttcgcatcaccggtggcatgaaggtgaaagctgacagggatgaatcatcgccttatgcagccatgcttgcagcccaagatgtggctcagcgatgcaaggaacttggtgttactgctcttcacattaagcttcgtgccactggaggaaacaagaccaagaccccaggtccaggtgctcagtcagcacttcgagcccttgctcgttctggcatgaaaattggtcgcatagaggatgtgacaccgataccaacggacagtactcgcagaaagggtggtagaaggggtagaaggctgtgattactcctggcatcaggcatgcaattatgctgcttctttttctgcgatgttctgcattagaagcaagttctcgcttttgttgctgttattgtgattagtcttaggggttatatgtggatgttaaaattcatctcttgagctggtttaagacaaaagttttggatctagtttctcaccattgattagagcttgagcctcatcttctcatcttacaccttgcaagtgccatggaagtttgctgattggtgctctgtaattcsyttctcycttccgtakttcttggatgcmcmtggkgagggattcgatggannaaaaaaaaaaa

SEQ ID NO: 1043 - DNA, 664 bp, Festuca arundinacea
ggcacgaggccaaaccctagcctcctccccctcttccctctcaccgccgccgccagcaagcagacgcagctatgtccggaaggaagaagacccgcgagcccaaggaggagaacgtgacgctcggccccgccgtccgcgagggagagcacgtcttcggcgtcgcgcacatcttcgcctccttcaacgacaccttcatccatgtcacggatctgtccgggagagagacgctcgtccgcatcaccggtggcatgaaggtcaaagctgaccgtgatgaatcatccccttatgcagccatgcttgcatctcaggatgttgcagtaagatgcaaggagcttgggatcactgctctgcacattaagctccgtgctactggtggaaacaagacaaagacaccaggtccaggtgctcaatctgcacttagagctcttgcacgttctggcatgaagattggacgcattgaggatgttactccagtcccaactgacagcacccgccgaaagggtggtagaagaggaaggaggctgtaattctatgccttttcaaggatggtgcaacaccaagctatctatctcgtgtcttgaaacttgttatgtactctgtttatgatgtcaaatcagattttgtggatctatagcttttgagcaatatcctgctgtggatgttt

SEQ ID NO: 1044 - DNA, 646 bp, Festuca arundinacea
ggcacgaggcggcggcgaactcgtgatctcaaaccaggcgcactctcctcgtcgtcgtctcggatccaccgccgcttcacgcaaccatgtcgaagaggaagaccagggagcccaaggaggagaacgtcacccttggcccggctgtccgtgaaggagagcatgtctttggtgttgctcacatctttgcatccttcaatgacaccttcattcatgtgactgacttgtctgggagggaaaccctggtgcgcatcactggtgggatgaaggtcaaggctgatcgtgatgaatcttcaccttatgctgctatgcttgcatctcaggatgttgctgtacgctgcaaggagcttggcatcactgcactgcacattaagctccgtgccactggaggcaacaaaaccaagacacctggacctggagctcagtctgctctcagggctcttgctcgttctgggatgaagattggccgcattgaggacgtgactccagttcccactgacagcacccgccggaagggtggaaggaggggaaggaggctgtagatgtcttcttcaggctatctttcatctcccatggtggcaatcaagaacttactcctccgtgtggtcctactgtctatggttatcaggaggagctttaattttgccct

SEQ ID NO: 1045 - DNA, 566 bp, Festuca arundinacea
ggcacgaggcgccactgccgccaccatgtccgggaggaagaagacgcgggagcccaaggaggagaacgtgacgctcggccccgccgtccgcgagggagagcacgtcttcggcgtcgcccacatcttcgcctccttcaacgacaccttcattcatgtgaccgatctttccgggagggagacgctcgttcgcatcactggtggcatgaaggtcaaagctgatcgtgatgaatcgtcaccttatgcagctatgcttgcatcacaggatgttgcagtcagatgcaaggagcttggaataactgctttgcatatcaagctccgtgctactggtggaaacaaaacaaaaactcctggccctggtgctcaatctgcccttagagcacttgctcgatcaggcatgaagattggtcgtattgaggatgttactccagtacctactgacagcacccgcaggaagggtggaaggagaggaaggaggctgtgaactgcatgcagtttgaaaggaacaatagtgtggtttcccaaatgtaagggtttgctttgtaccagtttgtgtccctcaacctcgt

SEQ ID NO: 1046 - DNA, 658 bp, Linum usitatissimum
ctcgtctaaaactgcaagcgagaagctctctcgagatctccagctagctcgttctcttccagcctcacttcctgcaaagctatgtcgaagcgaaaggtcagggagcccaaggaggagacctgttaccctgggtcctaatgtccctgacggaaccattgtcttcggtgttgctcacatctttgcatcgttcaacgacacctttattcatgtcactgatatttctggcagagaaactttggttaggatcaccggtggaatgaaggtgaaagctgacagggatgagtcctctccctacgctgctatgcttgcagcacaggatgtttctacacgatgcaaggagctgggtatcaatgctcttcacattaagctccgagccactggtgggaacaagaccaagacccctggtcctggcgctcagtcagctctcagagctcttgcccgttctggcatgaagattggccgcattgaggatgtgacccctatcccaactgacagcactcgccgaaagggtggaaggagaggaaggaggctgtgagatatttggctcgcgtcatcttggctggctttgcggtcttattcatgcttggtttttagtgttggaaactttatcaaacacttgaaaatcgttggatgcaggcaacttattatcgattttcga

SEQ ID NO: 1047 - DNA, 730 bp, Zingiber officinale
gcacgmggycgtcttgttgctctctagctctcgcttcgaccatgtctggaagaaagaagaccagggagcccaaagaggaaaatgtgacgcttggtccgactgtacgagaaggcgagcaagtttttggcgtcgcccatatttttgcgtcatttaatgacactttcattcatgtgactgatttgtctggaagggaaacacttgtcaggattacaggtggtatgaaggttaaggctgaccgagatgagtcatctccatatgctgccatgcttgcagcccaggatgttgcacagagatgcaaggaacttgggattactgctttgcatattaaattacgtgctactggtggtaataagaccaaaacacctggtcctggtgctcagtctgctcttagagcccttgctcgtgctgggatgaaaattggtcggattgaggatgtaactccaattcctaccgatagcacgcgcagaaagggaggaagaagggggcggaggctgtagtttgtcaccgtatctgcatcaagctttttcattagcattttggaaatcaaggtcttttgttagcattttggagattgatttcggatgtactacaatagcttagtagtttctcattgataagatatggagccttcgctacggacttaaagcttgtgtttgtacaccgtttggattcttcaacttatcatctatgtttctatcctctttaataattgctatcattaaacttctct

SEQ ID NO: 1048 - DNA, 983 bp, Vitis vinifera
ataagcagccaagagcagccgtattctcctccttccactctagggtttcggcagaacagcttccccaaaagcccaagctctttctcattcgtcgaagtcatgtcgaggaggaaggttagagaacccaaggaagaaaatgtgacacttggacccactgtaagagatggagagcatgttttcggtgttgcccatatctttgcatcatttaatgatactttcattcatgtgactgacttgtcaggaagagaaactcttgttcgcattactggtggtatgaaggtgaaagctgacagggatgagtcatccccatatgcagccatgcttgcagctcaggatgttgcccaaagatgcaaggaacttggaatcactgctcttcacattaagctccgtgctacaggtggtaataaaacaaaaacacctggtccaggtgcccagtctgcactcagggctcttgctcgttctggaatgagaattggtcgtatagaggatgtgaccccaatcccaactgacagcactaggagaaagggtggtagaagagggagaaggctgtaagcttgccattctcatcccatcacgtcctgcgatcattttcacagtgactgttattgataatggattgatggtaccttgaagttttgctgaagttcttattgttgaacttaatttgtagtttttgacattgcattggccatagatttattttaagctcctttagagaccaagttgtgagactactctagaagctgtcttttgaattttttttaaagattttgttttattttattttaaacctccatggattggattattaatctgtgctgtgacagtggattcagttttattagtgacccaagatgcggtttgtgcatgcatggcaagactaatgtgtgtgtggtttatgcctgaagaaaccactcaattcatgtgttttttaattgaaaactcataactgaaaagtattaggattcaatttttctgcatca

SEQ ID NO: 1049 - DNA, 802 bp, Vitis vinifera
cgaaagtcactgctctcttcttcctcctaatctctgagcattccgaatttgatccgcttgaagccatgtcgaggaggaaggtcagggaaccaaaggaagaaaatgtaacccttggaccaactgtaagggatggagaacatgtttttggtgtggctcacatttttgcttccttcaatgacacattcattcatgtgactgatttgtctggcagagagaccttggttcgcatcactggtggcatgaaggtgaaagctgacagggatgagtcttcaccatatgcagccatgcttgcggcccaagatgtttcacaaagatgcaaggaacttggcgttactgctcttcatatcaagctccgtgccactggaggaaataagaccaagacacctggtcctggtgcccagtctgctctccgagcccttgctcgttctggaatgagaattggtcgcatagaggatgttaccccaatccccactgacagcactcgaagaaagggtggaagaagagggagaagactgtgagctggctcttattatttcatcaaactatccttgcatttgggtgttttgttttctgtggtggttacttgaagcttcagctggaaaatgattttttagttgaaacatttttgtagttttgacaatggcttggttgacttaagatttatatggagtatttgtgaaatggaaccatttgactttaactagggcatttacttccctctttttcaatatggaatcgtacgagtataagttataacttctgatgttttacgtgtatcttcacgagtctctgggaagtaggc

SEQ ID NO: 1050 - DNA, 729 bp, Vitis vinifera
ctgcgaaagggctatctcgaaaccctaacttcagtcctcaatctacaatccatttgaagccatgtcaaggaggaaggttagagagcccaaggaggaaaatgtgacactcggacccactgtaagggatggggagcatgcttttggtgtggcccatatttttgcatcatttaacgatacattcattcatgttactgacttgtctgggagagaaacccttgttcgcattactggtggtatgaaggtaaaagctgacagggatgaatcatcaccatatgcagccatgcttgcagcacaagatgttgctcaaagatgcaaggaacttggaatcactgccctccacattaagctccgggctactggagggaacaagactaagacccctggtccaggcgcccagtctgcgcttagagccctggctaggtcaggcatgagaattggccgcatagaggatgttactcccattcctactgacagtacgcgaagaaaaggtggcagaaggggaagaaggttgtgaattgtcatattcaatataaagtttatgtttggctgctgtgatgttagttgggaatgtttcaagttgagggttcttttcacttagtggggacaattttgtagttctggatatgtatggttgatatttgatcccgtaaaagaactttttattttaagatttgttgatcaaaaaacagttttttgttgtcaattttagcatcttatcctctatcagta

SEQ ID NO: 1051 - DNA, 784 bp, Mesembryanthemum crystallinum
  misc_feature (13)..(13): n is a, c, g, or t
  misc_feature (25)..(25): n is a, c, g, or t
gagatcaagttcnctagtcatgggnacgascctcgccaccctaccgcacatagagaaagagagagaagaggagctcagttaagatcctgtgaaaatgtcgaggagaaagaccagagaacccaaggaagaaaatgtgacccttggccctgctttgagggaaggcgagcatgcttttggtgtggcacacatttttgcctctttcaatgacaccttcattcatgtcactgatttgtctggcagggaaactttggttcgtattacaggtgggatgaaggttaaagctgacagggatgagtcttctccttatgctgctatgcttgcagcacaagatgtgtcacaaagatgcaaggaacttggaatcactgctcttcacatcaagctccgtgctactggtggaaacaagaccaagacacccggtcctggtgctcagtctgcactccgtgctcttgctcgttctggaatgaaaattggtcgtatcgaggatgttactccaattcctaccgacagtacccgaaggaagagtggacgtagaggacgaaggttgtagggtgtctcttcaagcagtttccattcacttgtatggcgattttatatttttgagttgcattagagttccgcctatagtgctggtaaaagctttgggaagttttcatctatctggagacaattttgtatgtttcagcagctgctttcttagacactctttaactatatcattttaagaatcttcgtaaggcttaaaagctatgtgacttyytagttycaatatcagtgtttgagttgt

SEQ ID NO: 1052 - DNA, 685 bp, Mesembryanthemum crystallinum
  misc_feature (647)..(647): n is a, c, g, or t
ggttctttcatctacctgcaaccatgtcgaagagaaggaccagagagcccaaggaagagaatgtgactctcggcccagctgtgagagagggtgagcacgtttttggtgttgctcgcattttcgcctcattcaatgacactttcatccatgtcaccgatttgtctggcagagaaactcttgttcgtattacaggtgggatgaaggtgaaggcagacagagacgagtcttctccttatgcagctatgcttgcagcccaagatgtttcacaacgatgcaaggaacttggaattactgctcttcacattaagctccgtgctactggtgggaacaaaactaagactcctggtcccggtgctcaatctgcacttagagcccttgctcgttccggaatgaaaatcggccgtattgaggatgtgaccccaattcccactgacagtacccgcagaaagagtggcagaaggggaaggaggctgtgaattttctcgttcaaccctgggcatacattttgtcatgctattctatgttttgggtagtaatagttgcagttgaagcctcccttcatttttgcagttgagttgtagtttggaattgtttatgactggttactatctcaggacttatggaggtttgactaataggtatacagnttttgatggtgtttgactcaaatacagatattatctca

SEQ ID NO: 1053 - DNA, 680 bp, Ipomoea nil
ttacatcgctagggttcttcagcctcaacagcagctcagcttctacagctctcttccacccacctgaagccatgtcaaggagaaagaccagagagcccaaggaggagaatgtgacccttggacctgccattagggaaggggaattggtgtttggtgttgcccacatttttgcatcattcaatgacacattcattcacgttactgatttgtctggccgggaaacactggttcgcatcactggtggaatgaaggtcaaggctgacagagatgaatcttctccatatgcagctatgcttgcagcacaagatgtgtctcaacgatgcaaggagctcgggattacagctcttcacattaagcttcgagctacaggtggtaacaagaccaagactcccggtccaggtgctcagtctgctctcagagcccttgctcggtcaggcatgaagattggccgtatagaggatgttactccaattcccaccgatagcactcgtagaaagggtggaagaaggggaagaaggctgtgattccttcgttatacttgtgcactcaccaccatgtttcgaaccctcaagtccggtcatttttgtttcgctttcgttctttatttcgggtgtttaaacattttgtagccaagaggcacttgtggttgtcaattttaccaacttttggtagtagtatgt

SEQ ID NO: 1054 - DNA, 709 bp, Ipomoea nil
tccgtggtttctcgagtcatcgctgtctggaacagcgatgagaaagctttgctagcaactctgtcctccatcctaatcaacccagagccatgtctaagagaaagaccagggagcccaaggaggagaatgttaccctcggacccgccatacgtgagggagaattagtttttggtgttccccacatttttgcctcgttcaatgatacattcatacacgtaactgatttatctgggagataaacattggttcgcattactgggggcatgaaggtgaaggctgacagggatgaatcttctccatatgcagctatgcttgcagcccaggatgtcactcagcgatgcaaggaacttggaatcactgcccttcacattaagctcagggctacaggaggtaacaagacaaagactcctggtccaggtgcccagtctgctctcagagcccttgctcgatctggcatgaaaattggtcgcatagaggatgttactccaattcccactgacagtactcgtagaaaaggtggtagaaggggaaggaggctgtaattccattttatactctctcaaaatggttgcaacttcaagtcatggaagagtttttgttttactttaatgtttagacgtttttgtagctcactctcaagcaaaaacttcaaatcaaatttgatggtttcaagcctttgatagcatgtgagatgttggatttgtttgat

SEQ ID NO: 1055 - DNA, 737 bp, Ipomoea nil
atatcttctacaaccctagatatataaacgccgagccttgtcacttggaatcagctctagggtttttccaagctttaagtcgcagctcagctctttcttcatcacccaaagccatagccatgtcgaggagaaagaccagggagcccaaggaggagaatgtcactctcggaccagccataagagaaggggagttggtgtttggtgttgctcacatttttgcctcattcaatgatacgttcattcatgttacggatttgtctggaagagaaacactggtccgtattactggtggcatgaaggtcaaggctgacagagatgaatcttctccttatgctgctatgcttgcggcacaagatgtgtctcagcgatgcaaggagcttggaattactgcactgcacatcaaacttcgtgctacaggagggaacaaaacaaagactcctggccccggtgcccagtctgctctgagagcccttgctcgttcaggcatgaaaattggccgcatagaggatgtcacaccaattcccaccgacagtactcgtagaaagggtggtagaaggggaaggaggctgtgattccttctttatactcattcatgtggatggaatctacaatcaaggatgctttgaatatctagacaacagttgagatttgattgcgaatttttatatttttcagatactgtagcttgtggaatggtggaactgtttgattttgctaaattaagaatacctcttatc

SEQ ID NO: 1056 - DNA, 742 bp, Ipomoea nil
cgctagggttcttcaagcttcaacagcagcttagcttctgcagctctcttccacccacctgaagccatgtcaaggagaaagaacagagagcccaaggaggagaatgtgacacttggacctgccattagggaaggggagttggtgtttggtgttgcccacatttttgcatcattcaatgacacattcattcatgttactgatttgtctggccgggaaacactggttcgcatcactggtggaatgaaggtcaaggctgacagagatgaatcttctccgtatgcagctatgcttgcagcacaagatgtgtctcaacgatgcaaggagctcgggattacagctcttcacattaagcttcgggctacaggtggtaacaagaccaagactcctggtccaggtgctcagtctgctctcagagcccttgctcggtcaggcatgaagattggccgtatagaggatgttactccaattcccaccgatagcacccgtagaaagggcggaagaaggggaaggaggctgtgattccttggttatasttatgcactcaccaccatgtttggaaccatcaagtccaggcgtttttgttttgcttttgctctatatttcgagtgtttaaacattttgtagccaagaggcacttatggttgtcaattttaccaacttttggtagtagtatgtcatattacaactaatctttactttgtgtttgtttaatgtcatattttggtttattagactctagaaa

SEQ ID NO: 1057 - DNA, 794 bp, Actinidia deliciosa
tatctaagcacgaggcggaatctcaagagctctctctctctctctctctctctctctctctctcgttcgcaggcatgtcgaggaggaaggtcagggaacccaaggaggagaccgttactcttggtcccagtgtacgtgatggggaaaacgtattcggtgtggcccacatttttgcatctttcaatgacacattcattcatgtgactgatttgtctggaagagaaaccctagttcgcattactggtggtatgaaagtgaaggccgacagggatgaatcttcaccatatgctgctatgcttgcagctcaagatgtttcacagcgatgcaaggagcttgggattaatgcacttcacattaagctccgggctacgggaggcaacaagactaagacacctggtccaggtgcccagtctgcactcagagctcttgctcgttctggcatgaaaattggtcgcatagaggacgtgactcccattccgaccgacagtactcgcagaaagggtggcagaagggggaggcggctgtgatctgttgcaatatgttcaatcatggttgcagttttggctgggatatttagttcagttgcttcctttatctatcggcgttttgaactacttttttttttagtttttgatgtggtttggactacatttgatggtctggagctcgaaaagttttaactcttcattgctgtgttttgagctttcattttagtctggttgtcagagctataaatacactatccttccatttatacaatagaactgctggtcttttgcgactaaaaaaaaaaa

SEQ ID NO: 1058 - DNA, 706 bp, Actinidia deliciosa
ttttcgaagattgataactgaagctcctctctctctctctcacacacaacagctcgcagccatgtcaaagaggaaggttagggagccaaaggaagagaccgtaactcttggacccaaagttagagatggagagaatgtttttggtgttgcccacatttttgcatcatttaatgacacattcatacatgtaactgatttgtctggacgggaaacacttgttcgcattactggtggcatgaaagtgaaagcagacagagatgagtcttcaccatatgcagctatgcttgcagcacaggatgtctcacagagatgcaaggaacttggcattaatgcccttcatattaagctccgtgccacaggtgggaacaagacaaaaacacctggtcctggtgctcagtctgcactccgagcccttgctcgttcaggaatgaaaattggtcgcattgaggatgtgactccaattcctaccgatagcactcgtagaaagggtggcagaagaggaagaaggctgtgagcttgcttttgtcgtccaagtacaaccatggttctttttcagcatttgtcggtacttccaattggaactgtgttccttctatttttaatcggactttattttcatgttctgaactgcgttgtagcgtttgacatttacttttggccaaggatttgagcttctgtggttgaagaaacaaaagtatttttgcaa

SEQ ID NO: 1059 - DNA, 890 bp, Actinidia deliciosa
cttcatataaagcgcagccgcaacaagcttccgtcttcctctaggattttcgaagattgataactgaaggagctctgtaaccatgtcaaggaggaaggttagggagccaaaggaagagaccgtaacccttggacccacagttagagagggagagaatgtttttggtgtggcccacatttttgcatcatttaatgacacattcatacatgtgactgatttgtctggacgggaaacacttgttcgcattactggtggcatgaaagtgaaagcggacagagatgaatcttcaccatatgcagctatgcttgcagcacaggatgtctcacagagatgcaaggaacttggcatcaatgcccttcatattaagctccgtgccacgggtgggaacaagacaaaaacacctggtcctggtgctcagtctgctctccgagcccttgctcgttcaggaatgaaaatcggtcgcatcgaggatgtgactccaattcctaccgatagcactcgtagaaagggtggcagaagagggagaaggctgtgagcttgcttttgtcgtccgagaacaaccatggttctttttcagcatttgtcaggacttccaattagaactgttacttctatttcaagctgactttattttcgtgttctgaattcgcatattgtagcgtttgccatctacttttggccgaggatttgagcttctgtggttgaagaaacaaaagtttttttgcaaggattgaatttttgaatgtgttttgatttgtggattgtgaaatgatgtacttgtgtcctctgaggccctatttatttggttacgttatcaaaatcagctgagaacaccttcagaatttgtttctaacatgaaaacattgcgttaatatcttaaaaaaaaaaaa

SEQ ID NO: 1060 - DNA, 688 bp, Lactuca sativa
ggtttgctgcgcmatcgagaaacgagaagtcatgtcaaagagaaaggttcgtgaaccaaaggaagaaaatgtcactcttggacctgcaactcgtgagggagagcttgtattcggtgtagcacacatctttgcttccttcaatgacaccttcattcatgtgactgatatctctggaagagaaaccatggtccggattaccggtgggatgaaggtgaaggctgacagggatgagtcttcaccctatgcagctatgcttgctgcacaggatgtctcccaaagatgcaaggaacttggcataaatgctcttcacataaagttaagggcaactggaggtaacaagaccaagacacctggcccaggtgcccaatctgccctcagagctcttgctcgttctggcatgaagattggtcgcatagaggatgtgactccgattccaactgacagtacacgtagaaagggtggaaggagaggaaggaggttgtgatgtgggtacatgcacagcaactgtgtattcaaatggatttatgttggttcaagttttgtttttgagtttacatttaatggcagataatttgtagaattttggtagacatattttgctgttatactctttctgtgctgtattgagttgaagatgttttattactttaaatattttagttttataagatgctttattacttcaaaa

SEQ ID NO: 1061 - DNA, 770 bp, Leymus cinereus x Leymus triticoides
ggcggcggcgcactcgtgatctcaaccaggcgcgcactcctcctcctctcgccgtcgtcgtctccgatcccccgccgctccacgcaaccatgtcatcgaagaggaagaccagggagcccaaggaggagaacgtcacccttggaccggctgtccgtgaaggcgaacatgtctttggtgttgctcacatctttgcatccttcaatgacaccttcattcacgtgactgatttgtctgggagggaaaccctggtgcggatcactggtggcatgaaggtcaaggctgatcgtgatgaatcgtcaccctatgctgctatgcttgcatctcaggatgttgctacgcgttgcaaggagcttggtatcaccgcactgcacattaagctccgtgccactggaggcaacaagaccaagacacctggacctggagctcagtctgctctcagggctcttgctcgttctgggatgaaaattgggcgcattgaggacgtgactccagttcccactgacagcacccgccggaagggaggaaggaggggaaggaggctgtaggcttatctttcaactctactggtggcaatcaagaaacttactcctctctgggtagtcctgctgtttctatgaatgtcaagaggagctttaattttgctctgttgaggatcatttactgttagtcgtactatgaatgttgcgtggatcctatttttggttcagaaacttgtggtatttatgcgaaaaactagcttttcagtctatggaaaccttgaaatggagtga

SEQ ID NO: 1062 - DNA, 993 bp, Liriodendron tulipifera
tatgagaaaacagtatatcataaacaggctaggaacatatatttaccagctacaatccattggtaactgtcaaaaaccatacaaaaatataccaaaatctaataagcaaaacctctgtatttctttgatctgctgaaaaggggacccttcctctactcatcagcaaaggtagtcttctttcctgtcccagctgcgcccatgcttggcttattaggtgtcccacgtcccctgccacccccgccaaaatgtccaccgccgccgcgtctgccgccaaatcggcctcctcctccaaaacccttctttcagaccctccgattcgcaattcgcagcggccatgtcgcgaagaaagaccagggagcccaaggaggagaatgtgacacttggaccaactgtacgagagggagagaatgttttcggtgtcgcccacatcttcgcatcttttaatgatacttttatccatgtgacagatttatctggaagagaaaccatggtccgcgttaccggtgggatgaaagtcaaggcagacagggatgagtcctctccctatgcagccatgcttgcggcacaagatgttgcacaacgctgcaaggagcttggaatcactgctctgcacatcaagttgcgtgcaactggtggtaacaagacgaagacacctggtccaggcgcccagtctgctctcagagcccttgctcggtctggaatgaaaattggtcgcattgaggatgtgacccctattccgcatgacagcacccgcagaaagggcgggagaagaggaaggaggctctagacgtatggcattgtttatcaaaagtttctgtggttgtttcctagctatagaaattggagctgtgttagttgttggggaatgctagtttttgttttgcttgtttggatatgagattttgcctgactggttatttttgttttatttaatcagatccatraaactttatgaactacaacaccatgctgctgaactttgagcatttgatt

SEQ ID NO: 1063 - DNA, 864 bp, Liriodendron tulipifera
gtgatataaatacaaccgaacgcgcgcgagaggttttcttctctagcatttgagggttttcttacagggagcagaagaagagctctgaaactctagacgctagccttcaatcccatctcttccattctgcagctatgtccagaagaaagaccagggaacccaaagaggaaaatgtcacacttggaccaactgtaagagaaggggagaatgtttttggtgtagcccatgtttatgcctcattcaacgatactttcattcatgtgactgatttgtccgggagagaaactttggttcgtgtcactggtggtatgaaagttaaagccgatagggatgaatcctcaccttatgcagccatgcttgcagcacaagatgttgcacaacgctgcaaggagcttgggatcactgctcttcacattaagctacgcgcaactggaggaaacaagactaagacgccaggacctggtgcccaatctgctctcagagcccttgcacggtctggaatgaagattggtcgcattgaggataagaccccaatcccccacgacagcacccgcagaaagggcgggagaagagggaggcggctgtagatcactctttctacatttttcaccatcaattggcagtgtattggtggtgcttgtcttagtgcagatggggagagctttagttgtttccaaaggtgttctagtctcgatgacatggtctttgccaactgttttactttctacgctcacagttttggatccgagttgaatttatttttctggtaaactcttcttttttacatggtttgggatgtggttgtccaaaaaccacaggataagatgtttcatacccgcccaatcaaagatcacttttctaaca

SEQ ID NO: 1064 - DNA, 720 bp, Lotus japonicus
gtaacacatcacaagccgaaggcgcatccattctccgattcccatcgccgccgcactgcaaccatgtcgaagagaaaggttagggagcctaaggaagacaacgtgaccctgggtccagctgttagagatggtgaacatgtctttggcgttgctcgcatctttgcttccttcaatgatactttcattcatgtcactgatttgtctggcagggaaacccttgtacgcatcactggtggaatgaaggtgaaagctgacagagatgagtcatctccttatgcagctatgcttgcagcccaggatgttgctaccagatgcaaggagttgggcattactgctcttcatatcaagctccgtgccactggtggaaacaagacaaaaactcctggtcctggtgctcaggctgctctccgtgcccttgctcgttcaggaatgaaaattggtcgcatagaggatgtgactcctattccctctgatagcacccgcagaaagagtggtagaaggggaagaaggctttagattccttatgtggtatatggctcgagttgctatcttttactttctatgccagatggattgtggctgtttgaaattttccaaaaacatctatttgtatttctgaggtattgacagttttagttaagttcatttagagtttatgttaaagagaatattgaaggttttgaatgttgattcgttgctcgcaatggcgtttaatggcct

SEQ ID NO: 1065 - DNA, 771 bp, Lotus japonicus
ccctaattcagagtctctgtccagctgctccgatctgacctccaaaacctagcttccaaccaacaacatgtcgaagagaaaggttagagagcctaaggaggataacgtgactcttggtcctgctgttagagatggagagcatgtttttggcgtggcacgcatttttgcatcattcaatgataccttcattcatgtgactgatttgtctgggagagaaacacttgtccgcattaccggtggaatgaaggtcaaggctgacagagatgagtcatctccatatgctgctatgcttgctgctcaagatgttgctaccagatgcaaggagttgggcataacagctcttcatatcaggctccgcgcaactggcggaaacaagaccaaaacacctggtccaggtgctcaagctgctctccgtgctttggctcggtctggaatgaaaatcggtcgcatagaggatgtgaccccaattccttcagatagcactcgtagaaagagtggtagaaggggtaggaggctctgagtttgctactggagtttgctactggagtatggctggagctactttttttgtcactgttttgtttctttttccgggctgtattatgacgtgttgaaattgaaatctagtcgaagttggattttgcaacttttttgaacgacttttgtgttagccaactcccaactcttgaattcatctagatattattatagtcagacattactcgtgttgcttcgagatttcctataaatcttcattcgtcttgcctacac

SEQ ID NO: 1066 - DNA, 965 bp, Eragrostis curvula
cggcgcggggggsgaatagggttttcmgccgcccctcgccgccgtcctycctcgcgagctctacccaccccktctycgcccgccgccatcaccatgtccgggaggaggaagacgcgggagcccaaggaggagaacgtgacgctcggccccaccgtccgcgagggagagtacgtcttcggcgtcgcgcacatcttcgcctccttcaacgacaccttcatccatgtgacggatctgtccgggagggagacgcttgttcgcatcactggtggtatgaaggttaaagcagatcgtgatgagtcctcgccttatgcagctatgcttgcatcacaggatgttgctcaaagatgcaaggagcttggaattaccgctcttcatattaagcttcgtgctactggtggaaacaagaccaagactcctggccctggtgctcagtcagcactgagagcacttgctcgatcaggcatgaagattggtcgtattgaggatgttactccagtcccaactgacagcacccgcagaaagggtggtaggagaggaaggaggctgtaattcaaagagtgttgcagtccgcctgttgcagttctatcttgtttgagttcatcatgtattgaacaagttttgaggcgtctgctttgggtgatgtataatgctcaatatgttttctttttgtcgccaacatgtactctgttaaacggttgaygacaaagtaggaaaggttgcataagattcastaagaacttgtccaagtcyaaaaaaaagaaaaaaaagacaaaccacaaaaaagtaccctgggattgagaccccttgggttaaacgcaatttcccagaggccgacatggacggcccggtacacatgtcgaaatctggccccaatttggcccattactagagctcggtattacgatttccttgggccgacggagttatacagagttcgaggacctgggaaaaacccgttggggttt

SEQ ID NO: 1067 - DNA, 801 bp, Eragrostis curvula
  misc_feature (799)..(800): n is a, c, g, or t
aaggaaaaaaaaaaaaaaaaagaaaaatcagggtttttsgagtctggcggcggcggaggcagcagcggcgtgctcgtgatcttcaagcccaggcgcgctcggctccggttccccgtcgctcaacgccaccatgtcgaggagaaagaccagggagcccaaggaggagaacgtcactcttggacccactgtccgtgaaggagagtatgtctttggtgttgcccacatctttgcttccttcaatgacaccttcattcacgtcactgatttgtctgggagggaaactctggttcgcatcactggtggaatgaaggtcaaggctgaccgtgatgagtcatctccttatgcagctatgcttgcatctcaagatgttgcccaacgttgcaaggaacttggtatcactgcgctgcacattaagcttcgtgctactggaggcaacaagaccaagacccctggacctggtgctcagtctgctcttagggctcttgctaggtctggcatgaaaattgggcgcattgaggatgtgactccagttcccactgacagcacccgcagaaagggtggtaggaggggaaggaggctgtaggtgtcttcttcaagctacttatcatgtggtgctggccatcgagaaactagtcctctctggattgtattgctgtttctatgcttgtcaagaggagctttaatkwtgctctatgttaargatcgtwtgatgtyagtcgaatctatgatgttrsatggatmctgtwywgrkwagcrragtcacwccttawattkatgctatgaaaatttaaagatcacnna

SEQ ID NO: 1068 - DNA, 871 bp, Zea mays
gggctgggtctaataaaccctaatgggctgcggcctcgtagataaaccagcactactcatccgtcgccccacggaagtttcggcggcgccggcgtgctcgtgatctcgaccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggaggcaacaagaccaagacccccggacctggtgcccagtctgccctcagggcgcttgctcgttctgggatgaaaatcggacgcattgaggacgttaccccggtccccacggacagcactcgcagaaagggcggtaggaggggaaggaggctgtaggcatctctggcggctcttggcggcatgaagctagtcctctctgggtggtgttgctgttttctgtgtttgtcaagacgagctttaattttgctctatgtggatgaccgtttacagttactcgagcctatatgatgttgcatggataatgttttttggctgaggaattggctcgtcatatttatatatgcattttcactctctataaacgtgtactagagtaaccttccgtttcgatgagtcatatttatatgaagccagttacaga

SEQ ID NO: 1069 - DNA, 804 bp, Zea mays
gctgtcctccctagcaaacctaacgtaccctcttccgcgccgccatgtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaagctccgtgctactggtggaaacaagaccaaaacccctggccctggtgctcagtctgctcttagagctcttgctcgatctggcatgaagataggccgtattgaggatgttactccagtccccacagacagcacacgcagaaagggtggtagaagaggaaggaggctgtaatttcgagtcctgacgtggtgccctgtcagatgtagcagttcaagtctgtctgcatctaatatactgagttattaggttttgtatcgattgaagttttgagtgaactcttgaatgcttaccaatactcattcttgacatggcatacaacatagcagcacaattacaagaggccctactgactgtttgtctgtgtttgatcggtactggggagcggtgtcaacctatggtttcgggtgaccctaacaatggacagcatgttcctgacttcctatggctttaatctgaactagctacatctgaacta

SEQ ID NO: 1070 - DNA, 727 bp, Zea mays
ttctgaagtttcggcagcggtgtaggcagcggcggcgtgctcgtgtaatcccatcccgaagtctccggtcacctgtcactctacgcaaccatgtcgaggaggaagaccagggagcctaaggaggagaatgtgacccttggccccactgtccgtgaaggagagtatgtctttggtgttgctcacatctttgcatccttcaatgacactttcattgagggaaacactggttcggatcactggtactatcgtgcgatgaaggtcaaggctgatcgtgatgagtcgttaccttatgctgctatgcttgctgctcaagatgctgcacagcgttgcaaggagcttggtattactgcactgaacattaagcttcgtgccattggaggcaacaagatcaagacccctggacctggtgctcagtctgctctcagggctcttgctcgttctgggatgaaaattggacgcattgagaacgttacccctgttcccactgacagcatccgcagaaagggtggtaggaaggggaaggaggctgtaggcgtatttgacatctcttggaggtggccatcaagcagctagtcctctctggatagtgttgctgtttctatgcttgtcaagaggagctttgattttgctatatgttgatgaccatttaccgtggttgaggaattgagttgtcatatttatcttctagatatgcattttcacttataaacgtgggttcccgttagct

SEQ ID NO: 1071 - DNA, 888 bp, Zea mays
aaaggtgggactaaaccctagcgagctgcggcctagtatataaatgagcaccacgcgtctgtcgtccttctgaagtttcggcggcggcgtaggtagcggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaactggaggcaacaagaccaagacccctggacctggtgctcagtctgctctcagggctcttgctcgttctgggatgaaaattggacgcattgaggatgttaccccggttcccactgacagcactcgcagaaagggtggtaggaggggaaggaggctgtaggcgtgtatccttgctatttgccatcactttgcactggcctctgggtagcgttgctgtttattagcttgccaaaaggagttttaattttgctcattttgctctatgtcgaggatcatttactgttagccgaatctatgatgtgcattgataatgttttggttgaggaattgacaattatgctagttttgctgccccgcggatctgagcatgctttccgaatacgagcgtgttgtgtggagaaatagtttctctggaactgtggatgtttgcctgcctgcaacgt

SEQ ID NO: 1072 - DNA, 844 bp, Zea mays
taaaccctaatgggctgcggcctcgtatataaaccagcaccactcatccgtcgccgcacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccgggatgaaaatcggacgcattgaggacgttaccccggtccccactgacagcactcgcagaaagggcggtaggaggggaaggaggctgtaggcgtctcgtctgcgtggcatttgccggctcttggccggtggccattatgaagctagccctctctgggtggtgttgctgttctgtgtttgtcaagacgagctttaattttgctctatgtggatgaccgtttaccgttactcgaacctatatgatgttccatggataatgttttttggctgaggaattggctcgtcatatttatgtatgcattttcactctctctataaagtgtactagagtaatcttccct

SEQ ID NO: 1073 - DNA, 803 bp, Zea mays
ctagtatataaatgagcaccacgcgtctgtcgtccttctgaagtttcggcggcggcgtaggtagcggcggtgtgcttgtgatctcaatctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgcccaagatgttgcacagcgttgcaaggagctcggtatcacagcgctgcacattaagcttcgtgccactggaggcaacaagaccaagacccctggacctggtgctcagtctgctctcagggctcttgctcgttctgggatgaaaatcggacgcattgaggacgttaccccggtcccactgacagcacttccaaaaagggcggtaggaggggaaggaagctgtaagcctcttctgcgtgccatttgctggctcttgtcgggtggccatcatgaagctagtcctctctgggtggtgttgctgttttctgtgtttgtcaagacgagctttaattttgctctatgtggatgactgtttaccgttagtcgaacctgtatgatgttgcatggataatgttttttggctgagaatgaaaaccgcccagtcgtcaggcgttgtcgt

SEQ ID NO: 1074 - DNA, 700 bp, Zea mays
ctcttgtttccgctgccagcttcccgcaagccctatagcaaatcgtctctttctcatccgttggtgaacatgtcgaggagaaagaccagagagcctaaggaggaaactgtcactctcggaccagctgttcgtgacggagagcaagtgttcggtgttgttcacatctttgcttctttcaatgacactttcattcatgtgactgatctgtctggaagagaaactctcgtccgtatcaccggtgggatgaaggtgaaggctgatcgtgatgagtcctctccttatgctgctatgcttgcagctcaagatgttgctcaacgttgcaaggagcttgggatcacagccatgcacgtgaagctccgtgccactggaggaaacaaaaccaagactccaggccctggtgctcagtctgctctcagagcccttgctcgttcaggcatgaagattggtcgtatagaggatgtgactccaattcccaccgacagtacacgtagaaagggtggacgcagaggaagaagactttgatttctcaatgagtctcatcattgttctgttgtgcccttgactctcgtgggtacacacttcgaagttcgtttttgtctctctcagtttgcttcgtaaaaacattataagctgcgtctttcttcaacatggtaaccttctgcatttggagttttgggaatgaccaaaagtgttagtgact

SEQ ID NO: 1075 - DNA, 681 bp, Zea mays
ctaaccaaactctccgtcggcggaaactacaagaacaagaggctcttccatatccgttacttgccctaaaccatgtcgaggagaaagacgagagagccaaaggaggagacagtgacacttggaccagctgttcgtgatggagagcaagtcttcggtgttgtccacatctttgcttcattcaacgacactttcattcacgttattgatttgtctgggcgtgaaacccttgtccgtatcaccggtggaatgaaggtgaaagctgacagggacgagtcgtcaccatacgcagctatgcttgctgcgcaagacgttgctcagagatgcaaggagcttggaatcactgctatgcacgtgaagctccgtgccactggtggaaacaagaccaagacacctggtcctggtgctcagtctgctctcagagctcttgcccgttccggcatgaaaattggccgtattgaggatgttactccgatcccaacagacagtacccgccgaaagggtggtagaagaggaaggaggctctgagtttctagcttgtttcttttttgtctgaacaatgttttcttgagttgtagctttgtttcattttgtcagaacaatttcttttgaacaacatttttctacaatggtgaatctctgtcctttgcgaattacttatattatgagactgccgtctttccc

SEQ ID NO: 1076 - DNA, 831 bp, Zea mays
aataaaccctaaggggctgcggctcgtatataaaccagcaccactcatccgtcgccccacggaagtctcggcggcgccggcgtgcttgtgatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagatgtcgcacagcgctgcaaggagcttggcattactgcactgcacattaagcttcgtgccaccggaggcaacaagaccaagacccctggacctggtgcccagtctgccctcagggcgcttgctcgttccgggatgaaaatcggacgcattgaggacgttaccccggtccccacggacagcactcgcagaaagggcggtaggaggggaaggaggctgtaggcgtctcttctgcgtgccatttgctggctcttgtcgggtggccatcatgaagctagtcctctctgggtggtgttgctgttttctgtgtttgtcaagacgagctttaattttgctctatgtggatgactgtttaccgttagtcgaacctgtatgatgttgcatggataatgttttttggctgaggaattggctcgtcatatttctatatgcattttcactcttttttttgacgaaaa

SEQ ID NO: 1077 - DNA, 837 bp, Marchantia polymorpha
agttctagatcgcgagcggccgcccttttttttggtcttcaatcttcatcagctcgaccattccccgctgctgctgtgtccacctcgagcttctgcggagcagaatccagttcacccactgcaatcatgtcgggaaagaaaaaagttagagaagtcaaggaggacaatgtcacccttggtccatctgtaagggaaggagagcacgtcttcggcgttgcccatatttttgcttctttcaacgataccttcgtccacgtcagcgatctgtcagggaaggagacaatttgccgtgtaacaggcggtatgaaggtgaaggccgaccgcgatgagtcgtctccctacgctgccatgcttgctgcacaagacgtcgctgtcaggtgcaaggagttgggaattactgccctgcacatcaagctccgtgccacaggcggtaacaagaccaagactcctggacctggtgctcagtctgcactccgagcccttgctcgttctggcatgagaattggacgcatcgaggatgtaaccccgattccgacagacagcactagaaggaagggtggacgacgaggacgtcggttgtgagtaatgtggatacacgtcactgcgttatctgcagtcgctagtcattagtgtcacgttaacgagattctgcaacatagtgcagaatatgaaggaaattttgcactagtgtacccctacaagcatatgcagtgctcaacacactgctgtacaagagcctaatgatttgatttggggctgggcgatttccaaccctatgtcaagagcttgagaatttaacttgagagcataatggagcaattttcgagaaaaaaaaaa

SEQ ID NO: 1078 - DNA, 879 bp, Marchantia polymorpha
gtcgaagctcaactccgattctcttctctctgccgcgtctctctgccgtcgctgcagatttctcgtcggcaatcatgtctggaaagaagaaagttagagaagtcaaggaggagaatgtcaccttgggtcctaccgtgagggaaggagagcatgtattcggagttgcccatatctttgcctccttcaacgacacctttgttcacgtgactgatctgtcaggaaaggaaaccatctgccgtgtcaccggtggaatgaaagtgaaggcggatcgtgatgagtcctctccctacgcagctatgcttgctgctcaggatgttgctcaaagatgcaaggagctaggaatcactgcacttcacatcaagctccgtgccactggtggaaacaaaactaaaacaccaggtcccggcgctcaatctgctctccgtgccctggctcgttcagggatgaggattggccgcattgaggatgtcacgcctattcctactgacagcacccgaaggaagggtggtcgcaggggtcgtcgtctgtagattttgcatctacttttggtgtccagagttgccatcgatttgatagtaaagcttacgggacttcctttttatcatggttcttcgaaagaattttgctatctctccgtgttcacccattttccaacaaccgtaatcggtacatagggctctacaagactccatgtctagcatcgatcttgagctctaagagttttccctggctggtgtatctgatgagttggatctgcgatgatctcgtgctagtagatctatagaaggcaaggctgtcaggctttgcaattgtggacccattataattgagtacaagaaattatttgaagcgccagctagtcgcgacccaaaaaaaaaa

SEQ ID NO: 1079 - DNA, 805 bp, Medicago truncatula
gcaccaggacgctttgttctctctgaagaggaagaaggtgcacgccggcggattgaagtaggaacccaacaccaccttcagcaatgtcgtcgaagagaaaggttagagagccaaaggaagaaacagtgactcttggtccagctgttaaagatggagaacaagtttttggtgttgctcgtatctttgcttcgtttaacgataccttcatccatgtgactgatttgtctggtagagaaacacttgtccgtattactggtggaatgaaggtcaaagctgaccgagatgagtcatctccatatgctgccatgcttgctgcacaagatgttgccaccagatgcaaggagttaggcataactgctcttcacatcaaactacgtgctactggaggaaacaagaccaaaacaccaggccctggtgctcaggctgctctccgtgccttggctcggtcaggaatgaaaatcggtcgcatagaggatgtgaccccaattccttctgacagcacccgccgaaagagtggtagaaggggtagaaggctctgagtttgctatggtattatggaaggagctgcttatgtttttattttggtcaccgtgtttttgtttctttccagactgtattgtggcatattcaaaagttctacatgagtttatttagatacaagttaagagtcaaatgaaagtttttcatgtttcttctatgatttacacttttgcggatttgataaattgcttcatctaatttttgttttgttctctcatgtttactttataccgtatgagaattagtacttaatggcaatggtata

SEQ ID NO: 1080 - DNA, 806 bp, Medicago truncatula
gagagagagagagagagagagagagagagagagagagagagagagagagrtcagtatccaaaaccctaatttcttcaaatctcggaaccccattttcaaccatgtcgtcgaagagaaaggttagggagccaaaggaagagacagtaacattgggtccagctgttaaggatggtgaacatgttttcggtgttgctcgcatttttgcttcgtttaacgacaccttcattcatgttactgatttatctggcagggaaacccttgtccgtatcactggtgggatgaaagttaaggctgacagagatgaatcatctccctacgctgctatgcttgcagcacaggatgttgctactagatgcaaggagcttggtattactgcacttcacattaagctccgtgccactggtggaaacaagactaaaacacctggccctggtgctcaagctgctcttcgtgctcttgctcgttctggaatgaaagttggtcgtatagaggatgtcacacccattccttccgatagcacccgtagaaagagtggtagaaggggtagaaggctttagataccttatggtgtatggaagctggagttgtatcttttactttccatgccaaacagaattgtggcattttgaaatttgaaatttagccatgtttgattcaacacctaaacataagtatttcttgtgttattttaggaagactactgaaatttttgaatgttggttgctatgttgtccgaattagctttattgtttactttcattgtttgtttgagaacttgccagattattagaattatgttcagcttt

SEQ ID NO: 1081 - DNA, 886 bp, Cucumis melo
gcggtggcagcctagaaggtctcgaaggttcaagctaagtctctgaagccttaacttcatttacaaagtccggtcatatactctccaccatgtcgagaaggaagactagagagcctaaggaggaaactgtcactcttggccctgctgttcgtgaaggagagcatgtctttggtgttgctcacatttttgcttcgtttaatgacactttcattcatgtgaccgatctgtctggtcgggaaacacttgttcgcatcactggtggtatgaaggtgaaagctgatagagatgaatcgtcgccttatgctgccatgcttgctgcccaagacgtttctcaaagatgcaaggaacttggcatcactgctttacacataaagcttcgggctactggtggaaataaaaccaaaactcctggacctggtgctcaatcagctcttagagcccttgcacgttcaggcatgaggatcggtcgtatagaggatgtaactccaatacctaccgacagcactcgaagaaagggtggaaggagaggaagaagactgtgattcatagccatcttcaaaatgggtttgcacttcttgctgctcgaccattgagttccatagttttagacaacgtagcatgttcaatcgacaaatccggtgttttggtttttggtgttcatcaagatttttgctgtgttttgatttaaatcatttagtcaattgagtttgatactttctttttttggctgcattttataattaattaatgattaatattgatgtgtgggactcgtcgcatatagccatataagtctgattgaccgatggtatcatgtgttagttttatatactagacgaaaacaataattattgtcactctttgaatatactaactgattttcccg

SEQ ID NO: 1082 - DNA, 641 bp, Cucumis melo
tgtaccgccctacgacaccgatccccgccccttcagcaccaccacatccgttgcaatggcccccaagggaaagaaagtcgagcgcaaggaggagaacatctccctcggcccgcagattcgggaaggtgaactcgttttcggtgtcgcccgtatcttcgcttccttcaacgataccttcgtgcacgtcaccgatctcagtggtcgcgaaaccatcacccgtgtgactggtggcatgaaggtcaaggccgaccgtgacgagtcgtccccgtacgctgccatgttggctgctcaggacgttgcagtccgctgcaaggaggttggcatcacggctcttcacatcaagatccgtgccactggtggtaacggaactaagacccctggtcctggcgcccagtctgccctccgtgcgttggctcgctctggcatgaagattggtcgcattgaggatgttactcctaccccgtccgacagcactcgtcgcaagggtggtcgccgtggtcgtcgtttgtaatcggtttcgtacaattggggttcacggggttcttttcaacatgggttgcttttctttgtcatgtcttttcaacttcatgggctggcgtataaaaatgtgcggcttctgggaataatgacatgattcgaac

SEQ ID NO: 1083 - DNA, 778 bp, Cucumis melo
ctccttgcacgatttctgcagcggcaaattctcgtagagctccacaaaggggaagctacttcggcyatctttttcgtaaacatgtctggttcaaggaggaagaccagggagcctaaggaagagactgtgactcttggtcctgcagtgagggaaggcgagcatgtgttcggtgtggctcacatttttgcctcgtttaacgatacatttattcatgtgactgatctttctggaagggaaacycttgtcgcattacaggtggtatgaaggraaagctgatagggatgagtcctccccctacgcagctatgcttgcagcacaggatgtttcccaaagatgcaaggaactcggtattactgctcttcatattaaactgcgtgctaccggrggaaacaagaccaaaacacctggtccaggtgcccaatctgcactacgtgctcttgctcgttctgggatgaggattggacgcatagaggatgtgactccaattccaacagacagcactcgccgaaagggtggaagaagaggaagaaggctgtaagctttacttactccgggattcctactattatggctgtgtcgatggtttctctatggttctgatgctccttaagctttgcagccttagtttttcagaactccaacttggtttttaattattgttttgtcagggatgttttgtcttcgattttgttttatgttgaacttagactgtgaaagaggaatttttggctttagattaacaaatcaatacaatgccctttggtcttaattaytattg

SEQ ID NO: 1084 - DNA, 796 bp, Cucumis melo
ctcttccaccggagatttatcacgtcgagggaggttgaaggttcagacaaagtctcgaaaaccctaatctccacttgcatcttccagtttattactcgtcaccatgtcgagaaggaagactagagagcccaaggaggaaactgtcactcttggccctgctgttcgtgaaggagagcatgtctttggcgttgctcacatttttgcttcgtttaatgacacttttattcatgtaactgatctgtctggtcgggaaacacttgtccgcatcactggtggtatgaaggtgaaagctgatagggatgagtcgtccccttatgctgccatgcttgctgcacaggatgtttctcaaagatgcaaggaacttggtattactgctttgcatataaagctccgggctaccggtggaaacaaaaccaaaactcctggacctggtgctcaatcggctcttagggcccttgctcgttcaggcatgcgaattggccgcatagaggatgtaactccaatccccacagacagtactcgtagaaagggtggcagaagaggaagaaggttgtaattcctaggctccttacaaattgtcgatctcttaccatggatgtggtggcagttgaataccatagttttagaagaaaggttgctcttacttatctgctaaattgtgtgaaccttaatgttctggtaattgcttctctaccaacattttttttgccattttgattcatggaataccttcaaagacaacgagtatagttcactttttgctgcctattagacatcaacatgactcgttcgcatg

SEQ ID NO: 1085 - DNA, 801 bp, Mesostigma viride
gaagtggctgtattcagtgcagccatacaggatggcttctaagaaggtgaagcaacctaaggcagatggagaggcgaccacttccggaccccaagttcgcgagggggagcatgtctttggcgtggcgcacatctttgcgtctttcaacgacaccttcgtgcatgtgactgatctgtccggcaaggaaaccctggtccgcattacgggtggcatgaaggtcaaggccgatcgtgatgaggcctccccttacgctgccatgcttgccgctcaggatgtggctgtgaggtgcaaggagctgggcatcacggccctgcacatcaagctgcgcgccacgggtggcaacaagaccaagactcccggaccgggagcccagtctgcgctgcgcgccctggctcgctcgggcatgaagatcgggcggattgaggatgtgacccccattcccaccgacagcaccaggagaaagggtggccgccgtggtcgccgtttgtaatcgcactccagcttccctgcagcggtgctgcatggatgcatggttggcggtttcttgtcatttgattgtttgtttataaacatttctgcccatgtctgggggacaacatggtgaaataggcttgtagtgagtacctgctttgccctcttcctaataatattatatgccgacaatggttaatgaaggcaattgtccgaaacagtaatgtgtggacaacgagatgggtaccaccttcacattcacgtcgtgaataagccagtggcctttcctgagcctccattagtttgtggactcataattagcaaggatgg

SEQ ID NO: 1086 - DNA, 718 bp, Pennisetum glaucum
  misc_feature (674)..(674): n is a, c, g, or t
tcggcacgaggcgcgctagcgatcttgaaagggcggagaagcagaaggaagtgccgccggtcaggtcacttcgccgttcgcccagccatgtcgaagaggaagaccagggaacccaaggaggagactgttactcttggacccactgtccgtgaaggggagcatgtctttggagtagctcatgtttttgcatcattcaatgatacattcatccatgtcactgatttgtctgggagggagactctcgtccgtatcactggtggcatgaaggtcaaagctgaccgtgatgaatcatcaccttatgcagctatgcttgcttctcaggatgttgcacagcgttgcaaggagcttggtattactgctttgcacattaagctccgcgccacagggggcaacaagactaagacacctggacctggtgcccagtcagctctccgggcacttgctcgatctggcatgaaaatcggacgcattgaggatgtgaccccggttcccactgacagcactcgcagaaaaggtggtaggagaggaaggaggctgtagatgtcttattcttgtggatgtcaccaagaatcccctattggatagtcctactgctttaatgttctgatgaggcttcacttatgtcagtgttctgaattcatggttgtcagccaattcagcaatatgtttcgtanagaaaatttgctcacatttgggcagcaatccagtctataggtgg

SEQ ID NO: 1087 - DNA, 629 bp, Pennisetum glaucum
  misc_feature (536)..(536): n is a, c, g, or t
  misc_feature (562)..(562): n is a, c, g, or t
  misc_feature (599)..(599): n is a, c, g, or t
  misc_feature (618)..(618): n is a, c, g, or t
gcacgaggggcggcgtaggcagcagcggcgtgctcgtgatctccacagccaggcgcgctcggctccggtcacccgtcgctccacgcaaccatgtcgaggagaaagaccaggagcccaaggaggagaatgtcacccttggccccactgtccgtgaaggggagtttgtctttggcgttgctcacatctttgcatccttcaatgacaccttcattcatgtcactgatttgtctgggagggaaaccctggttcggatcactggtggcatgaaggtcaaggctgatcgtgatgaatcatcaccttatgctgctatgcttgcagctcaagatgttgcagtgcgttgcaaggagcttggaatcactgcactgcacattaagcttcgtgccactggaggcaacaagaccaagactcctgggcctggtgctcagtctgctctcagggctcttgctcgttctggcatgtaaaatcgggcgtattgaggatgttaccccggttcccactgacagcactcgcagaaagggtggtagaggggaagaggntgtagcgtcttctcctgggtatttgncatctcttggtgccagcgatcccgaaactatgtcccnctctgcgtataaaatgcgntgttgtatgcc

SEQ ID NO: 1088 - DNA, 698 bp, Nuphar advena
aaaatgtctggaagaaagaagacccgagaagttaaagaggaaaacgtcacactgggaccgaatgttcgtgagggagagcatgtgtttggggtggctcatatctttgcttccttcaatgacactttcgtgcatataacagatttgtctggaagggaaacccttgtaagaatcacaggtggtatgaaagtgaaagctgatagagatgaatcttccccctatgctgccatgcttgcagctcaagatgttgctcagcgatgcaaggagcttggcattaccgctcttcacattaagttgagagcaacaggagggaacaagaccaggactcctggacctggagcacagtcagctcttcgagctttggcacgttctggaatgaggattggccgtatagaggacgtgacgcccattcctactgatagcaccagaagaaagggtggaagaagaggaagaaggctttaaattcccactgtttatcatccagatatgttcaagttgaaggccatggaccttttagggaatccccacaaatttcctttttctttttcttttcattatattttcttaaacattgcaatgaactggtgaacttagttttgaaggggatgttttgttgatttcgtgatagcttcttgaatttttaacctactaaagacaaatgacggttaaattttggtttatttcttaatatagctttaatt

SEQ ID NO: 1089 - DNA, 707 bp, Nuphar advena
ccgagctccccaacaagagggaccaaaatgtctggaaggaagaagactcgagaagttaaggaggagaatgtgacactaggacccaatgttcgggagggtgaacatgtgtttggggtggctcatatctttgcctccttcaacgatacttttgtgcatataacagatttgtctggaagggaaactcttgtaagaatcacaggtggcatgaaagtcaaagctgacagagatgagtcctccccttatgctgccatgcttgcagctcaagatgtagctcagcgttgcaaggagcttggcattactgctcttcacattaagttaagggcaacaggtgggaacaaaaccaggactcctggacctggtgcacaatcagctcttcgagctttggctcgttctggaatgagaattggccgtatagaggacgtgacccccattcctactgatagcaccagaagaaagggtggacgaagaggaagaaggctctgaactttccactctttggttattcagatatgttcgaggtgaaggccgtggagtttatattagtgaatcccttcaattttccttttctctttctcggatacattttcctgaaaattgcaattgaaaacaattggtttatttctgaagggaagtattttctgttgtggtggtacctttttgaacctaggaaagaccatattgattgagttgagtttttgtttacttct

SEQ ID NO: 1090 - DNA, 727 bp, Nuphar advena
gttttgagggagagagagagagagagagcacgccatcgcccagtgtttccgagctctccaacaagaggaaccaaaatgtctggaaggaagaagactcgagaagttaaggaggaaaatgtgacactaggacccaatgttcgggagggtgaacatgtgtttggggttgctcatatctttgcctccttcaacgatacttttgtgcatgtaacagatttgtctggaagggaaacccttgtaagaatcacaggtggcatgaaagtcaaagctgacagagatgagtcttccccttacgctgccatgcttgcagctcaagatgtagctcagcgatgcaaggagcttggcattactgctctacacattaagttaagggcaacaggaggtaacaagaccagggctcctggacctggtgcacaatcagctcttcgagctttatctcgttctggaatgagaattgggcgtatagaggacgtgacacccattcctacagatagcaccagaagaaagggtggacgaagaggaagaaggctctgaactttccactcttttgtttttcagaaggtgaaggccgtggagtttatattagtgaatcccttcaattttcctttttctcagatacattttcctgaacattgcaaattaaaacagtgggttttatttttgaaaggaaatgtttttggttgtcgtggtggtagctttttgaacctaggaaagaccatattgattgagt

SEQ ID NO: 1091 - DNA, 728 bp, Quercus rubra
gcacactctttcatccgcacgaagcagccatgtcgaggcgaaagcaaagggagccaaaggaagaaaatgtgacccttgggcctgctactcgtgaaggagaacaagtttttggagtggctcacatttttgcatcctttaatgatacattcattcatgtaactgatctgtctggcagagagacactagttcgcatcactggtggtatgaaggtaaaggccgatagggatgagtcttcaccatatgcggctatgcttgcagcacaggatgtatcgcagagatgcaaggaacttggcatcactgctcttcatatcaagctccgtgctactggaggaaataaaaccaagacacctggtcctggtgctcagtctgcactccgggcccttgctcgttctggaatgaagattggtcgcatagaggatgtgactcccatccctagtgacagcactcgaaggaagggtggtagaagaggtagaagactgtaggctggcttcttgcgtcaaccatctcattattcaactttggtgctggttatgaagttgcttggctacatcttggaagggtattagttgaaatattttagtagtttttgaaaatggtttgacttttgcttttatatcaagcttatcaatgtagaatcagaagggtgtgagattatctatggaatttgtgttcacataaatgaattttttgacgcgatgtttccaattagtttaagattctttattgct

SEQ ID NO: 1092 - DNA, 764 bp, Quercus rubra
cgaagggccgagtctagctctcattggctctctgtactcgtagtcgcgcttgcactcacactcgcagcagccatgtctagaaggaaaactagggagcccaaggaggagaatgttaccctaggacctgctacacgtgaaggagagcaggtttttggtgtggcccatatttttgcatcgttcaatgacacattcattcatgttactgatttgtctggaagggaaacacttgttcgcattactgggggcatgaaggtgaaagctgatagggatgaatcatcaccatatgcagccatgcttgcagctcaagatgtttctcaaagatgcaaggagcttggcatcactgcactgcacataaagctgcgggctactggagggaacaagactaagactcctggtccaggtgcccagtcagcacttagagcccttgcacgttcaggcatgaaaattggtcgcatagaggatgtgaccccaattcccagtgacagtactcgcagaaagggtggcagaaggggtagaaggctgtgattccttgtcatatcagatcaagttgattcagctgctatgtttgcttggactttgttagtctaaatgcaaccatattcttgacttccttagacaacactttgtagttttgaattttgatttgtttgcatcttatcatttagttgaagcagaagagattttttctcaagttccatttaatattttaccatatgattttatgaagcaaagatcgatatgcaatatacaatttgtgttgtaac

SEQ ID NO: 1093 - DNA, 872 bp, Quercus rubra
aacgacgctgtctaaatacgtttcactcttctcctccttcctagggttttcgcagttgaaagaaccaaccgagcctcctcaaaaaccctagagctctcaatcccatcacttcgaagccatgtcgaagaggaagactagggaaccaaaagaagaaaatgtgactcttggacccgctgtcagagaaggagaacaagtttttggtgtcgcccacatttttgcatcatttaatgacaccttcatacatgtgaccgatctgtcaggaagagaaacactagttcgcattactggtgggatgaaggtgaaagctgacagagatgagtcttcaccgtatgctgccatgcttgcagcacaggatgtttctcagagatgcaaggaacttggcatcactgccttgcatatcaagctccgtgctactggtgggaacaagaccaaaacacctggtcctggggcacagtctgctctccgtgcgcttgctcgttctggaatgaaaattggacgtatagaggatgtcactccaattcctagcgacagcactcgtagaaagggtggtagaagaggaagaaggctgtgagcttgcttttcttatccagtcgggtgtttttgctcttgcaatggttgtgatttccaaatgagctttgggacattggaaattagatacaattactacccaattttgaaactaatttgtacttttctatgtgacttgcgaaagatttattttgagttgtttgaaaacaaattttataagacttggctaaaattatggcttctagcttttcttgaggcattatttaatattttatgctgttgtgtatcctgctcatgtagttttgtgccctgggtgataaaggagtggagaaagtctacagagg

SEQ ID NO: 1094 - DNA, 859 bp, Elaeis guineensis
tgaagagagagagagagaactagagttctatattttccggatcaaaacctagcacgtcccggccgccgcccccttcgtcgacacccccgccgccaccatgtctagaaggaagaccagggagcccaaagaggaaaatgtgacacttggaccaacagttcgcgaaggagagcatgtgtttggtgtggctcacatttttgcatcattcaacgatactttcattcatgttactgatttgtcggggagagaaacaatggttcgcatcactggtggcatgaaggttaaagctgacagggatgaatcatctccttatgccgccatgcttgcagcacaagatgttgctcagcggtgcaaggagttgggcattactgctctgcatattaagctgcgagccactggtgggaataagacaaagactcctggtcctggtgctcagtccgcccttagagccttggctcgttctggaatgaaaattgggcgtattgaggacgtgacccctatccccactgacagcacccgcagaaagggtgggagaagagggaggaggctgtaacttattttcacctctgtcacaaagcagccactctatcactggccagacaattcctcgtagcttttgcattcagttttgtagtttcttaatgtttatcaggctgaatgttgatttatttgatgaattcatcttggatcatcagatgatgctatcgtgatgcttttattgcgttttgttttaccatcattggaaatgccaatcacctttatgaacttgatcttaatgccgtgcttgttataagctcttgcgtttagctgtatctagcatgtatggattcagtgaagcataagcagattatgagtttgattt

SEQ ID NO: 1095 - DNA, 702 bp, Elaeis guineensis
gtgcgcgcctccttatccggcaacatttcttcagctgagccggccgggaagggcagaagcatcgactctgcgaccaccatgtcgagaagaaagaccagggagcccaaagaggagaatgtgacactgggacctaccgtacgagagggggagcatgtttttggtgttgcccatatttttgcttcttttaatgatactttcatacatgtcactgatttatccggaagagaaacaatggtccgcattactggtggtatgaaggtcaaagctgatcgtgatgaatcatctccatatgcagctatgcttgctgcacaagatgttgcacagcgatgcaaggagcttggtataactgctctacatataaaactccgtgcaactggtggaaacaagaccaagacacctggccctggtgctcaatctgcacttagagctcttgctcgatctggaatgaaaattggtcgtattgaggatgtgacaccaatcccgactgatagcacccgcagaaagggtggaagaagagggaggaggctgtagtcatctcgtatggttctttttgcgacagccatttagttttcggtagtagatttgtaatttgatgacagctgttgtttgccatccaaaggcttggataacatcggaaactttattattgtttttctaaccttatcctttgttatggtaatggagaaaattggtgtgttccat

SEQ ID NO: 1096 - DNA, 834 bp, Elaeis guineensis
aactagggttgtatttgtcccggatcaaaccctagcgtctctccgccgtagcccgcttcgctcccaccgcgaccatgtctagaaggaagaccagggagcccaaagaggaaaatgtgacacttggaccaacagtgcgagaaggagagcatgtgtttggtgtcgctcacatatttgcgtcattcaatgatactttcattcatgttactgatctatctgggagagaaacaatggttcgcatcactggtggcatgaaggttaaagctgatagggatgaatcatctccttatgcagccatgcttgcagcacaagatgttgcccagcggtgcaaggaattgggcattactgctctgcatattaagcttcgagccactggtggaaacaagacaaagactcctggtcctggtgctcagtctgcccttagagccttggctcgttctggaatgaaaattgggcgtattgaggacgtgacccccatccctacagacagcacccgcagaaagggtgggagaagagggaggaggctgtaactccttttcacctttattacagagtagcaaaagttytctgccactggctgggcrattgcttttasattttgggatcagttttgtagtttcttgatgcgratctggttgaatgatgatttakttgatgaaatcatttcggmttatcaagtgacactatcgagatatatttagacctgttgctatttgttttatcatcattggagaatctaatgaacgttatgagcttgtttaatgctgtgcttgttgccataagcagttgcatttaccatttttcagttaaagcataagcagaaggctaggttaaagg

SEQ ID NO: 1097 - DNA, 670 bp, Allium cepa
cgtagcttcacttgctcattcgctcaactggtcgtcatcatgtcaaggaagaaagttcgtgaacccaaggaggaaaatgtcactcttggacctgcagtccgtgaaggggaacatgtgtttggcgttgctcatatttttgcatcgttcaatgatactttcattcatgtgactgatttgtctggaagggaaactcttgtccgtatcacaggtgggatgaaagtcaaggctgacagagatgaatcatccccttatgctgctatgcttgctgctcaagatgtggcacagagatgcaaggaacttggaatcactgcattgcatattaagttaagggcaaccggtggtaataagactaaaacacctggtcctggtgcccaatccgctcttagggctcttgctcgttctggaatgaagattggccgcattgaggacgtgacgccaattccaactgatagtacccgcaggaagggtggaagaagaggaagaaggctttagttttttcagagtttattgcttcaaagaattcaatatcattttattccatctccgcttttgttttggttttttatctagagctgttgaatttatggacatgtatgtattgttaatgctcactagttgggctaatatttaaaagttgcattaagttgcccgtctttgtgttttctgcttt

SEQ ID NO: 1098 - DNA, 878 bp, Carica papaya
acggccagggctgacaaggttttccatcaacagagagcttaacccgctacctttctctttcatcgtctcgaagcaatgtcgaagaggaaaaccagggagcccaaggaggaaaatgttacccttggacctgctgtgcgtgagggagagcatgtttttggggtggttcacatttatgcctcattcaatgatacatttattcatgtaactgatttgtccggcagggaaacactcgttcgcatcactggtggtatgaaggtcaaagcagatagggatgaatcctcaccatatgcagccatgcttgcagcacaagacgttgcacaaagatgcaaggagcttggcatcactgctcttcatgtaaagcttcgagccactggaggcaacaagaccaagactcctggacctggagctcagtcagcacttagagcccttgctcgttcgggcatgaggattggtcgtatagaggatgtgactccaatcccgactgatagcacgcgcagaaagggtggtagaagaggaagaaggttgtgatttatcagttgcattttagctgctgttgcctgtttttgggtgatgatttatgctcttcctgagttgggtagtttggatgtaattttttcccaagcgttttgaacattgtagctttgatttgagtaacggaatgcttatatattgagttaaaagcataggacaagagatttgctgttaatttgcagtggttctaagttctaagaacttcaaggcgtgcttttagtaagaagttaggatcttaaaattttggtttcaagtcacataggtcttgggaatactcagttcttttcctattactatttatgtctggtaatttctccttcatgccgttcaattgatgatgtctaaat

SEQ ID NO: 1099 - DNA, 760 bp, Carica papaya
gtctccttattaccaaggctgttcagggtttagcgtcgacacagagctttcgaaaccctaagtcgccgctcctctcatctgttcaaagccatgtcgaagcgaaaaaccagggagcccaaggaggagaatgtcaccctcggacctgctgtgcgtgagggcgagcatgtttttggggttgttcacatctatgcatcattcaatgacacattcattcatgtaaccgacttgtctggaagggaaacacttgttcgcattactggtggtatgaaggtcaaagcggatagagatgaatcttcaccttatgctgctatgcttgcggcacaagatgttgctcaaagatgcaaggaactcggtattactgctcttcatgttaagctccgggccactggaggtaacaagactaagacacctggtccaggtgcccagtcagcacttcgagctcttgctcgttcaggcatgagaattggtcgcatagaggatgttacaccaattccgactgacagtacacgtaggaagggtggaagacggggtagaaggttgtaagctcattatacatcacaaatgccattccagccagctaccgcaccattaccagaaccttattttgtttgtttttgtctttcgatcgagcctgagtaatttcgttttccaaaacttgattatcagaacgttatagttttgaattttctagttcaatgtcggtatcactgagtttaaaacataaacgaatgacattattggaatcctcttgatcttttgc

SEQ ID NO: 1100 - DNA, 767 bp, Prunus persica
ttgggtttttatagctgacaaaagcgcaccaagagcctcctcgaaaacctagcacccaatctcatcacttcgcagccatgtcaaggaggaaggttagggaaccaaaagaagaaaacgttacgcttggtcctaccctcaaggatggagaatatgcctttggtgtggcacacatttttgcgtcatttaatgacacattcattcatgtgacagatctgtcaggaagagaaaccttggtgcgcataactggtggtatgaaggtgaaagctgacagagatgagtcttccccgtatgcagctatgcttgcagcacaggatgttgcacagagatgcaaggaactaggtattactgctcttcatatcaagctccgtgctactggtggtaacaaaaccaaaacccctggtccaggtgcccagtctgccctccgtgcccttgctcgttctggaatgagaattggtcgtatagaggatgtgactccaattcctactgatagcacccgtagaaagggcggccgaagaggaaggaggctgtaaagcttgcacttcttatctggtcagacctgtttgtcatggtggttgctggattatgggtctcagaaactaggagctgttactttcagttttgagactagcttttgactatgtggttgctaaagatttatattttcaattaatttagaaagagtttatgagactcttgaagtttttgtttgttatccgtactttgttaatgtggtctgcaatgagctatcttatggcacgtttttgcct

SEQ ID NO: 1101 - DNA, 757 bp, Arachis hypogaea
  misc_feature (736)..(736): n is a, c, g, or t
cattacggccgggggaatatcacaaacctagggtaagtgaaagctgattctcactgcgcaaccttcgagcaccaaccatgtcgaggagaaaggttagagagcccaaggaggaaaccgtcactcttggccctgctgttagagagggtgaacatgtttttggtgttgctcgcatttttgcatcattcaatgacacctttattcatgtgactgatttgtctggaagggaaacccttgtccgcatcactggtggaatgaaggttaaagctgacagagatgaatcatccccatatgctgctatgcttgcagcacaagatgttgctgctagatgcaaggagctgggcataactgctcttcatatcaagctccgtgccaccggaggaaacaagacaaaaacacctggccctggtgctcagtctgctctccgtgccttggctcgctctggaatgaaaattggccgcatagaggatgtgactccgattccttcagatagcactcgtagaaagagcggtagaaggggaagaaggctttgaagattgctatggctgcccaagccttctgtttttgtctgtgttttgaaattccgaactctattgtacttcttgacggttgacttgtttgtccaactgttttaattgagcttgtttagagtttccgtttgatgcccccgttggacagtaaaatacaaaacaaaatacatgaaattttattagactgctatttttccaagggccactantaaagaagtgggattccttgt

SEQ ID NO: 1102 - DNA, 720 bp, Arachis hypogaea
caaacaatttttcagctactcaggaactctctcaagcctcgactccaaaacctagcagcagcagcagcagcttcaaatccttcggccatcagctatgtctaggagaaaggttagagagcccaaggaagaaactgtcactcttggccctgctgttagagagggtgaacatgtttttggtgtggctcgcatctttgcatcatttaatgacacctttattcatgtgactgatttgtctggaagggaaacccttgtccgcatcaccggtggaatgaaggttaaagctgacagagatgagtcatccccatatgctgctatgcttgcagcacaagatgttgctgctagatgcaaggagctgggaataactgcccttcatatcaagctccgagccactggtggaaacaagacaaaaacacctggccctggtgctcagtctgccctccgtgccctggctcggtctggaatgaaaattggccgtatagaggatgtgaccccgattccttcagatagcactcgcagaaagagtggtagaaggggtagaaggctttaagctcactttggcttgcaggagcctcttttttgtcattttattttgttcgtattggaaaacagtagtggcatcttaaaatttagatgaagttgaatttcaattttctcatattgtactttttgacatgtcatatccgactgttttaattgagttaatttagaattatcgtgtct

SEQ ID NO: 1103 - DNA, 767 bp, Capsicum annuum
accaaatcggcttctccgtagtatccaacaccaccgtttcagcagcagtaatctcttcaccaccaacaacaacatgtcgaagaggaggactagggagccaaaggaagagactgtcactcttggaccttctgtgagagagggagagcttgtttttggtgttgctcacatttttgcgtcattcaatgacactttcattcacgtgactgatttgtctggaagggaaactatggttcgtattactggtggtatgaaggtcaaagctgatagggatgaatcttccccatatgctgctatgcttgctgcacaagatgtttcccagagatgcaaggagctgggaatcaacgcgcttcacattaagcttcgggccactggtggaaacaagaccaaaactcctggacctggtgctcagtctgctctcagggctcttgcccgttcaggaatgaaaattggtcgtatagaggatgtgactcccattcctactgatagcacccgcagaaagggtggtcggagaggaagaaggctgtaagcttgctgctcttgtcaagaagcagatgcgggttcttgttgagaatgtcgcaggtgctagttttgatatggacttgaatattgttcatctactatgtacttctattgatgttggccttgcctataaattttgcttcttttttcatggttaaatttgtgaaacaattatgagaaatatgaattgtggcctacaatcaattagctggttaagaatctacgttccatggttaaaaaagcggccg

SEQ ID NO: 1104 - DNA, 747 bp, Capsicum annuum
ttcagtagcagctcatcagcaaatcaaccgaagccatgtcgaggagaaagaccagggagcccaaggaagagactgttacccttggaccagctaccagggagggtgaattggtctttggcgttgcccacattttcgcctctttcaacgacaccttcattcacgtgactgatttgtctggacgcgaaacaatggttcgcattactggcggtatgaaggtgaaggctgacagagatgaatcttctccttatgctgctatgcttgcagcacaagatgtttctcaaagatgcaaggagcttggaattaatgctcttcacattaagctgcgggctacaggagggaacaaaaccaagactcctggtcctggtgcccagtctgctcttagagcccttgctcgatctggaatgaaaattggacgcatagaggatgtcactcctattcccaccgacagtactcgcagaaagggtggtagaagaggaaggaggctgtgaattcttctcagcaacatacacgctgcatgtcagaatattttggttaaggatgcaactttctttgtgttttacaacttagttttgaacattttgtagctagagtacaagtcattcctacttatgatcatttggagcttttgatgtcttgtgagatggaaaaatatttcgttgagttggattagtgttatctttgtggttattctcgttgagaagtgaacttttttggtgctacttccttggcaacttatgttttaagctt

SEQ ID NO: 1105 - DNA, 752 bp, Capsicum annuum
ggcacgagagtaatccctcaactttctcgctatcgaactcagctgaaaccatgtcgaggagaaagactagggagccaaaggaagagacagttacacttggaccagcaacaagggaaggtgaattggtgtttggtgttgctcacatttttgcttccttcaatgatacattcattcatgtgactgatttgtctggaagagaaactatggttcgcattactggtggaatgaaggtgaaggccgacagagatgagtcttctccatatgctgctatgcttgcagctcaagatgtgtcacagcgatgcaaggaacttggaattaatgctcttcacattaagcttcgagctactggaggcaacaaaaccaagactcctggtcctggtgcccagtctgctcttagggctttggctcgttctggcatgaaaattggacgtatagaggatgttactccgattcccaccgatagtactcgcagaaagggtggtagaagaggaaggaggctgtgaagacttctatttctacatgttgcaagttggagaatataaaatattgttgttgaggatggatgctcctttcagtatctatttacatttgatttctaattactttgtagctgagcacttttggtttcgaaccatcttcattttgagttggccttctcttcgaaatagtgaagtcttccttgaatctggaaaaattttgtactctttggttatcttacaaatctattggttatataaatcttcaatttcatc

SEQ ID NO: 1106 - DNA, 715 bp, Catharanthus roseus; identical to SEQ ID NO: 998

SEQ ID NO: 1107 - DNA, 761 bp, Catharanthus roseus; identical to SEQ ID NO: 999

SEQ ID NO: 1108 - DNA, 829 bp, Physcomitrella patens
ctctttaccagcgtcctccgttgctcttcgctctctttcgcgctctctctctctctctctctctctctctctctccctcttctgcttcgggcgtcagcaccgcttacaccatgtctggaaagaagaaagtcagagccgagaaggaggagaatgttaccctcggcccgtccgtgagggatggagagcacgtttttggtgtagcccacatctttgcgtctttcaatgatacattcgtgcatgtgactgatctctcaggaaaggagacaatcgctcgtgtcactggtggcatgaaggttaaggccgacagagatgaggcgtccccatacgcagctatgttggcagcacaggatgtagcccaaaggtgcaaggagttgggtatcaccgccctgcacatcaagcttcgtgctaccggtggaaataagactaagactcctggacctggagcccagtctgcactccgcgctttggcccgttccgggatgaggatcggacgcattgaggatgttacgcccattccaaccgacagcacgaggaggaagggtggacgcaggggacgtcgtctctagattatatgctatttcctcgaaagggaggagtatatgggcacttgtgttcgtgtcctctcttcagagttaaggatggtcagcatattgcttggatcctcttttagaatgttcgaactcagtgaatcttttgcagaaacttcaatatgcatgtaatgcattttgtttggaaagggatttaaggcatctaaggcatctttgcatatgtgtggtcaccatggttttagcttgctttatatattgttcaattaagaaatcattcgcca

SEQ ID NO: 1109 - DNA, 780 bp, Physcomitrella patens
tggacttacaacagtccatctcgcgtcctgcttacgccccttttccagcgtcctctgtcgctgcgtgcctgctcgccctttggctcctccacccttcgtagtctagcttcacctctccctccacaatgtctggaaagaagaaagtcagagccgagaaggaagagaatgtcacccttggtccatccgtgagggatggggagcacgtcttcggcgtggcccacatcttcgcctctttcaatgacaccttcgtgcatgtgactgatctttcagggaaggagactattgctcgtgtcactggtggtatgaaggttaaagcagatagagatgaagcgtcaccttacgcggctatgcttgctgctcaggatgtcgctcagcggtgcaaggagttgggaatcaccgccttgcatattaaactccgtgctaccggaggaaacaagacaaagactcccggacctggagcccagtctgcacttcgagccctggcccgttctaacatgaggattggacgcattgaggatgtaaccccaatcccaactgacagcaccaggaggaagggaggacgcaggggacgtcgtctctagatcctttattatctgctgcattgggcggtctactgggcatttatgttttatctttcctatggattctaattaggaaagatcggcatactgctttgatccagttttgatgtgttcttaattactgcaacatcgacagaaaatttgattcaaggagtacttcttgttgtgtatcttgagaatgcaagttttgattggtttc

SEQ ID NO: 1110 - DNA, 1034 bp, Pinus taeda
aacacaatgtctgcgttttttttaagcgaacactaaagcgaatgctcctcatakagaagccattttgcagctggagtgtgcgagaatagagggcgtatagttcctgttctttttcctttgatccagaagctcgcgactgcgtcaaaatgtctggcaagaaaaaggtcagggaacctaaggaggataatgtgacactagggcctactgtcagagaaggagaacaagtgtttggtgtggcacacatttttgcttcatttaatgatacatttgtgcatgtgactgatttgtctgggaaggaaacaatggctcgtgttactggtggcatgaaggttaaagctgatagagatgaatcttcaccctatgctgctatgcttgctgcacaagatgttgcacaaagatgcaaggagctgggaataactgctttgcacattaagcttcgtgccacgggaggaaataaaactaagactcctgggcctggagcacaatctgctcttcgtgctcttgctcgatctgggatgaagattggccgcatagaggacgtgactccaattccaacggacagcaccagaagaaagggtggacgacgaggaagaaggctatgatacctccttttgggtgttatttttttttggcagcttaatgcctgaaacatgagatttatagagcactatgttctcgagttaaacgtcagcacatcacatgttttggagatgtggagtacattaactcagttttgatgattagtctttttgatataaattaagctttggtattcaaacaataattagtcttgaaataaattagacgtctgtgtttgaacttcatgttctctgtgctgaaaaactgatgtgtcatggatttggtttaacatgcatcctggcatttagttctgaattatcttcaacttgattgttagccacatttagtgtgcagaaaatatagtgtgttcttgctgtcagacaattttactgggctggatcctgatttatgccgttatttttgggtcttgttctataataatttatgtttctgtg

SEQ ID NO: 1111 - DNA, 716 bp, Pinus taeda
gagagagaagacgagcggctgtcttcaaccaagcgacttgcagttttcacaggacaaccgtagccatgtctgggagaaagaaggttagagagcccaaagaggagactgttaccctaggtccyagtgttcgagaaggtgagcaagtgtttggagtggcgcacatattcgcatccttcaatgacacctttgtgcatgtgactgatctctctggaaaggaaacacttgctcgagtaactgggggtatgaaggttaaggctgacagagatgaatcttctccttatgctgctatgctagcagcacaagatgttgcacagagatgcaaggagcttggtataactgccttgcatattaagcttcgtgcaacaggagggaataaaacaaagacacctggtcctggagcacagtctgcccttcgtgctcttgcacgttctggcatgaagattggtcgtatagaggatgtgactccaatccctactgacagcactaggagaaagggtggacgaagaggaagaaggttgtagggtgcactttgggtgctccattttgaaagtgctagttttgttttatggtattattatttaggttatgcaaaacatttgttaagaaaatgcgaggtttagagggattgtcatggaatgttgaaattttgtttttactaaaatattcaactcaggaaattattgaagtaggcaatctaagcaaactactattttttg

SEQ ID NO: 1112 - DNA, 723 bp, Pinus taeda
ctcatagagaagccattttgcagctggagtgtgtgagaatacagggcttatagttcctgttctttttcctttgatccagaagctcgctactgcgtcaaaatgtctggcaagaaaaaggtcagggaacctaaggaggataatgtgacactagggcctactgtcagagaaggagaacacgtgtttggtgtggcacacatttttgcttcatttaatgatacatttgtgcatgtgactgatttgtctgggaaggaaacaatggctcgtgttactggtggcatgaaggttaaagctgatagagacgaatcttcaccctatgctgctatgcttgctgcacaagatgttgcacaaagatgcaaggagctgggaataactgctttgcacatcaagcttcgtgccactggaggaaataaaactaagactcctgggcctggagcacaatctgctcttcgtgctcttgctcgatctgggatgaagattggccgcatagaggacgtgactccaattccaacggacagcaccagaagaaagggtggacgacgaggaagaaggctatgatacctcctttttgggtgttattttttttggcagcttaatgcctgaaacatgagatttatagagcactatgttctcgagttaaacgtcagcacatcacatgttttggagatgtggagtacattaactcagttttgatgattagtctttttgatataaattaagctttgg

SEQ ID NO: 1113 - DNA, 656 bp, Pinus taeda
caaaatggctcccaagaagactaccacccgcgctccccaggagaacatctccctcggaccctccgttcgcgatggcgagctggtcttcggcgttgcccgtatcttcgcctcgttcaacgataccttcgtccacgttaccgatctgagtggccgtgagaccatcacccgtgttactggtggtatgaaggtcaaggccgaccgtgacgagtcctccccctacgctgccatgttggctgcccaggacgtcgctgcccgctgcaaggagcttggcatcaacgctcttcacatcaagatccgtgccactggtggtaacggtaccaagacccccggtcccggtgcccagtccgctctccgtgccctcgcccgtgctggcatgaagatcggccgaattgaggacgttacccctactccctccgactctacccgcagaaagggtggtcgccgtggtcgtcgtctctaagctgctcgctcatgggtggcttggatcggacaggagattcgctatctggtttctctgtggcgttgagaatcacgaggagaacggctttttcgcctggtctccagtctacactgcagagcctggtcaggttatgggttaggacgcagtagacagttatgaattcgcccgaagaaggcctatgaatcatcctgctgtc

SEQ ID NO: 1114 - DNA, 1037 bp, Pinus taeda
tatggtaatattaaagttactgttactaaactttagttaacggaaaccctaaaacctgtgtccgaaaacccatacttaatcccttgagaagctctctgttttgttctttcggaggctttgcagaatcggagatagaagacgagcggctgtcttcaaccaagcgacttgcagttttcacaggacaatcgtagccatgtctgggagaaagaaggttagagagcccaaagaggagactgttaccctaggtcctagtgttcgagacggtgagcaagtgtttggagtggcgcacatattcgcatccttcaatgacacctttgtgcatgtgactgatctctctggaaaggaaacacttgctcgagtaactgggggtatgaaggttaaggctgacagagatgaatcttctccttatgctgctatgctagcagcacaagatgttgcacagagatgcaaggagcttggtataactgccttgcatattaagcttcgtgcaacaggagggaataaaacaaagacacctggtcctggagcacagtctgcccttcgtgctcttgcacgttctggcatgaagattggtcgtatagaggatgtgactccaatccctactgacagcactaggagaaagggtggacgaagaggaagaaggttgtagggtgcattttgggtgctccattttgaaagtgctagttttgttttatggtattattatttagtttatgcaaaacatttgctaagaaaatgcgaggtttagagggattgtcatggaatgttgaaattttgtttttaaccaaaatattcaactcaggaaattattgaagtaggcaattgaagcaaattactattttttgatgcagacggcttttatatatttcatgtttgggttttgcatttcattatttgtattctatttcaatgttttatttttgagctttaggcatacatataatggtttttgtttggatatttggtatcracataacacatttgtagaaagctgccaattagtttgtttatgtagaatattaataagaagtattttt

SEQ ID NO: 1115 - DNA, 974 bp, Populus trichocarpa
ggagcaaagagaaaagcccagctcaatatgcagtcccaatatgaataaaaggaaaatccaaggaccttcaagcaaatacatatgatattgctgcgctcctaaaaccctagccactttccctcatataaagtcccctattttagccaacctccgtcgtctgttgaaacttacaagctcggccatcaaccctattagcatccttcggcttctagacctactcagcttttagccatgtcgaggagaaagacaagagagccaaaggaagagaatgttacacttggcccaactgtaagggagggagagcatgttttcggggtggctcacatttttgcttcatttaatgatacctttattcatgtgactgatttgtctgggagggaaaccctggttcgcattactggtggaatgaaggttaaagctgacagggatgaatcttcaccatatgctgctatgcttgctgcacaggatgtttcacagagatgcaaggaacttggcattactgctcttcacatcaagctccgtgctacaggaggtaacaaaactaagacccctggtccaggtgctcagtctgctctgagggcattggctcgttctggaatgaaaattggtcgcattgaggacgtcacaccaattcctactgacagcacccgcagaaagggtggaagaaggggtagaaggctgtaagctgtctcccatcatagcagttccattatgggtggtggtgctttgattgcttggtgacggttcttttcaatccgggatgtttttgtagtttttattatcctatcaggagttgttgactttgaatttatatttaagctttgtagaaacataaagatatgatggagttttgcttgtgactttgatgttctaaatgaggtcattacttgtattgaagtaatattttttttgacatgccattgcaaagatagtcatttgctcgaaattatctacaagtcatcccttgttacatt

SEQ ID NO: 1116 - DNA, 914 bp, Populus trichocarpa
atcaacctaaaattatagggcttcaatggaaactccaaaacttaaaacagtctcacgcaggagtcataccctaacccgtccacgtctcatataatcgcagccgattcactataggttctttcttttcgcatttcaccaaacacagcctccgcagaaaccaatctcaatctcacttcttcgcagccatgtcaaagagaaggactagagaaccaaaggaagaaaatgtgacccttggacccaccgtgagggaaggggagcatgcttttggggttgctcacatcttcgcatcttttaatgacacattcattcatgtgactgatctctctggaagagaaacccttgtccgcataactggtggaatgaaggtgaaagctgatagagatgaatcttcaccatatgctgccatgcttgctgcacaagatgtttcacagagatgcaaggaactcggtatcactgcccttcatattaagcttcgtgctactggtgggaacaagacaaagacacctggtccaggtgcacagtctgccctgcgtgcccttgcccgttctggaatgagaattggccgcatagaagatgttactccaattccaacggatagcactcgtagaaagggtggcagaagaggtagaaggctgtgatcttgaaggatctgattttatttggttccaaatggagacttctttctttgatatgagtaaagctactttgcagttcagaattgctgtttagattttcgccttcacctttgcagtgattcatgttgaactcatgtagaaacaagaggttgtgaagcacttgaaattttgctttggtagattatgaaatgctatgtatggtctattaatagttatctgttgtagcttcgttaaaacgaaaccttttcttcctgcaaatagcaataacatttctcggca

SEQ ID NO: 1117 - DNA, 949 bp, Populus trichocarpa
agccagaaccctaacccatccactacttcatataatcgcagccgcgttacatagcttcggtatttccttcttctaaggttttcttctcgcatttcacagcctcctcagaactaatctcaatctcgcttcttcgcagccatgtcatcaaggagaaagactagagagccaaaggaagaaaatgtgacccttggacccactgtgagggaaggggagcatgcttttggagttgctcacatctttgcatcatttaacgatacattcattcatgtgactgatctctctggaagagaaacccttgtacgcataactggtggaatgaaagtgaaagctgacagagatgagtcttcaccatatgcagccatgcttgctgcccaggatgtgtcacagagatgcaaggaacttggcattactgcccttcatattaagcttcgtgctactggtgggaacaagacaaagacacctggtccaggtgcacagtctgcccttcgtgccctttctcgttctggaatgagaattggtcgcatagaggatgtgactccaattccaacggatagcactcgtagaaagggtggtagaagagggagaaggctttaatcttgttacttcggtggactggatctgtttttattttgttccaaatggagatttgttacttggattttacttaaagttgcttcgcagtttcagaactgctgtttagattttctcattctcctttacaatgatttatgttgaacttaaaaagaggtcctcttgtgaagtagttggaatttttctttggtagatcatatgaaatgctccacagggtcttagctataaatgtctctgttaggtttgttgaaatactttcaacctgccaatagcaatagcatttctctggggcctatttctgactgtaattatggtggtggccttagatgagatgagttcccgggaaggggttattctg

SEQ ID NO: 1118 - DNA, 846 bp, Populus trichocarpa
tggccactcccctcatataaagtctcctctttgagccactccctgtcgtcctccgcaacgccgcaagcaagctcggccatcagccttttttagcatccttcggcttctgaacctaaactgccttcagtcatgtcaaagagaaggacaagagagccaaaggaagaaaatgtcactcttggcccaactgtccgggagggagagcatgttttcggggtggctcacatttttgcttcattcaatgacacattcattcatgtgactgatttgtctgggagggaaaccctagttcgcattactggtggaatgaaggttaaagctgacagggatgaatcctcaccatatgctgctatgcttgctgcacaggatgtttcacagagatgcaaggaacttggcattactgctcttcatatcaagcttcgcgctacaggagggaacaaaactaagacacctgggcctggtgcccagtctgctctgagggcattggctcgttctggaatgaaaattggtcgcattgaggatgtgacaccaattccaacagacagcacccgcagaaagggtggcagaaggggaagaaggctgtaagctgtctctcatcagagaaattccatttcggtggtgctgctttggttgcttggtgatggctcttttcaagtcaggacgtttttgtagtttttcttatcctatggaaaattgttgacttcgaattgatatttaaactttgtagaaacttaacgatatggagttttgcttgtgacttttatgctctgaatgaggtggttacttttattgaagtaatatgtttttttactgatgcacttgcaaatatagtcatttgttcttaaacga

SEQ ID NO: 1119 - DNA, 976 bp, Papaver somniferum
cagacccaacatccatttcatctattcgaagtagtagccatgtcgaggaggaaggttagagagccccccgaagagaatgttactcttggacctgctgtacgtgatggagagtttgtttttggtgttgctcacatctttgcatcattcaatgatacctttattcatgtgactgatttgtcaggaagggaaactttggttcgtattactggtggaatgaaggtcaaagctgatagagatgagtcctcaccttatgctgctatgcttgcagcccaagatgttgctgcacggtgcaaggaacttggtgttactgcattgcatatcaagcttcgtgctactggaggtaacaaaactaagacccctggacctggtgcccagtctgcattgagagcccttgctcgttctgggatgagaatcggtcgtattgaggatgtcactcctattcccaccgacagcactcgaagaaagggtggaagaagaggaaggaggttgtaggttttcagtccttcgttcagatcctgctttttcatcatctatactggtggcaatgctggttctgcgaattgggtttgagacttatctttattaattggggaactagatatgtagtttgtgtgagcagtgacttggtttagaaactgtagcaagagacgactcaagttactcatttttgatggtttcaagtttgttaatctctgttgttaccctggatatctcaatgacatttgaataggcatatttctgttttcttctcactcattatctaagagtggccgtttctgatggaatgctgcttagaatcccttcttcttccactgatattccctaccaaacttgtgaatcttctgaagaatgtttgtcctagtttctgtttataggtacctttgcactgcacatggatccctttttgttattgtctacaacaatttttcatatgatacaatgattgaagaccacttttgtgggtggaacttttcat

SEQ ID NO: 1120 - DNA, 711 bp, Papaver somniferum
tgaaggcttggagagagaagaaatctttgaacaaaccctagaagagctaatctcacttcgattatcccgtaatcatgtcgaggaggaaagttagagagccaaaagaagaaactgttacccttggacccagtgtaagagatggggagcatgtttttggtgttgcacacatttttgcatctttcaatgatacattcattcatgtcacagatttgtctggaagggaaacccttgtacgtattactggtggaatgaaggtcaaagctgatagggatgaatcttcaccatatgcagctatgcttgcagctcaggatgttgcagcccgatgcaaggaacttggagttactgcgcttcacatcaagcttcgtgcaactggtgggaacaaaacaaagacaccaggtccaggtgcccaatctgcccttagggcccttgctcggtcaggaatgagggttggtcgcattgaggatgttacccccattcctactgacagcacccgtagaaagggtggtagaagaggaaggaggctgtaagttatgtccatggtggtggttgtggaggccaaagctgcaatggctcgtcctgttggagtctgggctttcccttttttacttttggaagaacagttttgtagctttgataaatgattgacatggaacctttttcaagcgtgaaagacagaaatgtagtgattagcttacagggctgctcttttgt

SEQ ID NO: 1121 - DNA, 611 bp, Solanum tuberosum
tttcttcaagctgctgagtatctctgaactttctcactaccaagctcagccggaaccatgtcgaggagaaagaccagggagcctaaggaagagactgttacacttggaccagcaacgagggaaggtgaattggtgttcggtgttgcacacatttttgcgtcgttcaatgatacattcattcatgtcactgatttgtctggaagagaaactatggttcgcattactggtggaatgaaggtgaaggctgacagagatgagtcttctccatatgctgctatgcttgcagctcaggatgtgtcacagcgatgcaaggaacttggaattaatgctcttcacattaagctccgagctacaggaggcaacaagaccaagactcctggtcctggtgcccagtccgctcttagagctttggctcgttctggcatgaaaattggacgtatagaggatgttactccaattcctaccgatagtactcgcagaaagggtggtagaaggggaaggaggctgtgaaaactgtttcttttctgcagcatgttgcaagttggagggaaaaatattgttgtcgaaaatgcagctttcgatatctatttacattttgatttcctgaacac

SEQ ID NO: 1122 - DNA, 756 bp, Solanum tuberosum
ggtttcttcaagctgctgagtatctctgtactttctcactaccaagctcaaccggaaccatgtcgaagagaaagaccagagagcctaaggaagagactgttacacttggaccagcaacgagggaaggtgaattggtgttcggtgttgcacacatttttgcatcgttcaatgatacattcattcacgttactgatttgtctggaagagaaactatggttcgcattactggtggaatgaaggtgaaggctgacagagatgagtcttctccatatgctgctatgcttgcagctcaggatgtgtcacagcgatgcaaggaacttggaattaatgctcttcacattaagctccgagctacaggaggcaacaagaccaagactcctggtcctggtgcccagtccgctcttagagctttggctcgttctggcatgaaaattggacgtatagaggatgttactccaattcccaccgatagtactcgcagaaagggtggtagaaggggaaggaggctgtgaaaactgtttcttttctgcagcatgttgcaagttggaggaaaatattgttgtcgaaaatgcagctttcgatatctatttacatttgatttctgaacactttgtagttgagcacttttggtttcgaaaccaccttcattttgagttggtcagcttttcgagatagtgaaattctcttaaatttggtttatgtaggctgtttgttggataaatttatactgttttggtttatcttacaagtcttttt

SEQ ID NO: 1123 - DNA, 776 bp, Solanum tuberosum
caccaccattgcagctagggttcttcaagcttcagtagcagcagcagcagcagcagctcatctgcaaatcaaccttagccatgtcgaagagaaagaccagggagcccaaggaagagactgttacccttggaccagctaccagggagggtgaattggtctttggtgttgctcacattttcgcctctttcaacgacacgttcattcatgtgactgatttgtctggacgtgaaacaatggttcgcattactggtggcatgaaggtgaaggctgacagagatgaatcttctccttatgctgctatgcttgcagcacaagatgtttctcaacgatgcaaggagcttggaattaatgcccttcacattaagcttcgggctacaggtgggaacaaaactaagactcctggtcctggtgcccagtctgctcttagagcccttgctcgatccggaatgaaaattggacgcatagaggatgttactcctattcccaccgacagtactcgcagaaagggtggtagaagaggaaggaggctgtgaattcttctcagcaacatacatgctgcatggcagaatattttggttaaagatgcaactttgtttgtgttttacaacttagttttgaacattttgtagccagagtacaagtcattttgacttatgttcatttggagatttttcaatcttgtgagatggaaattatttttgttgagttggattagtaagttgactttcgtcgttatcatcattgaaaagtgaacattttttgttgcttaaaaaaaa

SEQ ID NO: 1124 - DNA, 752 bp, Solanum tuberosum
gctgaaccaaatcgccttctctgaattcaacctcctccgaattgaacaccgccgtttcagcagaagtctcatcagcaacaacaccatgtcgaagaggagaactagggagccaaaggaagagaccgtcactcttggtccttctgtgagagagggagagcttgttttcggtgtcgctcacatttttgcatcattcaatgacactttcattcacgtgactgatttgtctggacgggaaacaatggttcgtattactggtgggatgaaggtcaaagctgatagggatgaatcttccccatatgctgctatgcttgctgcacaagatgtttctcagagatgcaaggagcttggcatcaatgcacttcacatcaagcttcgagccactggtggaaacaagaccaaaacacctggacctggtgctcagtctgctctcagggctcttgctcgttcaggaatgaaaattggtcgtatagaggacgtgactccaattcctactgatagcactcgcagaaagggtggtaggagaggaagaaggctgtaagcttgctgcttttgtcaagaatcaaatgcgggttcttgttgagaatgctgcaggtgttagttttgatatggacttgaatcgtattcatctactatgtagttctactgatgttggccttgcctataaattttgcttctttttcgtggttaaatttgtgaaacaattaagagaaatatgaattttagccttctatctattagctggttgagaatct

SEQ ID NO: 1125 - DNA, 701 bp, Solanum tuberosum
gggtttcttcaagctgctgagtatctctgaactctctcactaccaagctcagccggaaccatgtcgaggagaaagaccaggagcctaaggaagagactgttacacttggaccagcaacgagggaaggtgaattggtgttcggtgttgcacacatttttgcatcgttcaatgatacattcattcacgttactgatttgtctggaagagaaactatggttcgcattactggtggaatgaaggtgaaggctgacagagatgagtcttctccatatgctgctatgcttgctgctcaggatgtgtcacagcgatgcaaggaacttggaattaatgctcttcacattaagctccgagctacaggaggcaacaagaccaagactcctggtcctggtgcccagtccgctcttagagctttggctcgttctggcatgaaaattggacgtatagaggatgttactccaattcctaccgatagtactcgcagaaagggtggtagaaggggaaggaggctgtgaaaactgtttcttttctgcagcatgttgcaagttggagaaaatattgttgtcgaaaatgcagctttcgatacctatttacatttgatttctgaacactttgtagttgagcacttttggtttcgaaaccaccttcattttgagttggccagcttttcgagatagtgaagttctcttaaatttggtttatgt

SEQ ID NO: 1126 - DNA, 1353 bp, Prunus persica
ccacgagggttttgaaagcgctgagcttgagcgccacagttgtgaataacctctaagtaatcgcctgcttgtagccatgtcgagaaggaagaccagggagcccaaggaggaaaatgtcactctcggacctgctctccgagatggagagcatgcttttggtgttgctcatatttttgcctcatttaatgatacattcattcatgtaactgacctgtctggaagggagacacttgttcgcatcactggtggtatgaaggtgaaagctgatagagatgaatcatcgccatatgcagccatgcttgcggctcaggatgtttctcaacggtgcaaggagcttggcattactgctttacatataaagctccgggctactggagggaacaagactaagactcctggtcctggtgcccaatcagcactcagagccctggctcgttctggcatgagaattggtcgtattgaggatgtgactccaattcccactgacagtactcgtagaaagggtggcagaaggggaagaaggttgtgattgcttacaattgtgtggttttagctggcgatgtggtttctgggatatttttgttttggataaaaaaaatttattatcagccttgctatcggctyggaygtagttttaaacctagttagattattgtgccrgaaaagagaactagaatttgatttggttgrcaattatcatttgagctttacacatcaaatgctgttattcacttgtttcttcaaggtttttaatcggatgctggattctatgtttwgttccttattgggctgaactggatgctattaattagaaaatagatggccactgaaataatcatgaaatctaaacactcaaggctgtcaagttttacgaaaccttaccgtgtgagaggattaaagaacaaaagggacgcttacccaaaaattctactagagcagtgttaatttcactaccttgtggttgagcaggacatacaattactaacaactagcttctcagtccaatagtaatgttagagacaaattaaattctcccatttctctctacccgttggtgtgtcgaacttgattggattgtttcaattaaattgaaaaagtgaccgagtcattgttcggtatgctagaattgttcggtatgctagaactgaacttattgtgttttataagaccttgtacgcattacattggctcattaaagtccgggggataccatgataggaataactgttaaccttatttactcatagcaaacgaaaaactgctacatgaattgttgtccaaaagtttagtgtaataaaatggtgtcactagcaatgttgatcacttgaagaaaaagaatggttctaaaaagcc

SEQ ID NO: 1127 - DNA, 790 bp, Prunus persica
ggcacgagctcgtgccgaattcggcacgaggtttttatagctgacaaaagcgcaccaagagcctcctcgaaaacctagcacccaatctcatcacttcgcagccatgtcaaggaggaaggttagggaaccaaaagaagaaaacgttacgcttggtcctaccctcaaggatggagaatatgcctttggtgtggcacacatttttgcgtcatttaatgacacattcattcatgtgacagatctgtcaggaagagaaaccttggtgcgcataactggtggtatgaaggtgaaagctgacagagatgagtcttccccgtatgcagctatgcttgcagcacaggatgttgcacagagatgcaaggaactaggtattactgctcttcatatcaagctccgtgctactggtggtaacaaaaccaaaacccctggtccaggtgcccagtctgccctccgtgcccttgctcgttctggaatgagaattggtcgtatagaggatgtgactccaattcctactgatagcacccgtagaaagggcggccgaagaggaaggaggctgtaaagcttgcacttcttatctggtcagacctgtttgtcatggtggttgctggattatgggtctcagaaactaggagctgttactttcagttttgagactagcttttgactatgtggttgctaaagatttatattttcaattaatttagaaagagtttatgagactcttgaagtttttgtttgttatccgtactttgttaatgtggtctgcaatgagctatcttatggcacgtttttg

SEQ ID NO: 1128 - DNA, 681 bp, Pseudoroegneria spicata
agcctcctcctccctcgccgccgccgcagccgccgcagccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgcattgaggatgttaccccggtcccaactgacagcactcgccggaagggtggtagaagaggaaggaggctgtaattccatgctcgttcaaggatggaacaaccaagctatcgatatcctgtgtcttgcagcttgttctgtactactccgtttatgatgttaagtcagatcttgtggatttatagattttgagcgatattgtgttgcatgtttagaaaattaccctttcccctctttgaatcaagtggttgccatctatt

SEQ ID NO: 1129 - DNA, 788 bp, Pseudoroegneria spicata
  misc_feature (10)..(10): n is a, c, g, or t
aattcccttncgcactcgtgatctcaaccaggcgcgactcctcctcctcctcgccgtcgtccccgatccaccgccgctccacgcgaccatgtcgtcgaagaggaagaccagggagcccaaggaggagaacgtcacccttggaccggctgtccgtgagggagagcatgtctttggcgttgctcacatctttgcatccttcaatgacaccttcatccatgtgactgacttgtctgggagggaaaccctggtgcggatcactggtggcatgaaggtcaaggctgatcgtgatgaatcgtcaccctatgctgctatgcttgcatctcaggatgttgctacccgttgcaaggagcttggtatcaccgcactgcacattaagctccgtgccactggaggcaacaagaccaagacacctggacctggtgctcagtctgctctcagggctcttgctcgttctgggatgaaaatcggtcgcattgaggacgtgactccagttcccactgacagcacccgccggaagggaggaaggaggggaaggaggctgtaggtcatcttccatctctactggtggcaatcaagaaacttactcctctctgggtagtcctgctgtttctatgaatgtcaagaggagctttaattttgctctgttgaggatcatttactgttagtcgtactatgaatgttgcgtggatcctatttttggttcagaaacttgtggtatttatgcgaaaaaactagctttgcagtctatggaaaccttgaaatgaagtgatttcttttgtcaaaaaaaa

SEQ ID NO: 1130 - DNA, 677 bp, Raphanus sativus
agccaaggctgaaactacagaaggaagcagagacgttactccgatcttaaacaatgtcgaggagaaagacgagagagcccaaggaggagacagtaacacttggaccagctgttcgtgatggagagcaagtcttcggtgttgtccacatcttcgcttccttcaacgacactttcattcacgttactgatctgtctggacgtgaaacccttgttcgtatcactggtggaatgaaggtgaaagctgacagggatgagtcctcaccttacgcagctatgcttgctgcacaagatgttgctcagcgatgcaaggagcttggaatcaccgctatgcacgttaagctccgtgccacgggtgggaacaagaccaagacacctggtcctggtgcccaatccgctcttagagctcttgctcgttccggcatgaaaattggccgcattgaggatgttactccgatcccaacggacagtacccgccgaaagggtggtagaagaggaaggaggctctgagtttttttttttttttggctatttagctcttgtgtttcattttgtcagaacaatgtttcttcgagttttattaaaagggatttgaagttcaagtttttttttgataatttggaacaacatttttctactatgattcatctctatggcctttgaatgacttgattagtttca

SEQ ID NO: 1131 - DNA, 768 bp, Raphanus sativus
cagagaagagcagcatcccaaaaccccttagcatttcgtctctcttcatccattgtcgaacatcatgtcgaggagaaagaccagagagcccaaggaagaaacagtcactctcggacccgctgttcgcgacggagagcaagttttcggtgttgttcacatctttgcatcattcaatgacactttcattcatgtgactgatctttccggaagagaaactctcgttcgtatcacaggtgggatgaaagtgaaggctgaccgtgatgagtcgtctccttatgctgctatgcttgctgctcaagatgttgctcagagatgcaaggagctcggcatcacagccatgcacgtgaagctcggtgccaccggaggaaacaaaaccaagactccaggtcctggtgctcagtctgctcttagagcccttgctcgttctggcatgaagattggtcgtatagaggatgtgactccgattcccactgacagtacacgtagaaagggtggacgtagaggaagaagactttgatttccccatgagagcctactcgtcattgttcggttgtcccctttgactctggttgtttattgggtacaacacttggaatttagttctgtctcgttgctatttatcttttcatgttacttgggaaacattataagctgtgtcttttcttcaatgttgtaactttttgcatttggagttttgagaatgagaagagtaacagtgactatatcacgttgtgttttgccttttatcttctctcactttatctactt

SEQ ID NO: 1132 - DNA, 860 bp, Raphanus sativus
ggctaacggaaaagttccgagtattaaagccaattttgatctcgtcggctcctccttagcaagctcaaggcggaaacacacaaagaaaccctagatccccgtcgtccttttgttcgaaatcatgtcgaggagaaagacaagagagccaaaggaagagacagtgacacttggtccagctgttcgtgacggagagcaagtctttggtgttgtccacatctttgcttctttcaacgacactttcatccatgtcactgatttgtctggacgggaaacacttgtccgtatcactggtgggatgaaggtgaaagccgacagagatgagtcctcaccttatgctgctatgcttgctgctcaagatgtcgctcagcgttgcaaggaacttggaatcacagccatgcatgtgaagcttcgtgccacaggtggtaacaagacaaagacccctggtcctggtgctcagtctgctctcagagcccttgcccgttctggcatgaaaattggtcgcattgaggatgttactccaatcccaaccgacagtacccgcagaaagggtggaagaaggggaaggaggctctgagttctttctggcgtcagccggtggatcactctatatgggtggggcttcatctttatatttagcactctctatgtgttgttttgtttagtagattgaaagagagatcctggttattatatgcgttgttgttttctcaaatctttacacatttatgttcctgttacatgaccatcaaatattcaaaagatttggttgaagtatttctcataaagcacctttgtgtaatgctggtttcaaggatagtgttgatgttttatggtaagattctttctactcaaaaaaaaaa

SEQ ID NO: 1133 - DNA, 796 bp, Raphanus sativus
gggtcactgccacagctcccacccagagaaagagcagcatcccaaaacccccttagcatttcgtctctcgtcatccattgtccaacatcatgtcgaggagaaagaccagagagcccaaggaggaaactgtcactctcggacccgctgttcgtgacggagagcaagttttcggtgttgttcacatctttgcatctttcaatgacactttcattcacgtgactgatctctcgggaagagaaactctcgttcgtatcacaggtgggatgaaggtcaaggctgaccgtgatgagtcctctccttatgctgctatgcttgctgctcaagatgttgctcaaagatgcaaggagctcggcatcacagccatgcacgtgaagctccgtgccactggaggaaacaaaaccaagactccaggtcctggtgcccagtctgctcttagagcccttgctcgttctggcatgaagattggtcgtatagaggatgtgactccaattcccaccgacagtacacgtagaaagggtggacgtagaggaagaagactttgatttccccatgagagcctactcgtcattgttctgttgttgtgctctttgactctggttgtttattgggtacacacttggaatttagttctgtctcgttacaatttatcttttcatgttacttcggaaacattattaagtggtgtctttcttcaacgttgtaacttttgcatttggagttgtgagaatgagaagagtaacagtgtgactatatcacgttgtgtttttccttttctcttctctcactttatctactt

SEQ ID NO: 1134 - DNA, 708 bp, Raphanus sativus
cttccagagacccctcatccaaaaagccctagcattttgtctcttctcatccatcggtgaacatgtcgaggagaaagaccagagagcccaaggaggaaacagtgactctcggacctgctgttcgtgacggagagcaagtgttcggtgttgttcacatctttgcttctttcaacgacactttcatccatgttactgatctgtcgggaagagaaactctcgtccgtatcaccggtgggatgaaggtgaaggctgaccgtgatgaatcctctccttatgctgctatgcttgccgctcaagatgttgctcagagatgcaaggagcttggcatcacagcaatgcacgtgaagctccgtgccactggaggaaacaaaaccaagactccaggccctggtgctcagtctgctctcagagcccttgctcgttctggcatgaagattggtcgtattgaggacgtgactccaattcccacagacagtacacgtagaaagggtggacgaagaggaagaagactctgattgtcctatgagagcctcatgatcgttcagttgttgtgccctggactcgtgtagtttcttgggtacacgctttgaagttagttttgtctctccatttcatcctgtcaagtttgctttgaaaacttgcgtctttcttgagcattgtaaaacatttatacatttggagttattttgcattttctttctttattta

SEQ ID NO: 1135 - DNA, 675 bp, Raphanus sativus
atcttagccaagcagaaactgaacaaggaagcatagacgttgctgcgatcttaaacaatgtcgaggagaaagacgagagagcccaaggaggagacagtgacacttggaccagctgttcgtgatggagagcaagtcttcggtgttgtccacatcttcgcttccttcaacgacactttcattcacgttactgatctgtctggacgtgaaacccttgtccgcatcactggtggaatgaaggtgaaagctgacagggatgagtcctcaccttacgcagctatgctdgctgcacaagatgttgctcagcgatgcaaggagcttggaatcaccgctatgcacgtgaagctccgtgccacgggtgggaacaagaccaagacacctggtcctggtgcccaatccgctcttagagctcttgctcgttccggcatgaaaattggccgcattgaggatgttactccgatcccaacggacagtacccgccgaaagggtggtaggagaggaaggaggctctgagttttttttttggctatttagctcatgtgtttcgttttatcagaacaatgtttcttcgagttttgttaaaagggatttaamgkttaaystttttggttaatttgaacaacatttttctattatgattagtctctatggcctttgccaatgacttgattagtttta

SEQ ID NO: 1136 - DNA, 690 bp, Raphanus sativus
ggctctccctcttgccaaatctctgcgtcggcggaactacaggaagaaggaagatctctcacatccttttcttgccctaaaaatgtcgaggagaaagacgagagagccaaaggaagagacagtgactcttggaccagctgttcgtgatggagagcaagtcttcggtgttgtccacatcttcgcttccttcaacgacactttcattcacgttactgatttgtctggtcgtgaaacccttgtccgtatcactggtgggatgaaggtgaaagctgacagggatgagtcctcaccttacgcagctatgcttgctgctcaagatgttgctcagcgttgcaaggagcttggaatcaccgctatgcacgtgaagctccgtgccacgggtggaaacaagaccaagacacctggtcctggtgctcagtccgctcttagagctcttgcccgttctggcatgaagattggccgcattgaggatgttactccgatcccaacggacagtacccgcagaaagggtggtagaagaggaaggaggctctgagttttcttttggttcatttgtttcagtttgtcagaccaatgtttttttttttgaattttgtgaaagagtttcgaagttgaatgctttttgttaattttgagcaacattttctgctatgattagtctggcttttgcttaggattacttcggtagtt

SEQ ID NO: 1137 - DNA, 717 bp, Raphanus sativus
ctccttagcaagctcaaggcggaaacacacaaagaaaccctagatccccgtcgtccttttgttcgaaatcatgtcgaggagaaagacaagagagccaaaggaagagacagtgacacttggtccagctgttcgtgacggagagcaagtctttggtgttgtccacatctttgcttctttcaacgacactttcatccatgtcactgatctgtctggaagagaaacacttgttcgtatcactggtgggatgaaggtgaaagccgacagagatgagtcctcaccttatgctgctatgcttgctgctcaagatgtcgctcagcgttgcaaggaactcggaatcacagccatgcatgtgaagcttcgtgccacaggtggtaacaagaccaagacccctggtcctggtgctcagtctgctctcagagcccttgcccgttctggcatgaaaattggtcgcattgaggatgtgactccaatcccaaccgacagtacccgcagaaagggtggaagaaggggaaggaggctttgagttctttctggcctcagccagtggatcactctatatgcgaggggctcatctttgtgtgttgttttgtttagtagactgaaaaagagatcttggttactatatgcgttgttgttttctcaaatctttacacatttatgttcctgttacatgaccatcaaatattcaaaagatttggttgaagtatttctcataaa

SEQ ID NO: 1138 - DNA, 640 bp, Raphanus sativus
cctcttgccaaatctctgcgtcggcggaactacaggaagaagacgatctctcacatcctttgcttgccctaaaaatgtcgaggagaaagacgagagagccaaaggaagagacagtgactcttggaccagctgttcgtgatggagagcaagtcttcggtgttgtccacatcttcgcttcctttaacgacactttcattcacgttactgatttgtctggacgtgaaacccttgtccgtatcactggtggaatgaaggtgaaagctgacagggatgagtcctcaccttacgcagctatgcttgctgctcaagatgttgctcagcgttgcaaggagcttggaatcaccgctatgcacgttaagctccgtgccacgggtggaaacaagaccaagacacctggtcctggtgctcagtccgctcttagagctcttgcccgttggcatgaagattggccgcattgaggatgttactccgatcccaacggacagtactcgcagaaagggtggtagaagaggaaggaggctctgagtttattttggctcatttgtttcagtttgtcagaccaatgttttttttttttttgaattttgtgaaagagtttcgaagttgaatactttttgttaatttgagcaacaatttctgc

SEQ ID NO: 1139 - DNA, 688 bp, Raphanus sativus
agagaacccccatccaaaaaagcccgagcattttgtctcttctcatccatcggtgaacatgtcgaggagaaagaccagagagcccaaggaggaaacagtgactctaggacctgctgttcgtgacggagagcaagtgttcggtgttgttcacatctttgcttctttcaatgacactttcattcatgttactgatctgtcgggaagagaaactctcgtccgtatcactggtgggatgaaggtgaaggctgaccgtgatgagtcctctccttatgctgctatgcttgccgctcaagatgttgctcaaagatgcaaggagcttggcatcacagcaatgcacgtgaagctccgtgccactggaggaaacaaaaccaagactccaggccctggtgctcagtctgctctcagagcccttgctcgttctggcatgaagattggtcgtattgaggacgttactccaattcccaccgacagtacacgtagaaagggtggacgaagaggaagaagactctgattgccctatgagagcctcatgatcgttcagctgttgttcccttgactcgtgtagtttcttgggtacacactttaaagttagttttgtctctccatttcatcctttgcttcgaaaacttgcgtcttttttgaacaatgtaaaacattatacatttggagttattttgcattttctttc

SEQ ID NO: 1140 - DNA, 713 bp, Raphanus sativus
cctcttcttcctctasccaagccggaaactacagaaggaagaagtgacctttgctgtgatcgatcttaacaatgtcgaggagaaagacgagagagccaaaggaggagacagtgacacttggaccagctgttcgtgatggagagcaagtcttcggtgttgtccacatcttcgcttccttcaacgacactttcattcacgttactgatctgtctggacgtgaaacccttgttcgtatcactggtgggatgaaggtgaaagctgacagggatgagtcctcaccttacgcagctatgcttgctgcacaagatgttgctcagcgatgcaaggagcttggaatcaccgctatgcacgtgaagctccgtgccactggtggaaacaagaccaagacacccggtcccggtgctcagtccgctcttagagctcttgcccgttccggcatgaaaattggccgcattgaggatgttactccgatcccaacggacagtacccgcagaaagggtggtagaagaggaaggaggctctgaacaattgtgtttcattttgtcagaacaatgtttgttgagtttagctcgtgttttgccatttaagctcgtttgtttcattttgtcagaacaatgtttcttgtgaacgaggttccaagttgaatgtttttttgttaaatttgaacaacatttatctactactagtattgaccccatgccatgcatgggacc

SEQ ID NO: 1141 - DNA, 735 bp, Raphanus sativus
tagccaaggctgaaactacagaaggaagcagagacgttactgcgatcttaaacaatgtcgaggagaaagacgagagagcccaaggaggagacagtgacacttggaccagctgttcgtgatggagagcaagtcttcggtgttgtccacatcttcgcttccttcaacgacactttcattcacgttactgatctgtctggacgtgaaacccttgtccgcatcactggtggaatgaaggtgaaagctgacagggatgagtcctcaccttacgcagctatgcttgctgcacaagatgttgctcagcgatgcaaggagcttggaatcaccgctatgcacgttaagctccgtgccacgggtgggaacaagaccaagacacctggtcctggtgcccaatccgctctcagagctcttgctcgttccggcatgaaaattggccgcattgaggatgttactccaatcccaacggacagtacccgccgaaagggtggtagaagaggaaggaggctctgagttttttttggctattcagctcatgtgtttcattttgtcagaacaatgtttcttcgagttttgttaaagggatttaaagtttaatgtttttttgttaatttgaacaatttttttctagtatggttagtatctatggcctttgcgaatgacttgattagttttactattagtttcaaaattcatcgattcatgtcttagattttatttggcaatctggctatatataat

SEQ ID NO: 1142 - DNA, 748 bp, Raphanus sativus
gggcgtctttcttgttaccactgcctaggtgctttccagagacgcgcatccacaaaccctaagcaaatcgtctcctctctctcatccatctgtgaacatgtcgaggagaaagaccagagagcccaaggaggaaaccgtcactctcggacctgctgttcgtgacggagagcaagtattcggtgttgttcacatctttgcttctttcaatgacactttcatccatgtgactgatctgtccggaagagaaactctcgtccgtatcaccggtgggatgaaggttaaggctgaccgtgatgagtcttctccttatgctgctatgcttgcagctcaagatgttgctcaaagatgcaaggagcttggcatcacagccatgcacgtgaagctccgtgccactggaggaaacaaaaccaagactccaggccctggtgctcagtctgctctcagagcccttgctcgttctggcatgaagattggtcgtattgaggatgtgactccaattcccaccgacagtacacgtagaaagggtggacgcagaggaagaagactttgatttcccaatgagattcgtcatctttcagttgtgcccttgactcttgtgagggctacacacttgcgaagttggtttttgtctctctctctccagtttatctttcaagttgcttcgtaaaaacattataagctgtctttcttcgactttgtaaacttttgcattttggagttttgggaatgaaaaaaaagtgttagtgac

SEQ ID NO: 1143 - DNA, 763 bp, Raphanus sativus
ggggggtctctttcttgttaccactgcctttctttccagagacgcgcatccacaagccctaagcaaatcgtctcctctctcatacaccggtgaacatgtcgaggagaaagaccagagagcccaaggaggaaaccgtcactctcggaccagctgttcgtgacggagagcaagtcttcggtgttgttcacatctttgcttctttcaacgacactttcattcatgtgactgatctgtccggaagagaaactctcgtccgtatcaccggtgggatgaaggttaaggctgatcgtgatgagtcttctccttatgctgctatgcttgcagctcaagatgttgctcaaagatgcaaggagcttggcatcacagccatgcacgtgaagctccgtgccactggaggaaacaaaaccaagactccaggccctggtgctcagtctgctctcagagcccttgctcgttctggcatgaagattggtcgtattgaggatgtgactccaattcccaccgacagtacacgtagaaagggtggacgcagaggaagaagactttgatttcccaccaatgagattcatcatcgttcagttgtgcccttgactcttgtgcgggcacacacttcgaagttggtttttgtctctctctctctctctctctctccagtttatcattcaagttgcttcgtaaaaacactataagctgtctttcttcgactttgtaaacttttgcattttggagttttgggaatgagaaaaagtgttagtgactaatg

SEQ ID NO: 1144 - DNA, 760 bp, Raphanus sativus
actgccacagttcagagaagagcagcatccaaaaccccttagcatttcgtctctcgtcatccattgatagacatcatgtcgaggagaaagaccagagagcccaaggaagaaacagtcactcttggacccgctgttcgcgacggggagcaagttttcggtgttgttcacatctttgcatctttcaatgacactttcatccatgtgactgatctttctggaagagaaactctcgttcgtatcacaggtgggatgaaggtcaaggctgaccgtgatgagtcatctccttatgctgctatgcttgctgctcaagatgttgctcagagatgcaaggagctcggcatcacagccatgcacgtgaagctccgtgccactggaggaaacaaaaccaagactccaggtcctggtgcccagtctgctctcagagcccttgctcgttctggcatgaagattggtcgtatagaggatgtgactccgattcccaccgacagtacacgtagaaagggtggacgtagaggaagaagactttgatttccccatgagagcctactcgtcattgttcagttgttgtgccctttgactctggttgtttattgggtaacacacttggaatttagttctttctcgttacaattcatcttttcatgttgcttcggaaacattataagtggtgtctttcttcaatgttgtaacttttgcatttggagttttgagaatcagaagaggaacagtgactatatgttttaccttttctcttccccca

SEQ ID NO: 1145 - DNA, 844 bp, Raphanus sativus
gggtcactgccacagctcccacccagagaaagagcagcatcccaaaatcccaaaaccccctagcatttcgtctctcttcatccatcgtccaacatcatgtcgaggagaaagaccagagagcccaaggaggaaaccgtcactctcggacccgccgttcgtgacggagagcaagttttcggtgttgttcacatctttgcatctttcaatgacactttcattcatgtgactgatctttctggaagagaaactctcgttcgtatcacaggtgggatgaaggtcaaggctgaccgtgacgaatcctctccttatgctgctatgcttgctgctcaagatgtcgctcaaagatgcaaggagctcggcatcacagccatgcacgtgaagctccgtgccactggaggaaacaagaccaagactccaggtcctggtgctcagtctgctcttagagcccttgctcgttctggcatgaagattggtcgtatagaggatgtgactccgattcccaccgacagtacacgtagaaagggtggacgtagaggaagaagactttgatttccccatgagagcctactcgtcattgttcagttgttgtcccttttgactctggttgtttattgggtacacacttggaattcagttctgtctcgttacaatttatcttttcatgttacttcggaaacattataagctgtgtctttcttcaatgttgcatttggagttttgagaatgagaagagtaacagtgactatatcacgttgtgttttgcttttctcttctcactttatctacttcaacctaactcaagttcctatgcttttatatatagttatgtgctgcgtttcgacca

SEQ ID NO: 1146 - DNA, 713 bp, Raphanus sativus
cgaaaccaaaaagccctagcatttcgtctcttctcatccatcggtgaacatgtcgaggagaaagaccagagagcccaaggaggaaacagtaactctcggacctgctgttcgtgacggagagcaagtgttcggtgttgttcacatctttgcttctttcaatgacactttcattcatgttactgatctgtcgggamgrgaaactctcgttcgtatcaccggtgggatgaaggtgaaggctgaccgtgatgaatcctctccttaygctgctatgcttgccgcycaagatgttgctcaaagatgcaaggagcttggcatcacagccatgcacgtgaagctccgtgccactggaggaaacaaaaccaagactccaggccctggtgctcagtctgctctcagagcccttgctcgttctggcatgaagattggtcgtattgaggacgttactccaattcccaccgacagtacacgtagaaagggtgggcgaagaggaagaagactctgattgtcctatgagagcctcatgatcgttcagctgttgtacccttgactcgtgtagtttcttgggtacacactttgaagttagttwtgtctctccatttcatcctgtcaagtttgcttcgaaaacttgtgtctttcttgagcattgtaaaacattatacatttggagttattttgcattttctttctttagttacatcatcagcttcatcgaa

SEQ ID NO: 1147 - DNA, 738 bp, Raphanus sativus
gttaccactgcctttctttccagagacgcgcatccacaagccctaagcaaatcgtctcctgtctctcatccactggtgaacatgtcgaggagaaagaccagagagcccaaggaggaaaccgtcactctcggacctgctgttcgtgacggagagcaagtcttcggtgttgttcacatctttgcttctttcaatgacactttcattcatgtgactgatctgtccggaagagaaacactcgtccgtatcaccggtgggatgaaggttaaggctgatcgtgatgagtcttctccttatgctgctatgcttgcagctcaagatgttgctcaaagatgcaaggagcttggcatcacagcaatgcacgtgaagctccgtgccactggaggaaacaaaaccaagactccaggccctggtgctcagtctgctctcagagcccttgctcgttctggcatgaagattggtcgtattgaggatgtgactccaattcccaccgacagtacacgtagaaagggtggacgcagaggaagaagactttgatttcccaccaatgagattcatcatcgttcagttgtgcccttgactcttgtgcgggcacacacttcgaagttggtttttgtctctctctctctccagtttatcattcaagttgcttcgtaaaaacactataagctgtctttcttcgactttgtaaacttaactcttgcattttggagttttggkaacgagaagaattgttagtga

SEQ ID NO: 1148 - DNA, 710 bp, Raphanus sativus
ccagagaagagcagcatcccaaaaccccttagcatttcgtctctcttcatccattgtccaacatcatgtcgaggagaaagaccagagagcccaaggaggtaacagtcactctcggacccgccgttcgcgacggagagcaagttttcggtgttgttcacatctttgcatctttcaatgacactttcattcatgtgactgatctttcgggaagagaaactctcgttcgtatcacaggtgggatgaaggtgaaggctgaccgcgatgagtcctctccttatgccgctatgcttgctgctcaagatgtcgctcagagatgtaaggagctcggcatcacagcaatgcacgtgaagctccgcgccactggaggaaacaaaaccaagactccaggtcctggtgcccagtctgctcttagagcccttgctcgttctggcatgaagattggtcgtatagaggatgtgactccgattcccaccgacagtacacgtagaaagggtggacgtagaggaagaagactttgatttccccgtgagcgcctactcgtcgtcattgttcagttgtcccctttgactctggttgtttattgggtacacacttggaattcagttctgtctcgttacaatttatcttttcatgttacttcggaaacattataagctgtgtctttcttcaatgttgcatttggagttttgagaatgagaagagtaacagtg

SEQ ID NO: 1149 - DNA, 709 bp, Raphanus sativus
cttccagagaccccccatccaaaaagccctagcattttgtctcttctcatccatcagtgaacatgtcgaggaggaagaccagagagcccaaagaggaaacagtgactctaggacctgctgttcgtgacggagagcaagtgttcggtgttgttcacatctttgcttctttcaatgacactttcattcatgttactgatctgtcgggacgagaaactctcgttcgtatcaccggtgggatgaaggtgaaggctgaccgtgatgaatcctctccttatgcagctatgcttgccgctcaagatgttgctcaaagatgcaaggagcttggcatcacagccatgcacgtaaagctccgtgccactggaggaaacaaaaccaagactccaggccctggtgcccagtcagctctcagagcccttgctcgttctggcatgaagattggtcgtattgaggacgtgactccaattcccaccgacagtacacgtagaaagggtggacgaagaggaagaagactctgattgccctatgagcctcatgatcgttcagttgtgcccttgactcgtgtagttycttgggtacacacactttgaagttagttttgtctctccatttcatcctgtcaagtttgcttcgaaaacctgagtctttcttgagcattgtaaaacattatacatttggagttattttgcattttctttctttatttacagca

SEQ ID NO: 1150 - DNA, 663 bp, Raphanus sativus
catcatgtcgaggagaaagaccagagagcccaaggaagaaacagtcactctcggacctgctgttcgtgacggagagcaagtttttggtgttgtycacatctttgcatctttcaatgacactttcattcatgtgactgatctttctggaagagaaactctcgttcgtatcacaggtgggatgaaggtcaaggctgaccgtgatgagtcwtctccttatgcygctatgcttgctgctcaagatgtygctcaragatgcaaggagctcggcatcacagcmatgcacgtgaagctccgtgccaccggaggaaacaaaaccaagactccaggtcctggtgcccagtctgctytyagagcccttgctcgttctggcatgaagattggtcgtatagaggatgtgactccaattcccaccgacagtacacgtagaaagggtggacgtagaggaagaagactttgatttccccatgagagcctactcgtcmttgttcagttgtccccttttgactctggttgtttattgggtacacacttggagtttagttctgtttcgttacattttatcttttcatgctacttcggaaacattataagctgtgtctttcttcaatgttgtaacttttgcatttggagttttgagaatgagaagagtaacagtgactatat

SEQ ID NO: 1151 - DNA, 735 bp, Raphanus sativus
cccccatccaaaaaagcccgagcattttgtcacttctcatccatcggtgaacatgtcgaggagaaagaccagagagcccaaggaggaaaccgtgactctaggacctgctgttcgtgacggagagcaagtgttcggtgttgttcacatctttgcttctttcaacgacactttcattcatgttactgatctgtctggaagagaaactctcgtccgtatcaccggtgggatgaaggtgaaggctgaccgtgatgaatcctctccttatgctgctatgcttgccgcccaagatgttgctcaaagatgcaaggagcttggcatcacagccatgcacgtgaagctacgtgccactggaggaaacaaaaccaagactccaggccctggtgctcagtctgctctcagagcccttgctcgttctggcatgaagattggtcgtattgaggacgtgactccaattcccacagacagtacacgtagaaagggtggacgaagaggaagaagactctgattgccctatgagagcctcatgatcgttcagctgttatacccttgattcgtgtagtttcttgggtacacgctttgaagttggttttgtctctccatttcatcctgtcaagtttgcttcgaaaacttgcgtctttgttgagcattgtaaaacatttatacatttggagttattttgcattttctttctttatttacatcatcagctttatcgaatgcaagtttgatcattta

SEQ ID NO: 1152 - DNA, 683 bp, Raphanus sativus
agggctctccctcttgccaaatctctgcgtcggcggaactacaggaagaaggaagatctttcacatccttttcttgccctaaaaatgtcgaggagaaagacgagagagccaaaggaagagacagtgactcttggaccagctgttcgtgatggagaacaagtcttcggtgttgtccacatcttcgcttccttcaacgacactttcattcacgttactgatttgtctggacgtgaaacccttgtccgtatcactggtggaatgaaggtgaaagctgacagggatgagtcctcaccttacgcagctatgcttgctgctcaagatgttgctcagcgttgcaaggagcttggaatcaccgctatgcacgtgaagctccgtgccacgggtggaaacaagaccaagacacctggtcctggtgctcaatccgctcttagagctcttgcccgttctggcatgaagattggccgcattgaggatgttacccccatcccaacggacagtacccgccgaaagggtggtagaagaggaaggaggctctgagttttttttttggctcatttgtttcagtttgtcagaacaatgtttgttttttcgaattttgtgaaagagtttcgaagttgaatgctttttgttaatttgatcaacattttctgctatgattagtctggcttttgctaatgattact

SEQ ID NO: 1153 - DNA, 802 bp, Oryza sativa
ctcttctctcgtgtctccggcggcggcgagctcgtgatctcaacgaccaggaggaaaccggcgctcgcctcgatctccgccgcctcgtcccaccatgtcgaagaggaagaccagggagcccaaggaggagaacgtcactcttggacccactgtccgtgaaggagagtatgtgttcggagttgcccacatcttcgcatccttcaatgacactttcattcatgtcactgacttgtctggaagggaaactcttgttcgcattactggtggcatgaaggtcaaagctgaccgtgatgagtcatcaccatatgcagctatgcttgcttctcaagatgttgcacagcgttgcaaggagcttggtattactgctctgcacatcaagcttcgtgccactggaggcaacaagacaaagacacctggtcctggtgctcaatctgctcttagggctcttgctcgctctggcatgaagattggtcgcattgaggatgtgaccccggttcccacggacagcacccgcagaaagggaggtaggagaggaaggaggctgtagatgtattgtcagccaacttgtcgccatggagcatctcttctttggatagtctcatagctcccaatgttcctgaagagagatttagttttgctcagtgtcctgaattgttgactgtcaagttaattcggctgctatgttttggttcaaggaaatttccagttttcatgcttaacaaacccaatatgtgtaccttcgtggttccttataatatggttggattgtcttatgctatctgcgcatgctttctacatgtta

SEQ ID NO: 1154 - DNA, 778 bp, Rosa hybrid cultivar
tggattcagcagcagcaggcaaggctttgcaaggagggctgtgcattcagacttgtccacccaaatcatccactcgccgccgccgccatgtcgaagaggaaggtcagagagcccaaggaggagaatgtcactcttggacctgctgtccgtgatggagagcatgtttttggtgtcgctcacatctttgcctccttcaatgataccttcattcatgtgactgatttgtctgggagggaaactctcgttcgcatcactggtggcatgaaggtcaaggctgatagggatgaatcatcaccatatgctgccatgcttgcagcacaggatgtttctactcggtgcaaggagcttggaattactgccttgcacataaagcttcgggctactggagggaacaagaccaagactcctggtccaggtgctcaatcagctcttagagcccttgctcggtctgggatgagaattggtcggattgaggatgttactccaattcccaccgacagtactcgccgaaagggtggcagaaggggtagaaggttgtgatttctcaattgtgaggattcagatgttgcagccgtttcttgcatatttttggtttcggtgtttattatcagcctcagctctggcaggaatgtagttttgttgaactcatgttagattaatatgccagatagagaactagaatttagtttggktggttgactattatcattttcagctttacacaacatgctttattgttattttataatggatttgtgttttgcttaaaaaaaaaaaa

SEQ ID NO: 1155 - DNA, 673 bp, Secale cereale
gccaaaccctacmckcstcckcctcctcctcctcccctcaccgccgccgccgccgccgccgccatgtcagggaggaagaagacccgcgagcccaaggaggagaacgtgacgctcggccccgccgtccgcgagggggagcacgtcttcggcgtcgcgcacatctttgcctccttcaacgacaccttcatccatgtcacggatctgtccgggagggagacgctcgtccgcatcactggtggcatgaaggtcaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcacttagagctcttgcacgttctggcatgaagattggacgcattgaggatgttacccctgtcccaactgacagcacccgccggaagggtggtagaaaggaaggaggctgtaattccatgctcgttcaggatggaacaataccaagctatcgatattctgtgtcttgcaacttggtctgtactactccgtttatgatgttaagtcagatcttgtggatttatagattttgagcgatattgtgttgcatgtttagaaaatgaccctttc

SEQ ID NO: 1156 - DNA, 738 bp, Carthamus tinctorius
ctgtgtgtgaccttcattcttagcgcgctacaccatcaccatactagcgaattaacgccgccgccatgtcgaagtcaagaaaggttagggagccaaaggaagacaatgtcacccttggacctgctacccgtgaaggagagcttgtatttggtgtggcacacatctttgcatcgttcaatgacacatttattcatgtgactgatatctccgggagagaaaccatggtccggattacaggtgggatgaaggtgaaggctgacagggatgaatcctctccctatgctgctatgcttgctgcacaagatgtttctcagcgatgcaaggagctcggtattaatgctcttcacataaagttgcgggctacgggaggtaacaagaccaagacacctggtccaggtgcccagtctgctctaagagcccttgctcgttctggcatgaaaattggtcgcatagaggatgttaccccgattccaactgatagcacccgtagaaagggtggtagaagaggaaggaggctgtgatctcagcaagatggattattatgctgttgttcaagttttgtttttcggtccgacagttatgagtttatggtattgttttactgttatcgtgtttctttgatggagtattattatatgaagtgaatttgcttcttttttgtcattgcacaaagactgcatgtatccctttatttacccccaacaaaatggaagtattaccatagaatgatcatgctgt

SEQ ID NO: 1157 - DNA, 695 bp, Carthamus tinctorius
cgggggcgccatcgtatcgaactctcaacaccggaggaaacaaagagaagagccacaccatgtcgaagaggaaggttagmgagccaaaggaagaaaatgttactcttgracctgctacacgtgaaggagagctagtatttggtgtggcacatatctttgcgtcattcaatgatactttcattcatgtcaccgatatatctggaagagaaacaatggttcgaattacgggtgggatgaaggtgaaagccgatagggatgaatcatctccctatgctgctatgcttgccgcacaagatgtttctcagcgatgcaaggaacttggcatcaatgccctccacataaagttgcgggcaaccggagggaataagaccaagacacctggtccaggtgctcagtccgccctcagagctcttgctcgttccggcatgaaaattggtcgcatagaggacgtgacaccaattccaacagatagcactcgtcgaaagggtggtagaaggggaaggaggctgtgattcatttgcattttcgattattattactgttttatgatgatgacctctgtaggatgcttgcgtttttggtaccaatgcccgtgacaattttctttgcaaattcgtcaactttgtgttttgatcgtcgtcattattgaatgagagaacactggtgtttcaccggatcattttcttgctaaaaaa

SEQ ID NO: 1158 - DNA, 704 bp, Carthamus tinctorius
ccaggtgccgctgcagatcgaacctctgaagacaccaattcgctttcggcagagtagcagccrtgtcgaagagaaaggttcgagagcccaaggaagaaaatgtcactcttggacctgctacccgtgaaggagagctagtatttggtgtggcacatatctttgcatccttcaatgatactttcatccatgtgactgatatctctggaagagaaaccatggttcggattactggtgggatgaaggttaaggctgatagasatgaatcatctccctatgcagctatgcttgctgcccaasatgtttcccagcgatgcaaggaacttggcmtcaatgctcttcacatcaagttgcgggcaactggagggaacaagaccaakacccctggtccaggwgccyagtctgcccttagagctcttgctcgttctggcatgaaaattggtcgcatagaggatgtgacgccaattccaacasatagcactcgccgaaagggtggtagaaggggaaggaggctgtgagtgstctgctttattcatttgcagggtttggattactactgttctatgttttaatgacttttgtaggtwatatttgtgtttctgttgacatttgatgtctgggatctttgtcmtatgyttatcgtcctttctsgatggatgtttgaatgacatgmatttttggtaactctaagaaataaaaaacaaaag

SEQ ID NO: 1159 - DNA, 682 bp, Senecio madagascariensis
ctgaattctcagcagccggagcaacttagccatgtcgaagcgaaaggttagggagccaaaggaagacaatgttactcttggaccagctactcgtgagggagagcttgtctttggtgttgcacatatctttgcgtcgtttaacgatactttcattcatgtgactgatatctctggacgagaaaccatggtccgaattacaggtgggatgaaggtgaaggccgacagggatgaatcatctccctatgcagctatgcttgcagcccaagatgtttccacacgttgcaaggagcttggcatcaatgctcttcacattaagttacgtgctactggaggtaacaagaccaagtcacctggtcctggtgcccagtcagcactcagagctcttgctcgttctggcatgaaaattggtcgcattgaggatgtgacaccaattccaactgacagtactcgacgaaagagtggtagaagaggaagaaggttgtgattcttgtctgcaaagctgcatctgcaaatgaatcatctacttctgtttgaactagttttggattataattcctagacgtttatgtttgaacctagttttgctctatgactttgtctgattattatctttttggatcgattttatatctccgaattattttgttatcacattttgtcgtgcaagtatggaattcttaag

SEQ ID NO: 1160 - DNA, 727 bp, Sorghum bicolor
cggcggcgtaggcagcggcggcgtgttcgtgatctcagccccaggcgcgctcggctccggtcacccgtcgatccacgcaaccatgtcgaggaggaagaccagggagcccaaggaggagaatgttacccttggacccactgtccgtgaaggagagtatgtctttggtgttgctcacatctttgcatccttcaatgacaccttcattcatgtcactgatttgtctgggagggaaactctggttcggatcactggtggcatgaaggtcaaagctgatcgtgatgagtcgtcgccttatgctgctatgcttgcttctcaagatgttgcacagcgttgcaaggagcttggtatcactgcgctgcacattaagcttcgtgccactggaggcaacaagaccaagacccctggacctggtgctcagtctgctctcagggcccttgctcgttctgggatgaaaattggacgcattgaggatgttaccccggttcccactgacagcactcgcagaaagggtggtaggaggggaaggaggctgtaggcgtcttctccttgctatttgccatctcctggcactggcctttgggtagtgttgcttttgctatgcttgtcaataggagcatattttgctctatgtcgaggagcaattactgttagtcgaatctatgatgtgcatggataatgttttggttgaggaattgacatttatgctaaagatgcatttttcactcta

SEQ ID NO: 1161 - DNA, 937 bp, Sorghum bicolor
gctgcggcctcgtatataaactcgcacgcactcatccgtcgcccctccgaagtttcggcggcggcgtaggcagcggcggcgtgctcgtgatctcaacccccaggcgagctcggctccggtcacccgtcgatccacgcaaccatgtcgaggaggaagaccagggagcccaaggaggagaacgttacccttggacccactgtccgtgaaggagagtatgtctttggtgttgctcacatctttgcatccttcaatgacaccttcattcatgtcactgatttgtctgggagggaaactctggttcgcatcactggtggcatgaaggtcaaggctgatcgtgatgagtcatcgccttatgctgctatgcttgcttctcaagatgttgcacagcgttgcaaggagcttggtatcactgcgctgcacattaagcttcgtgccactggaggcaacaagaccaagacccctggacctggtgctcagtccgctctcagggctcttgctcgttctgggatgaaaattggacgcattgaggatgttaccccggttcccactgacagcactcgcagaaagggtggtcggaggggtaggaggctgtaggtgtcttcgccttgctatctgccatctcttggcactgccatctgggtagtgttgctgtttctaagcttgtcaagaggagctttaattttgctctatgtcgaggatcatttaccgttagtcaaatctgtgatgtgcaattgtgcatggataatgttttggttgaggaattgacattaagctaaaaatgcattttcactctactataggacctgggattggattaatgccctgttttgatgaggtgcagctgatctttgctgtattgctttatgctgatcagaacttgctttctgattaagtttcagcgtgtcagactgtcaggttatgatagtgtgttattgtg

SEQ ID NO: 1162 - DNA, 859 bp, Sorghum bicolor
tttcggcggcggtgtaggcagcggcggcgtgttcgtgatctcagccccaggcgcgctcggctccggtcacccgtcgatccacgcaaccatgtcgaggaggaagaccagggagcccaaggaggagaacgttacacttggacccactgtccgtgaaggagagtatgtctttggtgttgctcacatctttgcatccttcaatgacaccttcattcatgtcactgatttgtctgggagggaaactctggttcggatcactggtggcatgaaggtcaaagctgatcgtgatgagtcgtcgccttatgctgctatgcttgcttctcaagatgttgcacagcgttgcaaggagcttggtatcactgcgctgcacattaagcttcgtgccactgggggcaacaagaccaagacccctggacctggtgctcagtctgctctcagggcccttgctcgttctgggatgaaaattggacgcattgaggatgttaccccggttcccactgacagcactcgcagaaagggtggtaggaggggaaggaggctgtaggcgtcttttccttgctatttgccatctcttgccactggcctctgggtagcgttgcttttgctatgcttgtcaataggagcaaattttgctctatgtcgaggatcatttactgttagtcgaatctatgatgtgcatggataatgttttggttgatgaattgacgtttatgctaaagatgcattttcactctataggaccgggcattggattaatgccctgttttgatgaggtgcagctgatttttgctgtctgatcggaacctgctttctgattacgagtttcagcgtgtcaggttatgacagtgtgttatgattgtgt

SEQ ID NO: 1163 - DNA, 888 bp, Glycine max
gagggatactcttacaaaccctaatctaatctcactttcttgttcttcttcttatttgtaacgaagcaaacgctgccgaattcgttatcgctttgcactagcagctttgaaacccggttcatccgaagcccttcaccgaaccatgtcgaggagaaaggttagagagccaaaggaggaaaatgtgactctgggtccagctgttagagatggtgaacacgtttttggcgttgctcgcatctttgcctccttcaacgacaccttcatccatgtcactgatttgtctggcagggaaacccttgtccgaatcactggtggtatgaaagttaaagctgacagagatgaatcatctccttatgctgctatgcttgcagctcaggatgttgctgccagatgcaaggaactgggcataactgctcttcatatcaagctccgtgctactggtggaaacaagaccaaaacacctggtcctggtgctcaatcagctcttcgagcccttgctcgttcaggaatgaaaattggtcgtatagaggatgttactcccattccttcggatagcacacgtagaaagagtggtagaaggggtagaagactttaaacttcctattctggagttgctatattttacttttaatgccaaagagaattgtggccttttgatgttttttaagttaatatcagaacttctattgcatttcttgaggtgttgaacagaattttagttgagtacacatttaatcattgttgtcagagattttttaaagttgagcatgttgcttcctaggtttggttgattattgttttttataattcggttctccctttcggctactcttaagcatgaatgaattataaatctattcgttgttcgtcaatgaaattatattttac

SEQ ID NO: 1164 - DNA, 918 bp, Glycine max
caaaaccctaatcccacctagatataaaaactaaacaaaacggtgccgccattcctcactctgcagcagcacctttaaacgccgaaggttcatccaatctccgaaggccttcaccggattgcaaccatgtcgaggagaaaggttagagagccaaaggaggaaaacgtgactctgggcccagctgttagagatggtgaacatgtttttggagtcgctcgcatctttgcctccttcaatgacaccttcattcatgtcactgatctgtctgggagggaaacacttgtccgcatcactggcgggatgaaggttaaagctgacagagatgaatcatctccatatgctgctatgcttgctgcgcaggatgttgctgctagatgcaaggaactgggcataactgctcttcatatcaagctccgtgccacaggtggaaacaagacaaaaacaccaggtcctggtgctcaatcagctcttcgagcccttgctcgttcaggaatgaaaattggtcgcatagaggatgtgacccccattccttccgatagcacacggagaaagagtggtagaaggggtagaaggctttaagcttcttatggtatatgactggagttgccatattttaatttccatgtcaaacaaacagatttgtgccattttgaaattttcttcaatcagaacttcttttgtatttcttgaggttttgaacagaatttagttgagtatttaggcattattgtcagagattgttgaaagttttacatgttgcttcgtggcttggaaagaattggaatacttgatagaatgtttttcgttggagataagtcaacaagacacattggagtaagttagcaatatccatacgttttcttgcatgtgatgaatgattaacagatgaagtacaaacttgtgatatttttgtgtgcg

SEQ ID NO: 1165 - DNA, 924 bp, Glycine max
gtgagtaaatgaaaaaaggtggagggcatccagcaaaaccctactccagatctgtataaaaacaaaaacgctggctttgaaaccctaataagcttcatcaatctccgaactccgaagcccttcagcaaccatgtcgaggagaaaggttagagagccaaaagaagaaaatgtgactcttggtccagccgttagagacggtgaacatgtctttggtgtcgctcgcatctttgcctccttcaacgacaccttcattcatgtcactgatttgtctgggagggaaacacttgtccgcatcactggtgggatgaaggttaaagctgatagagatgaatcatctccctatgctgctatgcttgcagcacaggatgttgctgccagatgcaaggaactgggcataactgctcttcatatcaggctccgtgccactggtggaaacaagacaaagacacctggtcctggtgctcaatcagctcttagagcccttgcacgttcaggaatgaaaattggtcgcatagaggatgtgactcccattccttccgacagcacccgtagaaagagtggaaggaggggtagaaggctttaagcttcgtatggtatacgactggagttgctatattttactttcgatgccaaagagaatggtggccttttgatgctcttcaagttaatatcagaactcttgcatttcttgaggtgttagaacagaattttagttgactgcattattgtcagatttttgaaagttgagtatgttgcttcgtggcttgcaaatgtgttaatcactactttgataaattgcgccctaggtttggttgattattgttttttataattcgcttctctctctcggctacttttaagcaatgaatgaattggaaatctaatcattgttcgtcaaatgaaattatagtttataatttgccg

SEQ ID NO: 1166 - DNA, 702 bp, Selaginella moellendorffii
gtttaggtttagggtttggcggggagctcgggcggcagcaaccatgtcgggcaagaagaggaccaaggaggtgaaagaggagaatgtgaccctgggaccgtcggtgcgcgatggcgagcaagtcttcggcgtggcgcacatcttcgcctccttcaatgacacctttgtgcacgtcaccgatctctctgggaaagaaacgctcgcccgagtcacaggtggcatgaaggtgaaagccgacagggacgaagcctctccctacgctgccatgctcgcagcccaggacgtcgctgccaaatgcaaagacttgggaatcaatgcgctccacatcaagctacgggccaccggcggtaacaaaacaaaacagcccggacccggcgcacagtctgctctgcgcgctcttgctcgttccggcatgaagatcggccgaatcgaggatgtgactccgattccaactgacagcacgaggaggaagggtggtcgtaggggtcgccgtttgtaaggagcgacttgatctctgttctgtttttccagctctgaagagtatctaaaaactcgttgaggtgtctatttggaaaagttctccttgctgcttgcctcgcatctcaacttccattttcccttctcatacttcgcaggatataaaattgttggtttgtctccgatcataaaatcgtatgcataatccagaatctgttggccatg

SEQ ID NO: 1167 - DNA, 546 bp, Selaginella moellendorffii
cggggagctcgggcggcagcaaccatgtcgggcaagaagaggaccaaggaggtgaaagaggagaatgtgaccctgggaccgtcggtgcgcgatggcgagcaagtcttcggcgtggcgcacatctttgcctccttcaatgacacctttgtgcacgtcaccgatctctctgggaaagaaacgctcgcccgagtcacaggtggcatgaaggtgaaagccgacagggacgaagcctctccctacgctgccatgctcgcagcccaggacgtcgctgccaaatgcaaagacttgggaatcaatgcgctccacatcaagctacgggccaccggcggtaacaaaacaaaacagcccggacccggcgcacagtctgctctgcgcgctcttgctcgttccggcatgaagatcggccgaatcgaggatgtgactccgattccaactgacagcacgaggaggaagggtggtcgtaggggtcgccgtttgtaaggagcgacttgatctctgttctgtttttccagctctgaagagtatctaaaaactcgttgaggtgtc

SEQ ID NO: 1168 - DNA, 1078 bp, Picea glauca
cctagtcaagtggactccaattgcacccctattcaagtcaatcaagctgtcttgcccgggaactcatctcatgtgaccacatgacttaaaacgtagggtttctagggttttgtttggaaccctccgctcacaatatttcccttttttatgcgaacactcctctcctaaagaagccattttgcagctggattgtgtgtgaagaacggccgtagagttcctgctctgtttccttggttccagaagctcgcgaccgcgtcaaaatgtctggcaagaagaaggtcagagaacccaaggaggataatgttacactagggcctactgtcagagaaggggaacaggtgtttggtgtggcacacatattcgcttcatttaatgatacttttgtgcacgtgactgatttgtctgggaaggaaacaattgctcgtgttactggtggcatgaaggttaaagctgatagggatgaatcttcaccttatgctgctatgcttgctgcacaagatgttgcacaaagatgcaaggagctgggattaactgctttgcacattaagctccgtgccacaggaggaaataagactaagactcctggacccggagcacaatctgctcttcgtgctcttgctcgatctgggatgaagattggtcgcatagaggatgtgactccaattccaacagacagcaccagaagaaagggtggacgacgaggaagaaggctatgattcctcttttttggatgttattgtcttttggcaattttatattctttgcctgaaacatgagatttatagaacactatgttctctagttaaacctcacatgttttggagatgtggagtacattacctcaatttttcatgattagtcttcttgatataaattaagcttcggtgtttaaacaatgattagtcttcttgatataaattagacttccgtttttaaacttcatcttctctgtggtgaaaaactgatgtgcgatgaatttgtttccaggtcatcaatttggtttaacatgcatcctaacatttaggttctgaattatcttcaacctgattgttagctacatttagcctgcatggaattt

SEQ ID NO: 1169 - DNA, 1011 bp, Picea glauca
ggttactaaaaatttggttaacggaaaccctaaaacctgcctccaaaacccacttgatccctttaggaagctctctgttttgccctttcggaggctttgcagaatcggagaaagagagaagacaagcggctgtcttcaacaaagcgacttgcagttctcacaggagaatcgtagccatgtctgggaggaagaaggttcgagagcccaaagaggagactgttacactaggtcctactgttcgagagaatgagcaggtgtttggagtggcgcacatattcgcatccttcaatgacacctttgtgcatgtgactgatctctctgggaaggaaacaatggcacgggtaactgggggtatgaaggttaaggctgatagagacgaatcttccccctatgctgctatgctagcagcacaggatgttgcacagagatgcaaggagcttggtataactgccttgcatattaagcttcgtgcaacaggagggaataaracaaagacgcctgggcctggagcacagtctgctcttcgtgctcttgcacgttctggcttgaagattggtcgtatagaggatgtgactccaatccccactgacagcactagaagaaagggtggacgaagaggaagaaggctgtagggtgcactttgggtgctctatctcgaaagtgctgattttgatttatggtataagaaagggtggacgaagaggaagaaggttgtagggtgcactttaaggtgctgattttgttttatggtattattattttagttattgcaggacttttgctaagaaatacaatgtttagaggggttgtcatggaatattaaaattgtttttttaaccaaaaaatccaacttttaaaaaacattgaggtaggcaaactaagcaaattactatttttggaggcagagtgggctttatatatttcatctgagttttgcatttcataatttgtattctatttcaatgttttatttttgaactttagtcataaatataatgatttttgtttggc

SEQ ID NO: 1170 - DNA, 668 bp, Picea glauca
gcaccaaatcatcaacatgccaccaaagaaggccgtccgtccagcccaggagaacatctccctcggcccaaatgtcagagagggtgaactcgtcttcggagtcgcacgtatctttgcctccttcaacgataccttcgtccacgtaaccgatctttcaggtcgcgagacaattgtccgtgtcaccggaggaatgaaggtcaaagccgatcgcgatgagtcttccccttacgccgccatgttggcagctcaagacgtcgccgttcgctgcaaggaactcggtatcaacgccctccacatcaagatccgcgctacgggtggaaatggtaccaagaccccaggtccaggagctcaatccgctcttcgtgctttggctcgttcgggtatgaagattggacgtatcgaggatgttacgccaactccttccgatagcactcgtcgtaagggtggtagacgtggtcgtcgtctatagtttctccgatatccaaacttttgtgttgtggatggagggattgtgaggatggctattatgtgtatgggatatcgcaatcaacgcggagactggtccttgatctcgcaaggagagaggccctggttctcctgctttttcgagttgtcattggggtgatgacgcggaattgcgtagcagtgatcaatgcaaataaaggcca

SEQ ID NO: 1171 - DNA, 636 bp, Picea glauca
gctaacatcagcaaaaatggcacccaaggctaagcccgcccgcgtccaggagaacgtccagttgggccctcaaacccgtgagggtgagctcgttttcggcgttgctcgcatcttcgcttccttcaacgacaccttcgtccacgttaccgatctttccggccgtgagaccatctcccgtgttactggtggtatgaaggtcaaggccgaccgtgacgagtcctccccctacgccgccatgttggctgcccaggacgtcgctgcccgctgcaaggagctcggcatcactgccctccacgtcaagatccgcgccaccggtggtaacggcaccaagacccccggccccggtgctcagtctgctctccgtgctctggcccgtgccggcatgaagatcggccgcatcgaggacgtcacccccaccccctcggactctacccgcagaaagggtggtcgccgtggtcgtcgtctgtagattcttggcgcatcttgttgtcagctatctgctctcgatgtttcaggcaagacaatggttcatggcgaaatgtggcactgtcgcgcagaacggctttatcgcctggtctgcaatatattacgcttagctcttgtcttctgaaattatggagaaaccaaaacatccta

SEQ ID NO: 1172 - DNA, 688 bp, Picea glauca
gctaatacacagccaacatgcctcccaagaagaaggtcgagcgcggtgcgcaggagaacatccagcttggtccccaggtccgcgagggcgagctcgtcttcggcgttgcccgcatcttcgcctcgttcaacgacaccttcgtccacatcaccgatctgtctggccgcgaaaccatctcgcgtgtcaccggtggcatgaaggtcaaggccgaccgtgacgagtcctccccctacgccgccatgttggctgcccaggacgtcgccgcccgctgcaaggagctcggcatctctgccctgcacgtcaagatccgcgccactggtggtaacggcaccaagacccccggccccggtgcccagtccgctctccgtgctcttgcccgcgctggcatgcgcattggacgtatcgaggacgtcacccccacaccttccgactccacacgcaggaagggtggtcgccgtggtcgccgtctctgagcatgtgcgcaaagcacgtgtttggcttggtggagcatggcatggcattaccttggtatatgcaatggcagcacgattaatggctcatgtttcatgacctcaatcacaacaaagtcgcggggaacggcaaatgcctggtctccatgttgaacttggctatttccgtagagatatgtggtagtcagggtaaagcaacagaatcctttcctgttcga

SEQ ID NO: 1173 - DNA, 539 bp, Picea glauca
gagtgtttgacagctttcaaagcaagaggctgagccatggccccgaggaaaaacaaagttgcaaaagaggaggtccaggtgaccttgggcccccagcatttggtgggtgagaccgtgtttggagtcgctcacatctttgcctccttcaacgacacattcgtgcacgttaccgacttatccggtcgggaaaccatcgccagagtgactggtggcatgaaagtgaaggccgatcgtgatgaagcttcaccctacgccgctatgttggccgctcaggatgtggctgagaaatgcaaattactaggcatcagtgccctccacatcaagctccgtgccactggtgggaacaagaccaagacccctggtcctggcgcgcagtctgccctccgtgccttggctcgctccagcatgaagatcggccgcattgaggatgtcactcccgtgccctccgactctacccgcaggaagggaggtcgacgaggacgcaggctgtaatgtgttagtttaagctcactgtcaacttttaatataaaggatgcagt

SEQ ID NO: 1174 - DNA, 634 bp, Picea glauca
gcttttcgcacctcgaatggctacagattctcttctctagtttacagctagctggatataattttcccaattaaagggtaatccttcacatattcagcaagaaacaaaatggctccaaggaaaggaaaagtacaaaaagaggaaccagtgatccaattgggaccacaagttcaagaaggagaattagtctacggcgtcgctcatatttttgcaagtttcaatgacacattcgtacatgtaaccgatttgtctggaagggaaacaattgctcgagtaactggtggcatgaaagtcaaagccgacagagatgaagcttctccttacgctgctatgttagctgctcaggatgttgccgaaaaatgcaaacttttaggtatcaccgctttgcacatcaaactgagggcaactggtggaaacaaaacaaagactcctggtccaggagcacaatctgcattgcgtgctcttgctcgttctagtatgaaaattggtagaattgaagatgtaacaccaattccatcagattgtactcgtaggaagggtggtcgcagaggtagacgtttgtaattttccaatttttgtttgtattacatattgtgtttattacgaatattaaattggctttccctttaaaaaa

SEQ ID NO: 1175 - DNA, 751 bp, Euphorbia esula
agaaattgmagtttctctctagggttttcgcatttcataatacgcgcaggctgcatctgctataacctcactttctaatttcgctctcaatctaatcttctcgcaaccatgtctagaagaaagactagagagcctaaggaagaaaatgtgacacttggtcctgcattgagggatggtgaacatgcttttggagtagctcacatctttgcctcctttaatgacacgttcatccatgtcactgatctctctggaagagaaacccttgttcgaatcaccggtggaatgaaggtgaaagctgatagggacgagtcttcaccatatgctgccatgcttcagcacaggatgtttcccagagatgcaaggaactcggaataactgctcttcatatcaagctccgtgctactggtggaaacaagacaaaaactcctggtccaggagcacagtctgccctacgtgcccttgctcgttctggaatgaaaattgggcgtatagaggatgtgactccgattccaactgatagcactcgcagaaagggtggtagaagaggtagaagactttgagcttcatggtttgttggccacctgttgcttatctgtttctttgttttatttggaaaatggaccatttacgatgatgcattacagtttttgaacaaatttctagctattattattttataatttgcatgccaaaggttaatgaactcgtgtagaatccaagattttatggaataccagttatattttgtctt

SEQ ID NO: 1176 - DNA, 641 bp, Euphorbia esula
ctttgagccatgtcgaagaggaggacaagagagcctaaggaagaaaatgtcacccttggacctgctttaagggacggagaacatgcttttggggttgcccacatctttgcgtcttttaacgacactttcattcatgtcactgatttgtctggaagagaatcattggttcgcatcactggaggaatgaaggttaaagctgacagggatgagtcttcaccttatgctgctatgcttgctgcacaagatgtttcccagagatgcaaggaactcggcattactgctcttcacatcaagcttcgtgctactggagggaacaaaaccaagacacctggaccaggtgcccagtctgcccttagggcacttgctcgttctggaatgaagattggtcgcattgaggacgtcacaccaattccaactgacagcacccgcaggaaggggggtagaaggggaagaagattgtaaaatgtttccatttcaggaaccaattcaccagttttggtgtatgtgtttgctttctactttatggtcaacttgagccaaatttgacatttttgtagttctattttcttttgccttggtattgacttttgagctttgtagaaacatattataatggatgatcaagtatgaattttgtttgc

SEQ ID NO: 1177 - DNA, 779 bp, Fragaria vesca
gcaaaggagggctgtgcattcagacttgtccacccaaatcatcaactccccgccgccgccatgtcgaagaggaaggtcagagagcccaaggaggagactgtcactcttggacctactgtccgtgatggagagcatgtttttggtgttgctcacatctttgcgtccttcaatgataccttcattcatgtgactgatttgtctgggagggaaactcttgttcgcatcactggtggcatgaaggtcaaggctgatagggatgaatcatcaccatatgctgctatgcttgcagcacaggatgtttctactcgatgcaaggagcttggaattactgctttgcacataaagcttcgggctactggagggaacaagaccaagactcctggtccaggtgctcaatccgcacttagagcccttgctcgatctgggatgagaatcggcaggattgaggatgtcactccaattcccaccgacagtactcgccgaaagggaggcagaaggggtagaaggttgtgaattctccattgcggggtttcagatgttgctgccatttcttgcatatttttggtttcgaagtttaattatcagcctcagctctggcagaactgtagttttgttgaactaatgttagattaatatgccagaaagagaactagaacttagtttggttggtcgaattctcattttcagctttacacaacaactttattggtattttatcttggatttgttatttggtattatttcatataagcataatattaaatagaatttagtcaaaa

SEQ ID NO: 1178 - DNA, 857 bp, Fragaria vesca
ctccgctttagtgttttacagaataccaaaaccgccaggagcttcctacaacctccaatagcaccgtcgcgcaaccatgtcgaagcataagaagactagggagccaaaggaagagaatgtcactcttggccctgcagtcagagatggagagcatgtctttggggttgcccacatttttgcctcgtttaatgacacattcattcatgtgactgatctctctggaagggaaactttggtccgcatcactggtggtatgaaggtgaaggccgacagggatgagtcttcgccatacgctgctatgcttgcagcacaggatgtttctacaagatgcaaggagttgggcattactgctcttcatattaagctgcgagcaactggtggcaacaaaactaagacacctggccctggtgctcagtcagcactccgtgctctggctcgttctggaatgagaattggtcgtatagaggatgtgactccaattcctactgatagcactcgtagaaagggtggtagaagaggacgaagactgtgagcttgcagttcatttctgggaacgactgtttgtgtcatgcagttggattatgagactcttaaactagcgtttctttgctgcttttgaactgatacttcctgaatatgttttgcaagagattatattcagtttctttatgaagagatgtgggattcctattgaagttttgcttcactatcaatattatgtgcttcctgacttttgcacttgatatgcttctccgacttttttcatgatgaggattgtaaatcaatatcaaagaagcaattggaaattattatggaaccatacaagcatgtatagttgggaaatgagcaaattgatg

SEQ ID NO: 1179 - DNA, 532 bp, Fragaria vesca
gcggagtccggcgaagacgcgcagcaatggcacctcgcaaggggaaggaaaagaaggaggaacaggtcatcagccttgggccgcaggtggctgagggggagaatgtcttcggtgtctgccacatcttcgcgtccttcaatgacaccttcgtccacgtcactgatctttctggcaaggaaactatctgccgagtgaccggcggcatgaaggtgaaggccgaccgagatgagtcctcgccatacgctgccatgttggccgcccaggatgtagctcagaggtgcaaggagctgggcatcaccgccctccacatcaagctccgggccacaggaggaaataggacaaagacccctggacctggggcccagtcggctctcagagcccttgcccgctcgggtatgaaaatcgggcgaattgaggatgtcacccccatcccctccgacagcacccgcaggaaggggggtcgccgtggtcgccgcctgtgaacaggactccccagattgttttctgttaataaattgccatcgtgtcagcc

SEQ ID NO: 1180 - DNA, 821 bp, Saccharum officinarum
  misc_feature (579)..(579): n is a, c, g, or t
tcgatgcctgcggcaccggtccggagttccacgccacgcgtccgggcggtgcagcaggcggcggcgtgctcgtgatcccaacccgaagcgtgcctctgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactcttgttcggatcactggtggcatgaaggtcaaggctgatcgtgatgagtcgtcgccttatgctgctatgcttgctgctcaagatgttgcacagcgttgcaaggagcttggtattactgcactgcacattaagcttcgtgccactggaggcaacaagaccaagacccctggacctggtgctcagtctgctctcagggctcttgctcgttctgggatgaaaattggacgcattgaggatgttaccccggttcccaccgacagcactcgtagaaagggtggtaggaggggaaggaggctgtangcgtctcttctgcatgctatttgccatccctttggccatcaagaagctagacctctctggggtagtgttgctgtttctatgcttgtcaagaggagctttaattttgctctatgttgatgaccatttaccgttagtctcgaatctatgatgttgcatggataatgtttttgcttgaggaattatcttgtcatatttatatgctagatatgcattttcactctatataaacgtgcattttagag

SEQ ID NO: 1181 - DNA, 722 bp, Saccharum officinarum
ccagcgcccgccgccgctgcgccctcctctcggtcccgccgtccgtcgagctgtcccctcttttgcagccgtcgtcgccatgtctgggaggaagaagacacgtgagcccaaggaagagaatgtgacgcttggccccgccgtccgtgagggcgagcatgtcttcggcgtcgcccacatcttcgcgtcattcaacgacacattcatccatgtgacggatctgtccggaagggagacgctagtccgcatcactggtggcatgaaggttaaagctgatcgtgatgagtcctcaccttatgctgctatgcttgcctcacaggatgttgcacaaagatgcaaggagcttggaattactgcattgcacattaaactccgtgctactggtggaaacaagaccaaaacccctggccctggtgctcagtctgctcttagagcccttgctcgatctggcatgaagattggccggattgaggatgttactccagttcccactgacagcactcgcagaaagggtggtaggagaggaaggaggctgtaatttcaagtcctgtcgcggtggccctgtcagatgtagcaattcaagtctgccagcgtctaawatactcctactgaggaagtttttggaactgtattgattgaaattttgaggtgtcaactcttggacgttttstrtttgtaatcgttcttgacaaattatgtggcattcaacatagcaaggcacaatt

SEQ ID NO: 1182 - DNA, 765 bp, Saccharum officinarum
gcacgaggcaccactcatccgtctcccttctgaagtttcggcgtaggcggcggcggcggtgtgctcgtgatctcagccccaggcgcgctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtaactgatttgtctgggagggaaactctggttaggatcactggtggcatgaaggtcaaggctgatcgtgatgagtcgtctccttatgctgctatgcttgctgctcaagatgttgcacagcgttgcaaggagcttggtatcactgcgctgcacatcaagcttcgtgccactggaggcaacaagaccaagacccctggacctggtgctcagtctgctctcagggctcttgctcgttctgggatgaaaattggacgcattgaggatgttaccccggttcccactgacagcactcgcagaaagggtggtaggaggggaaggaggctgtaggcgtattctccttcctatctgccatctcttggcactggcctctgggtagtgttgctgtttctaagcttatcaagaggagctttaattttgctctatgtcgaggatcatttactgttagtcgaatctatggtgtgcatggataatgttttggttgaggattgacatttatgctaaaaatgcattttcactcta

SEQ ID NO: 1183 - DNA, 676 bp, Saccharum officinarum
  misc_feature (535)..(535): n is a, c, g, or t
ggcggcgcagcaggcggcggcgtgctcgtgatcccaacccgaagcgtggctctgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactcttgttcggatcactggtggcatgaaggtcaaggctgatcgtgatgagtcgtcgccttatgctgctatgcttgctgctcaagatgttgcacagcgttgcaaggagcttggtattactgcactgcacattaagcttcgtgccactggaggcaacaagaccaagacccctggacctggtgctcagtctgctctcagggctcttgctcgttctgggatgaaaattggacgcattgaggatgttaccccggttcccaccgacagcactcgtaaaaagggtggtaggaggggaaagaggctgtangcgtctcttctgcatgctatttgccatccctttggccatcaagaaactaagactctctggggtagtgttgctggttctattgctggcaagaggagctttaattttgctctatgttgatgaccatttaccggtagtctcgaa

SEQ ID NO: 1184 - DNA, 713 bp, Saccharum officinarum
gcggtgcagcaggcggcggcgtgctcgtgatcccaacccgaagcgtgcctctgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactcttgttcggatcactggtggcatgaaggtcaaggctgatcgtgatgagtcgtcgccttatgctgctatgcttgctgctcaagatgttgcacagcgttgcaaggagcttggtattactgcactgcacattaagcttcgtgccactggaggcaacaagaccaagacccctggacctggtgctcagtctgctctcagggctcttgctcgttctgggatgaaaattggacgcattgaggatgttaccccggttcccactgacagcactcgtaraaagggtggtaggagggraaggaggctgtaagcgtctyttctgcacgctatttgccatccctttggccatcgagaagctagacctctctggggtagtgttgctkkttctatgcttgtcaagaagaactttaaattttgctctatgttgatgaccatttaaccgtagtcttcaatctatgaatgtgcatggataatatttttggctggagg

SEQ ID NO: 1185 - DNA, 1200 bp, Saccharum officinarum
  misc_feature (783)..(783): n is a, c, g, or t
  misc_feature (852)..(852): n is a, c, g, or t
  misc_feature (1167)..(1167): n is a, c, g, or t
gcagcatctcctctccagcgcccgccgccgctgcgccctcctctcggtcccgccgtccgtcgagccgtcccctcttttgcagccgtcgccgccatgtctgggaggaagaagacgcgtgagcccaaggaggagaacgtgacgcttggccccgccgtccgcgagggcgagcatgtcttcggcgtcgcccacatcttcgcgtcattcaatgacacattcatccatgtgacagatctgtccggaagggagacgctagtccgcatcactggtggcatgaaggttaaagctgatcgtgatgagtcctcaccttatgctgctatgcttgcctcacaggatgttgcacaaagatgcaaggagcttggaattactgcattgcacattaaactccgtgctactggtggaaacaagaccaaaacccctggccctggtgctcagtctgcccttagagcccttgctcgatctggcatgaagattggccgtattgaggatgttactccagtccccactgacagcactcgcagaaagggtggtaggagaggaaggaggctgtaatttcaagtcctgtcgcggtggccctgtcagatgtagcaattcaagtctgccagcgtctaatatactcctaccgaggaagtttttgggaactgtattgattgaaattttgaggtgtcaactcttggacgttttctgkttgtaatcgktcttgacaaattatgtggcattcaacatagcaaggsacawttgcaagaggccccmcttttttttaaaaaaacaaaagaaaatcatatnatattatatacatcataatataactcacttcttttaatcttttaatatttactctcttttaaaaatacncgttttcctcactacacagttgtcctcactatacccgctgcttcttcctctgctcccgcgatattttttatgggggggcgcctccttataaatgaatccacttttttatccaccgccggtgccttccccacgtataaaatctctctttatttggtcccacactgatatataccttatgtcgggcgccggttttatatacatggcttgaagtggggaaagaaccctgtgtggtgcttccacacacctattatcctcttcgtacaaagaacaccccccttttcatctcatggtgtgtgtatataagccaagaaagcncccaccccaacattcgcctcctccctcaacagg

SEQ ID NO: 1186 - DNA, 722 bp, Saccharum officinarum
ggtcacccgttcgctccaaggcaacacatttggagaaggaagaccmgggagcccaaggaggagacgtcmacccttggacccmctgtccgtgaaggagagtatgttttggtgtggctcacatctttgcatccttcaatgacaccytcattcatatcactgatttgtctgggagggaaactctggttcggatcactggtggcatgaaggtcaaggctgatcgtgatgagtcgtcgccttatgctgctatgcttgctgctcaagatgttgcacagcgttgcaaggagcttggtattactgcactgcacattaagcttcgtgccactggaggcaacaagaccaagacccctggacctggtgctcagtctgctctcagggctcttgctcgttctgggatgaaaattggacgcattgaggatgttaccccggttcccactgacagcactcgtagaaagggtggtaggaggggaaggaggctgtaggcgtctcttctgcatgctatttgccatccctttggccatcaagaagctagacctctctggggtagtgttgctgtttctatgcttgtcaagaggagctttaattttgctctatgttgatgaccatttaccgttagtctcgaatctatgatgttgcatggataatgtttttgcttgaggaattatcttgtcatatttatatgctagatatgcattttcactctatataaacgtgtattttagagt

SEQ ID NO: 1187 - DNA, 719 bp, Helianthus annuus
cgggggmstgcctgcctgccgctacctgcaatcagccagccggactaagaagaagaagaagaagaaaagagaagtcacgccatgtcgaagagaaaggttagagagccaaaggaagacaatgtcactctcggtcctgctacccgtgaaggagagcttgtatttggggttgcacatatctttgcctcattcaatgataccttcattcatgtgactgatctctctgggagagaaaccatggttcggattactggtggaatgaaggtaaaggctgatagagatgagtcgtctccatatgcagctatgcttgctgcacaagatgtttcaacaagatgcaaggagcttggaatcaatgccctccacataaaactacgggcaactggaggtaacaagacaaagacacccggtccaggtgcacagtctgccctcagagctcttgcccgttctggcatgaagattggtcgcattgaggacgtgacaccaattccaacagatagcactcgtcgaaagagtgggagaagaggaaggaggctgtgatatgttttttgtctacagtatgttttcaaagtatytgcaatttggatttttgttgtcttcaacttttgtaggttatttttatgttctggttgacatttgggggtgacatgcatttttgttgaactgctttatatttctgtttaatgatattctattatttacttcatatatgggttttatgcttt

SEQ ID NO: 1188 - DNA, 792 bp, Helianthus annuus
gcggggtcttcctcatcccctctccacattttgcaggaagaaccacgccgacctgatttcttagctccacaaagccgccatgtcgaagaggaagacccgagagccgaaggaagacaacgtcactcttggacctgccacccgtgagggagaacttgtgtttggtgttgcacatatctttgcatctttcaatgacacattcattcatgtgactgatctctctggaagagaaaccatggttcgtattacaggtgggatgaaggtgaaggctgacagggatgaatcttcaccctatgctgctatgcttgctgcacaagatgtgtcccagcgttgcaaggagcttggtatcaatgctcttcacataaagctgcgggctactggaggtaacaagaccaagacacctggcccgggtgcccagtcagccctcagagctcttgctcgttctggcatgaagattggccgcatagaggatgttaccccaattccaactgacagcaccaggcgaaagagtggtagaagaggaaggaggctgtgatctgattatattctgctgcatttccaaatgtggtattatgttggatcaagtttgttttttggtcgacaatttacttgctttatgatgttttttatagaccatttttatttctagtgttggattgaaaagaatggttgttttgattgccggttatgatcggtctcttgacagtcatctaaaaacttgttttaagataagtttcattttggatttaatggttttggtaacgatactggtgggcttgggccttggtgtttgca

SEQ ID NO: 1189 - DNA, 706 bp, Helianthus annuus
ggaccaaagaagaagaaaaagcagcagcagcagcagcagctactccagccgactacagccatgtcaaagagaaaggttagagagccaaaggaagacaatgtcaccctcggacctgctactcgtgagggagagcttgtttttggtgtggcgcatatttttgcatccttcaatgatactttcattcatgtgactgatctctctggaagagaaaccatggttcggattactggtgggatgaaggtgaaggctgatagagatgaatcatctccgtatgcagctatgcttgcagcacaagatgtttcaacaagatgcaaggagcttggcatcaatgctcttcacattaagttgcgggccactggaggaaacaagaccaagacccctggtccaggtgctcagtctgcactcagagctcttgctcgttctgggatgaaaattggtcgcattgaggatgtgacaccaattccaactgatagcacccgtcgaaagagcggtagaagaggaagaaggctgtgatctgtttggtctagtatattatgtttttgcagcgtgtttgcattttggatgaacgtttctcggtgttatgacaacttttgtaggttgtttgattgacaattgatgttctatttatgcaattttggattttgttaaacagagtttctgcacttaaatgatctattctaccttgttgcgagtatgctttttgatt

SEQ ID NO: 1190 - DNA, 558 bp, Helianthus annuus
gtttccggtcgcccactgtaagcacgtaaaggattcaccatggcccccaggaaagggaaggttcagcaagagcaggtgcaggtccacctgggccctcaagtgcgcgaaggcgaaattgtgtttggtgtggcacacatctttgccagcttcaacgacactttcgtccatgtcactgatctgtccggaagggaaaccatcgcccgagtcactggtggcatgaaagtcaaggctgaccgtgatgaggcttcaccctacgctgctatgttggccgctcaggatgttgctgagaagtgcaagacccttggcatcactgctctccacatcaagttgcgtgccactggtggcaacaagaccaagacccctggtcccggtgcccagtctgctctgcgagctcttgctcgttcatccatgaaaattggccgtattgaagatgttactcccattcccacagacgccaccaggaggaagggaggacgacgtggtcgcagattgtaggcgatatgttttgtcaataaattaagttttccctacttgggagggcaattttccttgtctacg

SEQ ID NO: 1191 - DNA, 832 bp, Panicum virgatum
gcggcggcgtaggcagcggcggcgtgctcgtgatctcaacaccaggcgctcggctccggtcacccgtcgctccaagcaaccatgtcgaggaggaagaccagggagcccaaggaggagaatgtcacccttggccccactgtccgcgaaggagagtttgtctttggagttgctcacatctttgcatccttcaacgataccttcattcatgttactgatttgtctgggagggaaactctggttcggatcactggtggcatgaaggtcaaggctgatcgtgatgaatcgtcaccttatgctgctatgcttgcagctcaagatgttgcagctcgttgcaaggagcttggtatcactgcactgcacattaagcttcgtgcgaccggaggcaacaaaaccaagactcctgggcctggtgctcagtctgctctcagggctcttgctcgttctggcatgaaaattgggcgcattgaggatgttaccccagttcccactgacagcactcgcagaaagggtggtaggaggggaaggaggttgtaggcgtcttctcctggcaatttgccatctcgtggctcaggccatgaagaaactagtcctttctgggtagtgttgcaatttgccatctcgtggctcaggccatgaagaaactagtcctctctgggtagtgttgctgtttctatgcttgtcaagaggagctttaattttgctctatgttgaggatcatttaccgttagttgaacctgtgatgttgcatggatgatattttggttgaggaattgacttgtcatatttatgctaaaacatgtgttttcactctagaacctacctgttggatggc

SEQ ID NO: 1192 - DNA, 759 bp, Panicum virgatum
gccgccgtcgtcctccctagcgaaccctaatcgttcctcttcctcgcacgccgccgacgccatgtccgggaggaagaagactcgggagcccaaggaggagaacgtgacgctcggccccgccgtccgcgagggggagtacgtcttcggcgtcgcccacatcttcgcctccttcaacgacaccttcatccatgtgacggatctgtctgggagggaaacgctcgtccgcatcactggtggcatgaaggttaaagctgatcgtgatgagtcatcaccgtatgctgctatgcttgcctcacaggatgttgctcaaagatgcaaggagcttgggattactgctctgcacattaagctccgtgctactggtggaaacaagaccaaaagtccaggtcctggtgctcagtctgcccttagagctctcgctcgatctggcatgaagattggtcgtattgaggatgtcaccccagtcccaactgacagcacacgcagaaagggtggcagaaggggaaggaggctgtaatttcaagtatattgactggtgtttccagatgtagcagttctagactgttttcatctcatatactgcgcaagttttgcaacatgtattgaagttttgaggtgtctactcgtggacatgttttgtttaatacttgttgacgaagtatgtgccattcaacgtagcaagacaattacaggagctcccacttctgataatttatttgcttgttcccttgataaatagatgcaaaagtgatttcagtt

SEQ ID NO: 1193 - DNA, 720 bp, Panicum virgatum
cgcgctagcgatcttgagaggggcggaagcagaaggacgcgccggtcacatcgcttcgcccccgccatgtcgaagaggaagaccagggagcccaaggaggagactgtaactcttggacccactgtccgtgaaggggagcatgtcttcggagtagctcatgtctttgcatccttcaatgacacattcatccatgtcactgatttgtctgggagggagacacttgttcgtatcactggtggcatgaaggtcaaagctgatcgtgacgaatcatctccatatgccgctatgcttgcttctcaggatgtggcccagcgttgcaaggagcttggtattactgctttgcacattaagctccgcgccactgggggcaacaagaccaagacacctggacctggtgctcagtctgctctcagggcactcgctcgatctggcatgaaaatcggacgcattgaggatgtgaccccggttcccactgacagcactcgcagaaagggtggcaggagaggaaggaggctgtagatgtttttttttcctgtcatttttgtggagaatcctctatttaaatattcttatatagcttaaatgttccggtgaagcttgggttttgttttgctcagtgttctggattattgactgtctgccaatttggcgattcttttggttaagaaaattttgctcacaatcaatctcaagtctattaattatgctttcgtttgtttt

SEQ ID NO: 1194 - DNA, 814 bp, Panicum virgatum
ttctcccctctgaagtttcggcggcggcgtaggcagcggcggcgtgctcgtgatctcaacaccaggcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctggttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcctggtgctcagtctgctcttagggctcttgctcgttctggcatgaaaattgggcgcattgaggatgttaccccagttcccactgacagcactcgcagaaagggtggtaggaggggaaggaggctgtaggcgtcttctcctggctatttgccatatcatggcgcaggccatgaagaaactagtcctctctgggtagtgttgctgttcctatgcttgtcaagagagctttaattttgctctatgttgaggatcatttaccgttagtcgaacctgtgatgttgcatggatgatgttttggttgaggaattgacttgtcatatttatgctaaaaaaacatgtgttttcactctagaactttgtgttagtaatgtacctgttggatggcatgc

SEQ ID NO: 1195 - DNA, 644 bp, Panicum virgatum
agagattgaaatcattctcggttgatcatcaagaaaaagaattcaaataaaaaatgggtccacgtaaaggtcaaactcaacctaaacaagaacaagttagcttaggtccccaaatagctgaaggagaacttaattttggtgttgctcatatctatgctagttttaatgatacttttgttcatgtcactgatctttccggaaaagaaacaatagctcgtgtaactggtggaatgaaagtcaaagctgatcgtgatgaagcttcaccatatgctgctatgttagctgcacaagatgttgctgaacgttgtagaggtttaggtattactgctttacacgttcgtcttcgtgcaactggtggaaataaaaccaaaacacctggacctggtgcacaatctgctcttcgtgctcttgctcgatcaggaatcaaaattggaagaattgaagatgtaacaccagttccatcagatagtacacgacgaaaggtggtcgacgtggtcgtcgtttataaaccatcaacaatacatcaacacaacacacaaattcgttctttatattcaacaaattgtttttgtgtgtattcaacgttgttttcaatttcgttttttcttattcatttgtcatctttatgaataacaataaatgag

SEQ ID NO: 1196 - DNA, 873 bp, Panicum virgatum
ctagggtttgccgccgcctcctcgccgccgcctccccagcgaaccctaatcgttctcctcgcccgccaccgccgccgcggtcatgtccgggaggaggaagacgcgggagcccaaggaggagaacgtgacgctcggccccgccgtccgcgagggggagtatgtcttcggcgttgcccacatcttcgcctccttcaacgacaccttcatccatgtgacggatctgtctgggagggaaacgctcgtccgcatcactggtggcatgaaggttaaagctgatcgtgatgagtcatcaccttatgctgctatgcttgcctcacaggatgttgctcaaagatgcaaggagcttgggattactgctctgcacattaagctccgtgctactggtggaaacaagaccaaaactccaggtcctggtgctcagtctgcccttagagctcttgctcgatctggtatgaagattggtcgtattgaggatgtcacccctgtcccaactgacagcacacgcagaaagggtggcagaaggggaaggaggctgtaatttcaagtatattggctggtgtatccagatgtagcagttctagactgttttcatcttacactgagcaagttttgcaacatgtattgaagttttgagttgtcaactcgtggatccgtttcagtttaatccttgttgacgaagtatgtgccattcaacgtagcgagatacaattcaggagctcccacttctgcttgttggctcgataaatagttgcaaaagtgatttcagttaatattctcctgaaatgccttggctgtcttttgccagtggttttcttcatgtcgaattgtatgctaagaggataattagtgaaaaggcaaatagcaattcgtgtt

SEQ ID NO: 1197 - DNA, 722 bp, Panicum virgatum
ctccgaattccgaaccctagccttccttttctcctcccagccgccgcccccgccgccgcagcgagcacgcggacccagccatgtccgggaggaggaagacgcgggagccaaaggaggagaacgtgacgctcggacccaccgtccgcgagggcgagtacgtcttcggcgtcgcgcacatcttcgcctccttcaacgacaccttcattcacatcactgatctttccgggagggagacgctcgtccgcatcactggtggcatgaaggtcaaagctgaccgtgatgagtcatccccttatgcagccatgcttgcagctcaggatgttgcccagagatgcaaggagcttgggatcactgctctgcacattaagctccgtgctaccggtggaaacaagacaaagactccaggccctggtgctcagtctgcgcttagggctcttgcacgttctggcatgaagattggacgcattgaggatgtgactccagtcccaactgacagcacgcgaaggaagggtggtaggaggggaaggaggctgtagtttcgtgcagaaccagatccgacctggcgtgcaagctgttttgtgcttttgttcgtgatgctagcatcggatttcatggatttgttataagttttgagctacactgtattggatcgtttactcgtgagccgaattgctggcttgctttggctgcacattctctatttaagttggatgttttgctgg

SEQ ID NO: 1198 - DNA, 821 bp, Panicum virgatum
ggggggttatctctacccatttctccgtccgctcctcgcctcgtcccctcctctccgaattccgccgaaccctagccttttccttctctctcctcccagccgccgcccccgccgccgcagcgagcacgcggacgcagccatgtccgggaggaggaagacgcgggagcccaaggaggagaacgtgacgctcggccccaccgtccgcgagggcgagtacgtcttcggcgtcgcgcacatcttcgcctccttcaacgacaccttcatccatatcactgatctgtctgggagggagacgctcgtccgcatcactggtggcatgaaggtcaaagctgaccgtgatgagtcatccccttacgcagccatgcttgcagctcaggatgttgcccagagatgcaaggagcttggaatcactgctctgcacattaagctccgtgctaccggtggaaacaagacaaagtctccaggtcctggtgctcagtctgcgcttagggctcttgcacgttctggcatgaagattggacgcattgaggatgtgactccagtcccaactgacagcacacggaggaagggtggtaggaggggaaggaggctgtaatttcgtgccgaaccggatccaactggccgtgcaagctgttttgtgcttttgttcgtggtgctagcatcagatttcatggatttataagttttgagctaccttgtgtatcttaacattttgaaccgaattgctggcgtactttggctgcacattctctattgcaagttagctgttttgccggtaaggtatcctataaatgtccattagtccaccgtcgtttgtttgc

SEQ ID NO: 1199 - DNA, 754 bp, Panicum virgatum
cgaaaagccagaccgtcgccgaaaacttcaaaatgccccccaagaaggtcgccgctcctaaggagaacatctcctgggcccctctgcccgcgatggcgagctcgtcttcggcgttgcccgtatcttcgcctccttcaacgataccttcgtccacgttaccgatctgtccggccgtgaaaccatcacccgtgtcaccggtggtatgaaggtcaaggccgaccgtgacgagtcctccccctacgccgccatgttggctgcccaggacgtcgccgcccgctgcaaggagctcggcatcaacgctctgcacatcaagatccgtgccactggtggtaacggtaccaagacccccggccctggtgcccagtccgctctccgtgctctggcccgtgccggcatgaagattggccgcattgaggacgttactcctaccccctccgactctacccgcagaaagggtggtcgccgtggtcgtcgtttgtaaacgttgtattttctttatcaagaaaaaaatacaacatttgcatacctggcctggctttggtttgggatcaaggcgggagttgcgctatctggctcttttatgtggcgttgagaaaaaacgaggagaacggcccttgaagcctggtctccaattctaccattacgctcgagttcttttgtcctttgtctttcatagagaaggatattacttggtgttggtgcagtagacagttacatttcgcccgagaagctatgaaagttatcttcctgtcag

SEQ ID NO: 1200 - DNA, 736 bp, Panicum virgatum
gagtcacgcccagatcgtaattaccgccaacatgcctcccaagcagaaggttgcacgcgctccccaggagaacatccagctcggaccccaggtccgcgagggtgagctcgtcttcggtgttgccgtatctttgcctcattcaacgacaccttystccacatcaccgatctgtctgggccgcgaaaccatctcccgtgtccaccggtggcatgaaggtcaaggccgaccgtgacgagagctctccctacgccgccatgttggcagcccaggatgtcgccgctcgctgcaaggaactcggaatcaccgctctccacgtcaagatccgagctactggtggtaacggcaccaagacccccggccccggtgcccagtccgctctccgcgctcttgcccgtgctggcatgcgcattggacgtattgaggatgtcacccctaccccatccgactccaccaggagaaagggtggtcgctgtggtcgtcgtctctgagtgtatgcgcgcaagtggctctcagtggtggaatatggcatggcatggtttgcacgatttatggtttcatgaccacaataaagtcgcggggaacggcgaatctgcctggtctccatgttgaacttggcttctcgtgtgagagatagtcgagctaaatcaacagaatcctttttggtttgaaaaggcttcccgacaatgaagtgctattgctgtgttgatcaaaaaaaggtgttcatttatacattaag

SEQ ID NO: 1201 - DNA, 727 bp, Tamarix hispida
tgagcgaggaaggggaaaccagtcggtttctagtcggtttctcgtctcgaagaaccctaaagctcagtttctcgcgtcccgcggccgccgcaactatgtcgaggagaaagactagagaacctaaggaagaggctgtcactctcggccctgccgtgagagaaggcgagcatgtttttggtgtttgtcacatattcgcttctttcaacgacaccttcatccacgtgactgatttgtctggacgagagacaatggttcgaattactggtgggatgaaggttaaggctgatagggatgagtcctctccctatgctgctatgcttgctgcacaggatgttgcacagagatgcaaagagcttggtattactgctcttcatatcaagctcagggctactggcgggaacaaaaccaaaactcctggccctggtgctcagtctgcacttagagctcttgctcgttctggaatgaaaattggccgtattgaggatgttactcccattccaactgacagtacccgcakaaagggtggtagaaggggaaggaggttgtgaatgttgctgctcgggcaatgtattctgtttcttgagtgctgtaatagctctaggcgaagtttgaacatttgatttacgcagttacagctactgtagtttgagatatgctcgagtkgttattctgataggtcaaggattcaagactaatgctacaattttgatattgttggagacttatc

SEQ ID NO: 1202 - DNA, 533 bp, Tamarix hispida
  misc_feature (34)..(35): n is a, c, g, or t
ggggaattgactcagtaacccgaacgtcgccaanntctcaaaatgccccccaagaaggtcgtccgtgctccccaggagaacatctccctgggcccctccgtccgcgatggcgagctcgtctttggcgttgcccgtatcttcgcctccttcaacgacaccttcgtccacgtcaccgatctcagtggccgtgagaccatctgccgtgttaccggtggaatgaaagtgaaggcagaccgcgacgagtcctcgccctacgctgccatgttggctgctcaggacgtcgctgcccgctgcaaggagctcggcatcaacgccctccatatcaagatccgtgccactggtggtaacggtaccaagacccccggccctggtgcccagtctgctctccgagctcttgcccgtgctggcatgaagatcggccgcattgaggatgttacccctaccccctccgactctacccgcagaaagggtggtcgccgtggtcgtcgtctctaagctactcgcttattggctggcctggcatggacgggagt

SEQ ID NO: 1203 - DNA, 599 bp, Thellungiella halophila
ggtcgccggtaatttcctcttttcgtttcctctgtcagctctcaacgaagaagaaggaagaaggtcccaaagccgtaccgtctacttctcatccctgtgtagctatgtcgaggagaaagacgagagaacccaaggaggaaaatgtcactctgggacctgccgtacgtgagggtgagcaagtctttggagttgttcatatctttgcatccttcaatgacacattcattcatgtgactgatctgtctggaagggaaactctcgttcgtattactggtggaatgaaagtaaaagctgatcgtgatgaatcctctccttatgctgctatgcttgcagctcaagatgttgctcaaagatgcaaggagcttggcatcacagccatgcatgtgaagctgcgtgccactggaggaaacaagaccaagactccaggtcctggtgctcagtcagccctccgagcgcttgctcgttcaggcatgaagattggtcgcatagaggatgtgacaccaattccaaccgatagtacccgtagaaagggtggtagaaggggaagacgtctgtgatttttttctcacatgtctcctcattccgtttggttgcttctt

SEQ ID NO: 1204 - DNA, 688 bp, Thellungiella halophila
gcacgaggcctcgtgccgaattcggcacgaggcggaacagaaagaaaccctagtttcctttgtccgttcgaaaccatgtcgaggagaaagaccagagagccaaaggaagagaatgtgacgcttggacctgctgttcgtgaaggagagaatgtctttggtgttgtccacatctttgcttcattcaacgacacattcattcacgttactgatttgtctggacgtgaaacacttgttcgcatcactggtggtatgaaagtgaaagccgacagagatgaatcctcaccttatgctgctatgcttgctgcacaagatgttgctcagcgatgcaaggaactgggaatcacagccatgcatgtgaagctccgtgctactggtggtaacaagaccaagacccctggtcctggtgcacagtctgcccttagagcccttgcccgctctggcatgaaaattggtcgcattgaggatgtgactccaatcccaaccgacagtacccgcagaaagggtggaagaagaggaaggaggctttgagttttttggtctcgctctatgggctcatctttctttctctgtttctttttgtcttttttgttagattgaaaagagttttggattactatgcgttgttgtagtgtcaactctaaaaatatttttcttcctgctatataagmcattcaaaatttggtttgtc

SEQ ID NO: 1205 - DNA, 552 bp, Nicotiana tabacum
aggttacccctcatgcggccgctggtcgcccactgtaagcacgtaaaggattcaccatggcccccaggaaagggaaggttcagcaagagcaggtgcaggtccacctgggccctcaagtgcgcgaaggtgaaattgtgtttggtgtggcacacatctttgccagcttcaacgacactttcgtccatgtcactgatctgtccggaagggaaaccattgcccgagtcactggtggcatgaaagtcaaggctgaccgtgatgaggcttcaccctacgctgctatgttggccgctcaggatgttgctgagaagtgcaagacccttggcatcactgctctccacatcaagttgcgtgccactggtggcaacaagaccaagacccctggtcccggtgtccagtctgctctgcgagctcttgctcgttcatccatgaaaattggccgtattgaagatgttactcccattccctcagacgccaccaggaggaagggaggacgacgtggtcgcagattataggcgatatgttttgtcaataaattaagttttccctaaagcg

SEQ ID NO: 1206 - DNA, 536 bp, Nicotiana tabacum
gaattcctgcagcccaccaaagttgtcaaggaagaggtgaacgtcgcccttggacctcaagtccgtgaaggtgaactggtcttcggcgttgcccacatcttcgcgtcattcaacgacaccttcgtccatgtcaccgatctttctggacgtgaaaccgtctcccgtgtcaccggtggaatgaaagtcaaggccgaccgggacgaaagctcgccttacgctgccatgttggccgctcaagatgttgccgctcgttgcaaggaagtcggtatcaccgccctccacgtcaagctccgagctaccggtggaactcagactaagacccccggccccggtggacaagccgctctccgagctcttgcccgtgctggcatgcgaattggccgaatcgaagatgtcacccctgtccccactgacagcactcgtagaaaaggtggtcgccgtggtcgtcgtctatgatttgatgccccttttttgccaatctacggttttctgtttttgctggatcacttgagcgcactaaccgcggtgggggatcc

SEQ ID NO: 1207 - DNA, 795 bp, Nicotiana tabacum
ggccattacggccgggggtctactcgcacactccacagctagggtttttcaagcttcagtagcagctcagccgtctcatcagcaattcaaccgaagccatgtctaagagaaggaccagggagcccaaggaagagactgttaccttaggaccagctaccagggagggtgaattggtctttggtgttgcccacattttcgcctctttcaacgacactttcattcatgtgactgatttgtctggacgggaaacaatggtccgcattactggtggtatgaaggtgaaggctgacagagatgaatcttctccttatgctgctatgcttgcagcacaagatgtttctcaacgatgcaaggagcttggaattaatgctcttcacattaagcttcgggctacaggagggaacaaaactaagactcctggtcctggtgcccagtccgctcttcgagcccttgctcgatctggaatgaaaattggacgcatagaggatgttactcctattcccacagacagcactcgcagaaagggtggtagaaggggaaggaggctgtgaattcttctctgcaacgtacttgctgcatggcagaatattttggttaagggttgcatctttgattgtctttttacatcttagatttaaacattttgtagactcagtacaaggtcattttgacttgtgatcagtttgagttttgcaagcttttgaggtagcaagtatttcgttgagttggattagtaagttgtctttgttttgctagttcatgagtgaatttttgttgctgcttccttattaaaag

SEQ ID NO: 1208 - DNA, 797 bp, Nicotiana tabacum
ggctacatataaagctgcagctgcaccaaattgtctcctcttaagtctgaattcaacaaatctctgtattcaagaccagtgtttcagcacaactctcatcagcaacaacaccatgtcgaagaggaggactagggagccaaaggaagagactgtcactcttggacctgctacaagagagggagagcttgtttttggtgttgcccatatttttgcgtcattcaatgacactttcattcatgtgactgatttgtctgggagggaaacaatggttcgtattactggtggtatgaaggtcaaagccgatagggatgaatcttccccatatgcagctatgcttgccgcacaggatgtttctcagagatgcaaggagcttggcattaatgcacttcacattaagcttcgagccacagggggaaacaagactaaaacacctgggcctggtgctcaatctgctctcagggcccttgctcgctcaggaatgaaaattgggcgtatagaggatgtgactccaattcctactgatagcactcgtagaaagggtggtaggagaggaagaaggctgtaagcttgctgctcttgtcaagaagcagatgcggattcttgttgagaatgttgcaggtgttagttttgatatgaacttaaatcttgctcatctactatgtagttctattgatgttggcattgcctatagattttgcttcctttttcgtggttaaatttgtgagacaattatgagcaatatgaattgtagcctacaatctattagctggttgagaatctatattccaagtttttcc

SEQ ID NO: 1209 - DNA, 802 bp, Nicotiana tabacum
ggccattacggccggggacctcaaagtaaggttattcgctagctattcagtatctcttgagcttctcactaccaatcccagccgaagccatgtcgaggagaaagactagggagccaaaggaagagaccgtaacacttggaccagcaacgagggagggtgaattggtgttcggtgttgctcacatttttgcctctttcaacgatacttttattcacgtgactgatttgtctggaagagaaactatggttcgcattactggtggaatgaaggtgaaggctgatagagatgaatcttctccatatgctgccatgcttgcagctcaggatgtgtcacagcgatgcaaggaacttggaattaatgctcttcacattaagcttcgggcaactggaggcaacaagactaagactcctggtcctggtgcccagtctgctcttagggctttggctcgatctggcatgaaaattggacgtatagaggatgtgactccaattcccacagacagcactcgcagaaagggtggtagaagaggaaggaggctgtgaagactgttcgtttctgcagcatactgcaacttggaggattttgttgttgaggatgctcctttcaatttctatttacaatttatatttaaatactctgtacctgagactttttgtttcagaccacactcattttgagctggccagctttgcgagataatgaaattttcttgaatttggcttcgttgatattagtaggttgaatggtcaaaaatatgtagacatttcttaatgtgttggttggttaaggcttaattttatcc

SEQ ID NO: 1210 - DNA, 804 bp, Nicotiana tabacum
aagtctgaattcaacctgcctctgtattcaacaccagtagaagtctcatcagcaacaacaccatgtcgaagaggaggactagggagccaaaggaagagactgtcatccttggacctgctacgagagagggagagcttgtttttggtgttgcccacatttttgcatcattcaatgacactttcattcatgtgactgatttgtctggaagggaaacaatggttcgtattactggtggtatgaaggtcaaagccgatagggatgaatcttccccatatgctgctatgcttgctgcacaagatgtttctcagcgatgcaaggagcttggcattaatgcacttcacattaagcttcgagctacaggtggaaacaagactaaaacacctgggcctggtgctcagtctgctctcagggctcttgctcgctcaggaatgaaaattggccgtatagaggatgtgactccaattcctactgatagcacccgtagaaagggtggtaggagaggaagaaggctgtaagcttgctgctcttgtcaggaagcaaattcggattcttgttgagaatgttggaggtgttagttttgatatgaacttaaatcttgctcgtctactatgtatgtagttctattgatgttggccttgcctatagattttgcttcctttttcgtggttaaatttgagacatttatgaggactatgaattgtggcctacaatctattagctggttgagaatctatatttcatggttttccagtctcggctgattgttagattgctaaaaattttattttgtgcctcataaaaaaa

SEQ ID NO: 1211 - DNA, 824 bp, Solanum lycopersicum
gaaaccctaaaagccgtcttgctacatataaagctgcagctgaatccaaatcgccttctctgaactcaatctcctccgtattcaacatcgccgtttcagcagaagtaacaaaaacaacaccatgtcgaagaggaggactagggagccaaaggaagagactgttactcttggtccttctgtgagagagggagagcttgtttttggtgtcgctcacatttttgcatcattcaatgacactttcattcacgtgactgatttgtctggacgggaaacaatggttcgtattactggtggaatgaaggtcaaagctgatagggatgaatcttccccatatgctgctatgcttgccgcacaagatgtttctcagagatgcaaggagcttggcatcaatgcacttcacatcaagcttcgagccactggtggaaacaagaccaaaacacctggacctggtgctcagtctgctctcagggctcttgctcgttcaggaatgaaaattggtcgtatagaggacgtgactccaattcctactgatagcactcgcagaaagggtggtaggagaggacgaaggctgtaaggttgcttgcttctcttgtcaagaaggagatgcagtttcttgttgagaatgctgcaggtgttatttttgatatggacttgaatcttattcacctctactatgtagttctactgatgttggctttgcctataaattttgcttcttttttcgtggttaaatttgtgaaacaattatgagaaatatgaattttagcctactatcattctgttagctggttgagaatattccatggttttttgcgtctcgttgg

SEQ ID NO: 1212 - DNA, 797 bp, Solanum lycopersicum
ccactgcaaattagggtttcttcaagctgctgagtatctctgaattttctcactatcaagctcagctgaagccatgtcgaggagaaagaccagggagcctaaggaagagactgttacacttggaccagcaacgagggaaggtgaattggtgttcggtgttgcacacatttttgcatcgttcaatgatacattcattcacgttactgatttgtctggaagagaaactatggttcgcattactggtggaatgaaggtgaaggctgacagagatgagtcttctccgtatgctgctatgcttgcagctcaggatgtgtcacagcgatgcaaggaacttggaattaatgctcttcacattaagctccgagctacaggaggcaacaagaccaagactcctggtcctggtgcccagtccgctcttagagctttggctcgttctggcatgaaaattggacgtatagaggatgttactccaattcccaccgatagtactcgcagaaagggtggtagaaggggaaggaggctgtgaagactctttctcttttctgcagcatgttgcaaattggaggaaaatattgttgtcgaaaaatgcagctttcgatatctatttacatttgatttctgaacactctgtagttgagcacttttggtttcgaaaccaccttcattttgagtttgccagcttttcgagatagttaagttctcttaaatttggtttatgcaggctaattgttggataaatttatactctttttatcttcacaattctgttagttataaagctttatttcattatggat

SEQ ID NO: 1213 - DNA, 796 bp, Solanum lycopersicum
atcggccgaattcccatggggatccgatgactcgcaccaccattgcagctagggtttttcaagcttcagcagcagcagcagcagcacacctgcaaatcaaccttagccatgtcgaggagaaagaccagagagcccaaggaagagactgttacccttggaccagctaccagggaaggtgaattggtctttggtgttgctcacattttcgcctctttcaatgacacattcattcatgtgactgatttgtctggacgcgaaacaatggttcgcattactggtggcatgaaggtgaaggctgacagagatgaatcttctccttatgctgctatgcttgcagcacaagatgtttctcaacgatgcaaggagcttggaattaatgcccttcacattaagcttcgggctacaggtgggaacaaaaccaagactcctggtcctggtgcccagtctgctcttagagcccttgctcgatccggaatgaaaattggacgcatagaggatgttactcctattcccaccgacagtactcgcagaaagggtggtagaagaggaaggaggctgtgaattcttctcagcaacatacatgctacatggcggaatattttggttaagaatgcaactctgtttgtgttttacaacttagttttgaacattttgtagccagagttgcaagtcattctgacttgtgatcatttggagctttttcaatcttgtgagatggaaattattttgttgagttggattagcaagttgacttcgtcattatcttcattaaaaagtgaacactttttgttgctta

SEQ ID NO: 1214 - DNA, 754 bp, Triphysaria pusilla
gccattacggccggggccccatcggctaattttgatttccaggcatcaggattttccgagttaagctctcagtcgccgcagctatgtcaaaaagaaagaccagggaacctaaggaagagaatgttactcttggacctgctactagggatggagaatttgtgtttggtgtggcccacatcttcgcctcattcaatgataccttcattcatgtgactgatctttcgggaagggaaaccatggttcgtattacaggtggtatgaaagtgaaagctgacagggatgaatcatccccatacgcagctatgcttgcagcacaagatgtttctcaaagatgcaaggaacttggcatcactgctcttcacattaagctccgtgctactggtggcaacaagaccaagactcccggccctggtgctcagtctgcacttagagctcttgctcgttccggcatgaagattggtcgtattgaggatgtgactccaattcctactgacagcactcgcagaaagggtggtagaaggggaaggaggctttaatttgttcttgtggttgtcatactttgcagactttcagttatggatttggacaatcgtatgaagtttcaatttttgttatttctgatgttttgaacaatttgtagtttaatcgggaatttgttaagtgcttgctctttgtttctctgttcacaactctcgctatatgaaattttgaagcttgcttgttttggttatagatttactttttgtgccattta

SEQ ID NO: 1215 - DNA, 899 bp, Triphysaria pusilla
cgcgcaggttgtccatatgctaggaaacggcagatgtggggccatgtgtatcgacggtgttaagcgcctctgtcacatccgtgcgaagatgcacaagaaggtttggatcgccgccggtgataatgtcatatgaacgggcctctagtctgacctaccggctcaaacaacccatctataaattcgggacatcaattttagcaacacttctctgtccatcttcgcattagggttttccacactcaaggagcagcaaagtctctacctcactcacagccgaaaccatgtcgaagagaaagaccagggagcccaaggaagataatgtcactcttggaccttctaccaaggacggggaatttgtgttcggggtggctcacatctttgcttcattcaatgacaccttcattcacgtcaccgatttgtctggaagagaaacaatggtccgtattactggtggcatgaaggttaaggccgatagggatgaatcctctccttatgcagctatgcttgcagctcaagatgtctctcagagatgcaaggagttgggtatcactgcccttcatatcaagcttcgcgctactggtggaaacaagaccaagacccctggtcctggtgctcaatctgcgctcagagctcttgctcgttcaggcatgaagattggacgtatagaggatgttactccaattccaactgacagcaccaggagaaagggtggacgaaggggaaggaggctgtaacttgtcattgtttgtcatttacttacggatggtttggatgttttttttcaagttgcaaatttttgatatttagtgcttgaactttttttattctagatattatgattgagcatctgaacatctacatttaagaggtagttatttttaatgaaccaccctttatta

SEQ ID NO: 1216 - DNA, 684 bp, Triphysaria pusilla
aggtcggcatyagggttttacatactcaggagcagcgtctttttttcgtcagttgcctcgaagcaccgaaaccatgtcgaagcgaaagaccagggagccgaaggaagataatgtcacccttggaccatctaccaaggatggagaatttgtgtttggggttgctcacatctttgcttcattcaatgacacattcattcatgtcactgatttgtctggtagagaaacaatggtccgtattactggtgggatgaaggtgaaggctgatagggatgaatcctctccttatgcagctatgctcgcagctcaagatgtatctcagagatgcaaggagttgggtattactgcccttcatattaagcttcgtgctactggtggaaacaagacaaagacccctggtcctggtgctcaatctgcacttagagccctcgctcgttcgggcatgaagattggtcgtatagaggatgtaactccaattccaaccgatagcaccaggagaaagggtggacgaaggggaaggaggctgtaagcagtcattgtttctcaagactatttgtggttgtggtctcgatgttttttggaagtttcagatttttgttatttattggttgaccagtttttattttggatattatgatgtttgaacatctgaatacatccacattgaagtagagaattttctggaac

SEQ ID NO: 1217 - DNA, 485 bp, Triphysaria pusilla
tcaggattttcccgagttaagctctccgtcgccgcagccatgtcgaaaagaaagaccagggaacctaaggaagagaatgttactcttggacctgctactagggatggagaatttgtgtttggtgtggcacacatcttcgcctcattcaatgatacattcattcatgtgactgatctgtcaggaagggaaaccatggttcgtattacaggtggtatgaaagtgaaagctgacagggatgagtcatcaccatatgcagctatgcttgcagcacaagatgtttctcaaagatgcaaggaacttggcatcactgctcttcatattaagctccgtgctactggtggcaacaagaccaaaactcctggacctggtgctcagtctgcacttagagctcttgcccgttccggcatgaagattggtcgtatcgaggatgtgactccaattcctactgacagcactcgcagaaagggtggtagaaggggaaggag

SEQ ID NO: 1218 - DNA, 1006 bp, Volvox carteri
  misc_feature (41)..(41): n is a, c, g, or t
gtgctgaatagcctagccccgttgcctgcgggtgccaccangtttttaaaagcagccatggcccctaagaagtctgccaaggccgatgacgcccccaaggaggtggtcagcctgggcccgaccgtgcgcgagggcgagcatgtcttcggcgttgcccacatttttgccagctttaacgacaccttcgttcatgtgactgacttgtctggccgggaaaccatctcgcgcgtcactggcggcatgaaggtcaaggccgaccgcgatgagtcttcgccctacgcggctatgcttgcagctcaggatgtggcccagaagtgcaaggagctgggcatcaccgcgctgcacattaagctgcgcgccactggaggcaacaggactaagacgccgggcccaggtgctcagtctgccctgcgcgctctggcccgtgcgggcatgaagattggccgcattgaggacgtgacgccgatccccacggacagcacccgccggaagggtggtcgccgcggtcgccgcctgtaaagcagcggtccaggagctggagagccctccctgctgcagcggcgttggcggcagcagcagcggcagttggagagcgagcagcaagtgcatctggggcggcgcgatgggaggccgcgtctatgtcggcagcgcttttgctgcgactgctgtccagtcgccttcgtcgtcgttgtgtgccgcttttcgtagcgtttctgtaacgtgaaaaggggtgtcactgcggctgctgctgatcactcatggcctctgctctcggttcctgggcggggttgggggtgatgtaaatgtcgccaaagggcagctgtaggagaaaacaaggtttggtgtcccgtgttctatcagcctgttctggcgggggttgctggtaactacatgccatcaaacaatacaagaagcggcgctccgcttctcggtttgtgcaaagtttacagtctgcagggtcttggtcaacagttgttcctgccgttaacgatccatgtcctggggg

SEQ ID NO: 1219 - DNA, 745 bp, Juglans hindsii x Juglans regia
gggggtcctcctcagccaatagtcactctcgatctctctaagtctctcatcttctcgaagcaaccatgtcgaagcgaaagacaagggagccaaaggaagaaaatgtgacccttgggcctgccacgcgtgaaggagaacaagtttttggtgtggctcacatttatgcatcctttaatgataccttcttgcatgtgactgatttgtctggacgggagacactagttcgcatcactggtggcatgaaggtaaaggctgatagggatgtgtcctcaccatatgctgccatgcttgcagctcaagatgtagcacagagatgcaaggaacttggcatcactgctcttcatatcaagctccgtgctactggaggaaataaaaccaagactccaggtcctggtgctcagtctgcacttcgtgcccttgctcgttctggaatgaagattggtcgcattgaggatgtgacaccaattcccagtgacagcacacgaaggaagggtggtagaagagggagaagactgtagattggccttttttgcccaattttcccatcattcaactttagtgctggtgatgtggttgcttcccaatgtcttgtgtggtttactagacgaacatatttttattatttaacattttgcgggtttgctttcgttctcacaattgacttgtgttcacgacttgtggtgcttcctgctccctgtgggattgttattcttagatgactaatctatggaaaccattttgttgg

SEQ ID NO: 1220 - DNA, 937 bp, Juglans hindsii x Juglans regia
gcaaaccctattcagccacgcccgagggttttcgcagctgaaacaagagccggagcctcttcagaaaccctagacctctcaattcatcacgtccaagccatgtcgaggaagaagactagggagccaaaggaagaaaatgtgacccttggacccgctgtaagagaaggagaacaagtttttggtgttgcccacatttatgcatcatttaatgacacattccttcacgtgactgatctgtcaggtagagaaacacttgttcgcattactggtgggatgaaggtgaaggctgacagagacgagtcttcaccatatgctgccatgcttgcagcgcaggatgttgctcagagatgcaaggaacttggaataaccgctctgcatatcaagctacgtgctactggtgggaacaagacaaaaactcctggtcctggggctcagtctgctctccgtgcacttgctcgttctggaatgaaaattggtcgaatagaggatgtcactccaattcctagtgacagcactcgtagaaaaggtggtagaagagggagaaggctgtaagcttgctgttcttatccagtcacagccgcctttgtttcagcactagcttatggtttccaactgaatggcctgaccttgatcagtaatcccaatttttaaaagatattgttgttctgcactatgagatttgacaaagtttaatttccagttcaaacctcttctatcaggcttccttggaattatgattctctgagactatgtattttgatttttatgttgttgcacatcctgctcgttcagtttttgtattgtttgattgaaaggttgcatggattgaacccgggcagaaaaagttacttttcattactgtttagataaaactgaataaaaaatactctagtcatgaagggattttataaaattaaactcataaactgacgtggct

SEQ ID NO: 1221 - DNA, 662 bp, Triticum aestivum
tcttctcgtccactccaaaccctagcctcctcctcctctcgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtgaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgcattgaggatgttaccccggttccaactgacagcactcgccggaagggtggtagaagaggaaggaggctgtaattccatgctcgttcaaggatggaacaataccaagctatcgatatcctgtgtcttgcaacttgttctgtactactccgtttatgatgttactccgtttatgatgttaagtcagatcttgtggatttatagattttgagcgata

SEQ ID NO: 1222 - DNA, 930 bp, Triticum aestivum
caacgcgtccgcgactggaggcacgaggacacttaacttggactgaatgtagtaaaaatctgagcctttcggcggcggcggcgcactcatcgtgatctcaaccaggcgcgcactcctcctcctcgccgtcgtcgtctccggtccaccgccgctccacgcgaccatgtcgtcgaagaggaagaccagggagcccaaggaggagaatgtcacccttggaccggctgtccgtgagggagagcatgtctttggcgttgctcacatctttgcatccttcaatgacactttcatccatgtgactgacttgtctgggagggaaaccctggtgcggatcactggtggaatgaaggtcaaggctgatcgtgatgagtcttcaccctatgctgctatgcttgcatctcaggatgttgctacacgttgcaaggagcttggtattaccgcactgcacattaagctccgtgccactggaggcaacaagaccaagacacctggacctggagctcagtctgctctcagggctcttgctcgttctgggatgaaaattgggcgcattgaggacgtgactccagttcccactgacagcacccgccggaagggaggaaggaggggaaggaggctgtaggctatcttccaactctactggtggcaatcaagaaacttactcctctctgggtagtcctgctgtttctatgaatgtcatgaggagctttaattttgctctgttgaggatcatttgctgttagtcgtactatgaatgttgcttggatcctatttttggttcagaaacttgtggtatttatgcaaaaaactagcttttcagtctatggataccttgaaatggagtgatatcttaattcatatgggttgctagtcatctttttggtgatgcattggtgctgtgagaactgtcacccatagtgcccagtgctttgc

SEQ ID NO: 1223 - DNA, 770 bp, Triticum aestivum
gcagctcatcttctcgtccactccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaagctccgtgctactggtggaaacaagacaaaaactccaggtcctggtgctcaagctgcgcttagagctcttgcacgttctggcatgaagattggacgcattgaggatgttaccccggtccccactgacagcacccgccggaagggtggtagaagaggaaggaggctgtaattccatgctcgttcaaggatggaacaataccaagctatcgatatcctgcgtcttgcaacttgttctgtactactccgtttatgatgttaagtcagatcttgtggatttatagattttgagagatattgtgttgcatgtttagaaaatgaccctttcccctcttttgaatcaagtggttgccatctattataaccctttctttgctatggatttttacttttgcgtcttgttgttgcttgtttcatgtg

SEQ ID NO: 1224 - DNA, 779 bp, Triticum aestivum
gagcattcggcggaggcggcgcactcgtgatctcaaccaggcgcgcacttctccccctctccgccgtcgtcgtctccgatccaccgccgctccgcgcgaccatgtcgtcgaagaggaagaccagggagcccaaggaggagaatgtcacccttggaccggctgtccgtgagggagagcatgtctttggcgttgctcacatctttgcatccttcaatgacaccttcatccatgtgactgacttgtctgggagggaaaccctggtgcggatcactggtggcatgaaggtcaaggctgatcgtgatgaatcgtcaccctatgctgctatgcttgcatctcaggatgttgctacccgttgcaaggagcttggtatcaccgcactgcacattaagctccgtgccactggaggcaacaagaccaagacacctggacctggagcccagtctgctctcagggctcttgctcgttctgggatgaaaattgggcgcattgaggacgtgactccagttcccactgacagcacccgccggaagggaggaaggaggggaaggaggctgtaggctatctttcaactctactggtggcaatcaagaaacttgctcctctctgggtagtcctgctgtttctatgaatgtcatgaggagctttaattttgctctgttgaggatcatttgctgttagtcctactatgaatgttgtgtggatcctatttttggttcagaaacttgtggtatttatgcgaaaaactagtttttcagtctatggaaaccatgaaatggagt

SEQ ID NO: 1225 - DNA, 843 bp, Triticum aestivum
ccacgcgtccgaacctctcccgctaattcctttatctctcttcacgaatttccggcggcggcggcgagctcgcgacctgaagcagaaggagaagacgcgtcgatccctcgttgcctcgccccaccatgtcgaagaggaaaaccagggagcctaaggaggagaatgttactcttggacctgctgtccgtgaaggggagcatgtcttcggagttgctcatgtctttgcatcattcaatgacacattcatccacgtcactgacttgtctgggagagagacccttgttcgtattactggtggaatgaaggtcaaggctgatcgtgatgagtcatcaccatatgcagctatgctcgcttctcaagatgttgcgacgcgttgcaaggaacttggcatcactgctttgcacattaagctccgtgccactggaggcaacaagaccaagactcctggacctggtgctcaatccgctctcagggcactcgctcgttctggcatgaaaattggacgcattgaggacgtgacccctgttcccactgacagcactcgcagaaagggcggcaggagaggaaggaggctgtagacaccttctttttcatcgtctctcatggtcgtcatcaagaatttgcagtttgagtagccttattatagatcctatgtagtcgcccgtcagtttactctgagttcagaatatttgactgtcgcttaattcagagctgtgcttcacttcagatcatctctggtcgtgtatttatgcsaaagtattagtccgcacatgcctttattatgctttctgataagtaatactgctggaatgccaacgatctcattcaggaacaaaaaaaaaa

SEQ ID NO: 1226 - DNA, 465 bp, Triticum aestivum
  misc_feature (53)..(53): n is a, c, g, or t
  misc_feature (412)..(412): n is a, c, g, or t
cttgattcgttgaatcatggcgccaagaaaggctaaagtcgagaagactgagnaagttgtacaactcggcccacaagtcgctgaaggtgaaaatgtcttcggagttgcccatatatatgcgtcattcaacgatacattcgttcatgtcactgatctatctggcaaagaaacaattgtacgtattaccggtggaatgaaagtgaaggctgatcgtgatgaggcttctccttatgctgctatgttggctgcacaagatgttgctgctaggtgcaaagagattggaatcaacgccctccacatcaagttgcgtgcaactggtggaaccagaaccaagactccaggacctggtgcacaaagtgcactccgtgctcttgccagatctggaatgaaaataggacgcattgaggatgtnactccaattccatcagaccacacaagaaggaagggggccgcagaggacgacgt

SEQ ID NO: 1227 - DNA, 595 bp, Triticum aestivum
aaccagcagtcgcccattcttcaaaatgcctcccaagaagaccgccacccgtgctccccaggagaacatctccctcggaccttccgttcgcgatggcgagctggtcttcggcgttgcccgtatcttcgcctccttcaacgataccttcgtccacgtcaccgatctgagtggccgtgagactatcacccgtgttactggtggtatgaaggtcaaggccgaccgtgacgagtcctccccctacgctgccatgttggctgcccaggacgtcgctgcccgctgcaaggagcttggcatcaacgctcttcacatcaagatccgtgccactggtggtaacggtaccaagacccccggtcccggtgcccagtccgctctccgtgcccttgcccgtgctggtatgaagattggccgaattgaggacgttacccctactccttccgactctacccgcagaaagggtggtcgccgtggtcgtcgtctctgagctgcttaccttttggtggcttggattggacaggagtttcgctatctggtttctctgtggcgttgagaatcacgaggagaacggctttttcgcctggtctccagtctacactgc

SEQ ID NO: 1228 - DNA, 739 bp, Triticum aestivum
ctcatccgtcgccccacggaagtytcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagaygtcgcacagcgctgcaaggagcttggcattactgcactgcacattaagcttcgtgccaccgggaggcaacaagaccaagacccctggacctggtgccartctgccctcaaggcgcttgctcgttccgggatgaaaatcggacgcattgaggaygttacccggtcccactgacagcactcgcagaaagggtggtaggaggggaaggaggctgtaggcgtcttttccttgctatttgccatctcttgccactggcctctgggtagcgttgcttttgctatgcttgtcaataggagcaaattttgctctatgtcgaggatcatttactgttagtcgaatctatgatgtgcatggataatgttttggttgatgaattgacgtttatgctaaagatcattttcactca

SEQ ID NO: 1229 - DNA, 736 bp, Triticum aestivum
ggcgcactcgtgatctcaaccagggcatgcactcctcctcctcttgccgtcgtcttctccaatccaccgccgctccgcgcaaccatgtcgtcgaagaggaagaccagggagcccaaggaggagaatgtcacccttggaccggctgtcagtgagggagagcatgtcttcggtgttgctcacatctttgcatccttcaatgacaccttcattcatgtgattgacttgtctgggagagaaacccttgttcggatcacgggtggcatgaaggtcaaggctgattgtgatgagtcttcaccctatgctgctatgcttgcatctcaggatgttgctacccgttgcaaggagcttggtatcaccgcgctgcacattaagctccgtgccactggaggcaacaagaccaagacaccaggacctggagctcagtctgctctcagggctcttgctcgttctgggatgaaaattgggcgcattgaggacgtgactctagttcccactgacagcacccgtcggaagggaggaaggaggggaaggaggctgtaggctatctttcagctgtactggtggcaatcaagaaacttgctgctctctggtagtcctgctgtttctatgaatgtcatgaggagctttaattttgctctgttgaggatcatttgctgttagttgtactatgaatgttgcttggatcctatttttggttcagaaacttgtggtatttatgcgcaaaactagtttttca

SEQ ID NO: 1230 - DNA, 519 bp, Triticum aestivum
gcacgaggggaaagcaggcgaagaacaaggaggtgaagaaggagcgtgctcccaaggaagaggttatcctcggaccccaaggcgtcaatgctggggagaacgtgttcgccgtcgcccatatctatgcgaccttcaacgatactttcattcatgtgactgatttgactggccgtgaaaccattgcccgtgttactggtggcatgaaggtcaaggctgatcgtgatgaatcctctccctacgctgctatgttggctgctcaggatgttgctgctcgctgcaagcaaattggcatcactgcccttcatatcaaattgagggccaagggtggaaaccaaaccaaaacccccgggcctggtgctcagtcagcccttcgtgctcttgcccgtgctggcatgaagattggtcgtattgaagatgttactcccgttcctcacgattgcacacgaagaaagggtggtcgtcgtggtcgccgattgtaaatgggccaaaccaaaaaataaaccaacataaataaaatcc

SEQ ID NO: 1231 - DNA, 905 bp, Zamia vazquezii
gctaccggctctcgtagtctcacaaatatcatttgctctatttcctggtgcacgaggttgtcgccactggacgcccatgtgaccgtgcggcagacgggaagctagggcggcgttctgcaagttagcgattcgtctcggtmgactgaagggcctggaaacgtcaaaatgtctgggaagaagaaggtgagagaagttaaggaggaaaacgttactttggggcctacagttagagaaggagaacatgtttttggtgttgcacacatatttgcatctttcaatgatacttttgtgcatgtgactgatttatctggcaaggaaactattgcccgagttactggtggtatgaaggttaaagctgatagagatgaatcttcaccttatgctgctatgcttgcagcacaagatgttgcgcagagatgcaaggacctgggcataactgctttgcacataaagctccgtgcaacaggaggcaacaagacaaaaactcctgggcccggagcacaatctgctcttcgtgcacttgctcgatctggaatgaggattggtcgcattgaggatgtgactccgatacccactgatagcacaagaagaaaaggtggacgaagagggaggaggttgtgattttttgggatgctattgtttcttggcagcttgttgaattttctgcctggagcagatttatagggcatttatgtagactaagttttatttcaaacacatacttggagatgtggatgacatcttctagtttgagccatcttagctaaatggtattatttaggcatactttcttattaatctgtttttgcctctaatgaactgcaacaaaactgcaacatgttttaatgtgttgtaacattcatctggtgttgaaatttcatttttttctgcaaaaaaaaaacaaa

SEQ ID NO: 1232 - DNA, 1116 bp, Hordeum vulgare
ggcggggggcggtctcgtctgtctgcggtaccacagaccaccaccgcagcacgcaccacgcgccctcccgccccgtgatcgccgccgtctcgccgctgcgccgacccctccaccggcattcgattcggagcccagcccgtccggcggcgcggagccatgggcacggttgtggatgctcccgcagctgtgactgagaaggaggtggttgctgagaacatgttgggtgacaagaaagtcacagtagtatttgttcttggtggtcctggaagtggaaagggcacacagtgtgccaacattgtggaacactttggattcacccatcttagtgctggagatcttttgcgcgcggagattaaatctggctctgagaatggaactatgattgagaacatgataaaggagggaaagattgttccatcggaggtgactataaagctcttgcagcaagccatgataaagaatgagaatgataagttcctcatcgacgggtttccaaggaatgaagagaatcgtgctgcgttcgagaatgttacaaaaatttcgcctgcatttgtgctattctttaattgttccgaggaagagatggaaagacgtcttttgggacgcaatgagggtagagttgatgacaacattgagactatcaggaagagattcaaagtttttgttgaatccagtttgcctgtgattgagtactatgacgcaaaagacaaggttaaaaagatcgatgctgcaaaaccaattcctgaggtgtttgaagatgtcaaagccatttttgccccatttgccaaggctgcatagaacagtataaaggaccacaaaggtgataaatggaatgatctcatacaaggttttgctcaagtgtgactacatatatgtgattacaaacccttaatatagatcagacttatcagtagacaatttgatttgttgccagcaataaattagatctggtttggggtgttcctgctagaagtttttatttaccacccattgttggtgtatcccatgtagtgtacctgtaccattgtgtaatttactgcaaggacgaatcagaccttgtgcccatgagctatgcggctgcattacagaaaattgaatttatcacatgttcactca

SEQ ID NO: 1233 - DNA, 695 bp, Brachypodium distachyon
cagtcatgggcacggttgtggatgctcctgcagctgtgactcagaaggaggaggttgctgagaacatgttgggtaacaagaaagttacagttgtatttgtcctgggtggtcctgggagtggaaagggcacacagtgttccaacattgttgaacattttggattcacccatcttagtgctggagaccttttgcgtgcagagatcaagtctggctctgagaacggaactatgattgagaacatgataaaggagggaaagattgttccatcggaggtaactataaagctcttgcagcaagccatgataaacaatgagaatgataagttcctaatcgatgggtttccaaggaatgaagagaatcgtgctgcattcgagaatgttacaaaaatttcccctgcatttgtgctattcttcaattgttctgaggaagaaatggaaaggcggcttatggggcgcaatgagggaagagttgatgacaacatagagactatcaggaaaagattcaaagtttttgttgagtctagtttgcctgtaattgagtactatgacgcgaaggagaaggttaaaaagattgatgctgcaaagccaattcctgaggtgtttgaagatgttaaagccatttttgccccatatgccaaggctgcgtagaacagtgtaaaggaccaaaaaggttataagggaatgatttcatgaaag

SEQ ID NO: 1234 - DNA, 1231 bp, Cenchrus ciliaris
cacgcacctagcgacyagcgcagattcgttccacgcccggcacccccctcgccctcgctcccrgatctcgcacgcctcccgcaagggtaactttgagctatgggcacggttgtggatgctccagcagctgtggctgaggaggtcactgagaacatgttaggcggcaagaaagttacagttgtattcgttctaggtggtcctggaagtggaaaaggcacacagtgtgctaacattgtggagcactttggattcacccatcttagtgctggagatcttttgcgtgcagagatcaaatctggctctgagaatggaaccatgattgagaacatgataaaggagggaaagattgttccatctgaggtaactataaagctgttgcagcaggcaatgataaaaagtgaaaacgacaaattcctgatcgatggattcccaaggaacgaggagaatcgtgcagcatttgaaaacgttaccaaaatttctcctgcattcgtgctattctttgactgttccgaggaagagatggaaagacgtcttttggggcgtaatcaggggagagttgatgataacattgagactattaagaaaaggttcaaaacttttgttgaatcaagtctgcctgtcatagagcattataactcaaaggacaaagttaaaaagattgatgctgcaaaaccaattcctgaggtgtttgaagacgtcaaagccatttttgccccatatgcgccaaaggctgaatagagcaatacaagggacacgttaaaaagattatgcatggtgccataggcaccgcacatccgcacaaacatatttgtgattaagaacccgttattgatatagaagaaaagttttggctcatatgagctaccagcatatcagtaggcaattcgatttgttaccagcaataagtagatctgattyccagcggtcccactagagtgacattttattgttgtcagtgtatccacggatatattgttgtaccaatgtgtaatttactgcacggatggacgatgaaaacattctccycgcccacatctgttgtaccaatgtggcattgcgaaaagtagaactgccatcatattcttttataagcgatacgattattcttgtagccctctgtttaacagcatttcactggacttttgtttggtcactttgcaaattgtaacatggtgcccttgtaacattgcatctgatgtgtattatgattattaggctgggagtgatacta

SEQ ID NO: 1235 - DNA, 1443 bp, Festuca arundinacea
ggcacgaggagcacacgcaccacgcgcttcccgtgatcccgccgccgcccgcgccgaccatcctccgcccaccgcgcgcccgccgtcgatccaggaccgcacagccatgggcacggttgtggatgcacccgcagttgtcactgagaacgaggaggttgctgtgaacatgttgggtgacaagaaagttacagttgtatttgttcttggtggtcctggaagtggaaagggtacacagtgtgccaacattgttgaacacttcgggtttacccatcttagtgctggagatcttctgcgcgcggagcttaaatctggctctgagaatggaactatgattgagaacatgataaaggaggggaagattgttccatcagaggtaactatagcgctcctgaaggaagccatgataaaaaatgagaatgataagtttctaatcgacgggtttccaaggaacgaagagaatcgtgctgcattcgagcatgttacaaaaatttctcctgcatttgtgctattcttcaattgttctgaggaagagatgcaaaaacgtcttttggggcgcaatgagggaagagttgatgacaacatagagactatcaagaagagattcaatgtttttgctgaatccagcttgcctgtaattgagtactatagagcgaaggagaaagttaaagagatcaatgctgcaaaaccgattcctgaggtgtttgaagatgtcaaggctatttttgctccatacgccaaggcttcctagaacagtataaaggaccaaaaggtgataaatggaaggattttatacaaggtataccttagcgccccttttatgcgtcattactttcttttcataagcggttctcatgaagtcataagtggtgcagctgtttaccttttcccttgtgacatagagcaatataagttggctctatttggctgtgtggttgacttgcaaaagtgttgacacacttgtctacgataatattagtaagaacaacatttgaatgggatatgtcaattagacaaatacgcaatgactgtagtagcaaatgagaagttgagaactacctcctagttgagaactacctaacctgcattgatctcctcaactatgagtccatgtgctattcaatagtgatgatagttagttatactgtacttcacagtaatatttcttatgaaatgtgcaataagcattgtacgtagctttgtggtgagactactctttactccagaaggcgtgctcagctgcttcttccacatgtttcaagccccaatcagtggaaacttacgtatgggattctgtagctggatttcagttgacataaattttttgaactcaagtaaaccttaatatcttactttcatggaaacaattggcctctgcttttcaatttccacatagcgtttttcagatagcttaattgcagtctaaaactatcaaccttaatcaaa

SEQ ID NO: 1236 - DNA, 1283 bp, Leymus cinereus x Leymus triticoides
gttcccaccggccaaatgccacgcttcccgcggagaccccgcgtgggccccacccccacagccccaccacctccccctccacctggccgcgcgccgcgcgcgtattaaacggcctcctcctcctcgctcctctcgcaccamcryyrcwgtcrcaccgcagcacgcaccacgcgcccccctgtgatcgttgtggtctcgccgccgcgccgaccttctgcttcctccaccgacattcgattcggaggccagctcgtccagcggcgcggagccatgggcacggttgtggatgctcccgcagttgtgactgagaaggaggtggttgctgagaacatgttgggtgacaagaaagttacagtagtatttgttcttggtggtcctggaagtggaaagggcacacagtgtgccaacattgttgaacactttggattcacccatcttagtgctggagatcttttgcgcgcggagattaaatctggctctgagaatggaactatgattgagaacatgataaaggagggaaagattgttccgtcggaggtgactataaagctcttgcagcaagccatgataaagaatgagaatgataagttcctcatcgacgggtttccaaggaatgaagagaatcgtgctgcgttcgagaatgttacaaaaatttcgcctgcatttgtgctattcttcaattgttccgaggaagagatggaaagacgtcttttgggacgcaatgagggtagagttgatgacaacatcgagactatcaggaagagattcaaagtttttgttgaatccagtttgcctgtgattgagtactatgacgcgaaggacaaggttaaaaagatcgatgctgcaaaaccaattcctgaggtgtttgaagatgtcaaagccatttttgccccatatgccaaggctgcatagaacagtataaaggaccacaaaggtgataaatggaatgatttcatacaaggttttgctcaagtgtgactacatatctgtgattacaaacccttaatatagatcagacttatcagtagacgattcgatttgttgccagcaataagtagatctggtttgtggtgttcccgctagaagtttttatttaccacccgttgttggtgtatcccatgtagtgtacctgtaccattgtgtaatttactgcaaggacgaatcagaccttgtgcccatgagctatccggttgtattacagaaaatcgaacttatcacatattcactcatattacattcacactgttggttcttctgttgaagatacagagtaacccttgcca

SEQ ID NO: 1237 - DNA, 1377 bp, Eragrostis curvula
cgaactaagcagcagattcctacccgcgccgcctccttcaccttgctcccagatctcgcgcgcctctctcaagagtaacgtcaaattatgggcacggttatggatgctccagcagctgaggttgagatcactgagaacatgctgggtggcaagaaagtcactgttgtatttgttctaggtggtcctggaagtgggaaaggaacacagtgtgccaacattgtggaacactttggcttcacccatcttagcgctggagatcttttgcgtgcggagatcaaatctggttctgagaatggaaccatgattgagaacatgataaaggagggaaagattgttccatcagaggtgacaataaagctgttgcaggaggccatgattaaaagtgaaaatgacaaattcctgatcgatggatttccaaggaatgaagagaaccgtgctgcttttgagaatgttacaaaaatttctcctgattttgtgctattcttcgattgttctgaggaagagatggaaagacgtcttttgggtcgcaatcagggaagagttgatgataacattgagactatcaggaaaaggttcaaagtttttgttgaatcaagtcttcctgtcattgagtactatagctcgaaggacaaggttaagaagattgacgctgcaaaaccaattcccgaggtgttcgaagatgtcaaagctatttttgccccctatgctccgaaggctgaatagagcaacgtaagggacaccataaggcgatacgcgatgccatcggtgccacacgtgtgaccacatatctgtgattatgaatcctttaatatagaaaagttttggctcatatgagctacacgcaatatcagtaggcaattcaatttgttaccagcaataagtagatctgattcacgatgtttctgctagagtaacattctcacgctgtcggtgtacctttttctttttgtattgttgtaccattgtgtaatttactacacggaccggcaaaaaaaaaaaaaaaaaaaaaaaaaaaaagtactctggcttgaaaccactggcttaatccaatttcccgcggcccccagggggggccgggaagcttgcgaacgcgggccccatttccccctaatagtgaatccaaattacaatttcccggggccctcctttttaaaacgccttggactggggaaaaccccggggccttctcccacatttaatccccctttcccccacccctcccccttttccccccgcgggggggtaaaaaaaaaaaaaaaaggcgccccccacccaatcccccccttttccccaccaaatttgtcccccccccccccggaaaaaggggggaaagaaggggggacccgccccccccccctgtggtaaaacggggcgccc

SEQ ID NO: 1238 - DNA, 1571 bp, Zea mays
cccgcctccctcctccgttcctcactttccaatttccgtctccaccctccgcggtccgcgccgcggaccgcggtcaccactcaccagcagcgctgcagcgccacgccgccactccagtcccccaccgaccacttgccgattgccgttgccgcgtcggcgttgctggatcctcaagcagaccgcccggacccgggaacccgcccgcgcgcttattaataacggccacctcgttcccccgcccgccccgaaggccgagggaagcgtacgcgcctagcgaccagcacagattcgttccacgcctacctcctgccctcgcccgtgctctcagatctcgcgcgcgccccgcaaagggtaactttgagccatgggcacagttgtggatgctccagcagttgtggctgaagaggtcactgagaacatgttgggtggtaagaaagttacagctgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgactataaagctgttgcaggaggcaatgataaaaaatgaaaatgacaaattcctgatcgacggatttccaaggaatgaggagaatcgtgcagcatttgagaatgttaccaaaatttctcctgcatttgtgctattctttgactgttctgagaaagagatggagaaacgtctcttggggcgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaagacgtcaaaaccatttttgccccatatgctccaaaggctgaatagagcagtctaaaagggacatgataaaggtgtcataggcaacacacaaacatatatgtgattatgaacccttcaatatagaacagaagttttggctcatatgagctaccagcgcatcagtaggcaattcgatttgttatcagcaatatttagatctgattctcaggggtcctgctagagtaacattttaccactgttgtttatgtatatcctttgatgttgtgttgtaccaatgtggaatttactttagggctagtttggacatggaaatacaggggatccatcaggcctgaggcaggaatccccttgttatttataaattaataagaggattcctgcctcatggattctctccattttcctatccaccaaaccagcccttatagagcaatgagaccttgtgcgatcccatcagatttcttgtggcattatggaaagtataaaactgctgccatattctttatacgttgaaatatgttcattgcactgaacatttgttttgatgactttgtatgtatataataccctcccaacagtaagtatctaagcttagcaagcctcttgtagttgt

SEQ ID NO: 1239 - DNA, 1144 bp, Avena sativa
aggcaccacgcgcttcccgtgatctcgccgccgcgccaccagccctccgcccgcctccgatttcggccgccaacctcgtccaggaacgcagagccatgggcacagttgtggatgctcctgcagttgtgactgagacggaggaggttgctgcgaacatgtyggsygasragaaattactgttgtatttgttcttggtggtcctggtagtggaaarggcacacagtgtgccaacattgtygaacacttyggattcacccatcttagtgctggagatcttctgcgcgcagagattaaatctggctctgagaatggaactatgattgagaacatgataaaggaggggaagattgttccatcggaggtaactataaagctcctraagcaagccatgataaaagatgagaatgacaggtttctaattgacgggtttccaaggaacgaagagaatcgtgctgcgttcgagcttgtcacaaaaatttctcctgcatttgtgctattcttcaattgttccgaggaagagatggaaaaacgtcttttgggacgcaatgagggaagagttgatgacaacatagagactatcaggaagagattcaaagtttttgttgaatccagtttgcctgtaattgagtactatagggcgaaggacaaggtcaaagagatcgatgctgcgaaaccgattcctgaggtgttcgaagatgtcaaggccatttttgccccatatgccaaggctgcatagaacagtataaaggaccaaaaggtgataaatgaatgattttatacaaggttttgctcaagtgtgacatatctgtgattacaaacccttaatatagatcagacttatcagtaggcaatttgatttgttaccagcaataattagatccatttgccgctagtttcttgattacysytgttggtgtatccsctgtagtgtacttgtaccattggtgtaatttactgcatggaagaaggttsagaccttgtgcccatgagytatctatctggttgtattacagagaagcaawctgccttcaccattgagttttttcattcgaagatatccagagttgtccaytgcaaacattttgtgcaccctgttgagaaaattactacagtttttacacatatctcgatatgtgtgtgttcc

SEQ ID NO: 1240 - DNA, 1197 bp, Pseudoroegneria spicata
cgcaccacgcgcccccctgtgatcgctgtggtctcgccgccgcgccgaccctcccgctccctccaccggcattcgattcggagccaagctcgtccggcggcgcggagccatgggcacggttgtggatgctcccgcggttgtgactgagaaggaggtggttgctgagaacatgttgggtgacaagaaagtcacagtagtatttgttcttggtggtcctggaagtggaaagggcacacagtgttccaacattgttgaacactttggattcacccatcttagtgctggagatcttttgcgcgcggagattaaatctggctctgagaatggaactatgattgagaacatgataaaggagggaaagattgttccgtcggaggtgactataaagctcttgcagcaagccatgataaagaatgagaatgataagttcctcatcgacgggtttccaaggaatgaagagaatcgtgctgcgttcgagaatgttacaaaaatttcgcctgcatttgtgctattcttcaattgttccgaggaggagatggaaagacgtcttttgggacgcaatgagggtagagttgatgacaacatcgagactatcaggaagagattcaaagtttttgttgaatccagtttgcctgtgattgagtactatgatgcgaaggacaaggttaaaaagatcgatgctgcaaaaccaatccctgaggtgtttgaagatgtcaaagccatttttgccccatatgccaaggctgcatagaacagtataaaggaccacaaaggtgataaatggaatgatttcatacaaggttttgctcaagtgtgactacatatctgtgattacaaacccttaatatagatcagacttatcagtagacaatttgatttgttgccagcaataagttagatctggtttgtggtgttcctgctagaagtttttatttaccacccattgttggtgtatcccatgtagtgtacctgtaccattgtgtaatgtactgcaagracgaatcagaccttgtgcccatgagctatccggttgtattacagaaaattgaacttatcacatgttcactcatattcacattctttatacactgttggttcttctgttgtgtaccattgtgtaatgtactgcaaggacgaatcagaccttgtgaccatgagctatccggttgtattacagaaaattgaacttaaaaaaaa

SEQ ID NO: 1241 - DNA, 1315 bp, Oryza sativa
cgaagctccgcctgctccgcttcgcttcgccgacgactccggccgccaccgcaaccgcacgcggcggcagccttaccggatcctccacccccacccgaacccgcgaacccgcgtgcccgtgcttcacgcgcattaaagcggcagcaaggccacctcctcgcacctcgctcaccgcacggcacacgcgcccgggggatttggaaattggaaatttcagatcccagatctcgtctcgccgatctcgccctccgctaagccatgggttcggttgtggatgctccaacagttgtggctggacaggaggaggtcactgacaacatgttgggtgacaagaaagttacagttgtatttgttctaggtggtcctgggagtggaaagggcacacagtgtgccaacattgttgaacactttggattcattcatcttagtgctggagaccttttgcgtgcagagatcaaatctggctctgagaacggaactatgatcgagaacatgataaaggagggaaagattgttccatctgaggtaactataaaactcttgcaggaagccatgattaaaagtggaaatgataagttccttattgatggatttccaaggaacgaagagaatcgtgctgcatttgagaacgttacaaaaataactcctgcgtttgtgctattcttcgattgttctgaggaagagatggaaagacgtcttttgggacgcaatcagggaagagttgacgataacattgagactatcaggaaaaggttcaaagtttttgttgaatccagtttgcctgtcattgagtactataatgcaaaggacaaggttaaaaagattgatgctgcaaaaccaattcctgaggtgtttgaagatgtcaaagccattttcgctccatatgcgccaaatgccgcttagagcaatagaaaggaccacatgagtgataaattgcaccaactttagaaaaggctttgctctcaggtgtgactacaaatctgtgattacgaaaccgttgatatagaagagagttttggctcatatgagctacctgcatacccgtaggcaatttgatttgttacttgcaataattaattttgatccccatttcctgctagattaacttttacgagagttggcgtatcgtatgtaatgctgtacttgtaccaatgtatcatttacctcatggacgatgaaactttgtcctcccgccagtttctggtggtataatacagaaagtggaacttccgaatttttttttggttagtttctaaaacaatgttcactgaacagctaataattattcaatttgttattgacaagcctttgcaga

SEQ ID NO: 1242 - DNA, 1371 bp, Oryza sativa
gggtgtctggtgtggctgcgccgacgcgcgccccctcccacgaccaatcaacgcgcttcccgcggcgcgaccccgcgtgggccccacctgccagaggaggattcatccccgccccgcgcgcgcgtataaacggacacctctcctcccccctctccctatctcgtgtgaattgtgatctctccaccaccatcaccaccaccacgacgctgcaggcagagaggagcacgcggcccctgtgatctccgtgccaaaatcctcgatcccccgccgcggaatccagcagagggactgaattttgcaattctcagccatgggttcagttgtggatgctccagtggttgtggagggggttgctgagaacatgttgggtgataagaaagttacagttgtatttgttctaggtggtcctggaagtggaaaaggcacacagtgtgccaacattgtggaacactttggattcacccacttaagtgctggagaccttttgcgtgcagagataaaatctggttctgagaatggaactatgattgagaacatgataaaggaggggaagattgttccgtcagaggttactataaagctcttgcaagatgccatgattaaaaatgagaatgataagtttctaatcgatgggttcccaaggaatgaagagaatcgtgctgccttcgagaatgttacaaaaatttcccctgcatttgtgctattttttgactgttctgaagaagagatggaaagacgtcttttgggacgcaatcagggtagagttgatgacaacattgagaccattaggaaaagattcaaagtttttgttgaatcaagtttgcctgtaattgagcactacaatgcgaagaacaaagttaaaaagattgatgctgcaaaaccaatttctgaagtgtttgaagatgtcaaagccatttttgccccatatgctaaggttgaatagagataaaaaaaggaccacagagggcacaaatggtggcgtgctgtcagaaaaggccttgctcgagtgtgactatatatctgtgattaagaaccattgatatagaagaaaagtttttcttggctcccatgagctacctaattatcagtaggcaattcgtttcgttaccagcaataagtagatccgagtctcgctgcccccatggtgtaccggcgtgtgtcctctgtaatgctgtactgttgtataatttacctcatggatgatcaaacattatgccctcccatcagctgtgccattacaagagggtttaaaacttctgtaactgtcacattctttcataagcgattggctattcgttaatttcagtctgtactatcttcactttttaagttgaagttaacagtattcaagctgctagtacaaaaaatctc

SEQ ID NO: 1243 - DNA, 1349 bp, Sorghum bicolor
ccccgttctcccgcctccctccctccgacggtccgacctccctctccagtctccaccctccaccctccgcgccgacgcctctccagtctccagtcgccaccacccccaccgaccatttgccgcgttggcgttgccggatcctcgaagcagtcagcccagcccacctccgcccggacccgagaacccgcgcgcgcccgtattaataacggccacctcgctcccccgaaggccgagggaagcgcacgcacctagcgacggaccagcacacagattcgttccacgccccacctcgtccgcgctcccagatctcgcgcgcctcccgcaagggtaatttgagccatgggcacagttgtggatgccgctccagctgttgtggctgaggaggtcactgagaacatgttgggtggcaagaaagttacagttgtatttgttctaggtggtcctggaagtggaaagggcacacaatgtgccaacattgtggagcactttggattcacccatcttagtgctggagatcttttgcgtgcagaaattaaatctggctctgagaacggaaccatgatcgagaacatgataaaggagggaaagattgttccatcggaggtgactataaagctgttgcaggaggcaatgataaaaaatgaaaatgacaaattcctgattgatggatttccaaggaacgaggagaatcgtgcagcgtttgagaatgttaccaaaatttctcctgcgtttgtgctattctttgactgttctgaggaagagatggagagacgtctcttgggccgcaatcagggaagagttgatgataacattgaaactatcaaaaaaaggtttaaaacctttgttgaatcaagtctgcctgtcattgagcattacaactcaagggacaaggttaaaaagattgatgctgcaaaaccaattcctgaggtgtttgaagacgtcaaagccatttttgccccattttcttcaaaggctgaatagagcaatctaagggacatgataaaggtgatacatggtgtcataggcaccacacaaacatatctgtgattatgaaccctttaatatagaacaaaagttttggctcatatgagctaccagcatatcagtaggcaattcgatttgttaccagcaataagtagatctgattcccagtggtcctgctagagtaacattttaccactgtgttgtttatgtatcctttgatgttgtgttgtaccattgtgtaattttactttacgcactgatgagaccttgtgccattccaccaggtttcttgttttattgaaagtgtaaaactgctgtcatattctttatgcgttgaaatatattcattgcaccgaacttttgtc

SEQ ID NO: 1244 - DNA, 1084 bp, Sorghum bicolor
gggacccgagtccgcggcttgtgcatctgccctccgaccctcgaaaagccgcccgcctccccttctcccgcgcacgggggcggcggactccacaacctccacctcgctcaccggctcgccgcctccggccgagagtagctttgagctatgggcacagctgtggatgcttcagcagctgtggctgaggaggtcactgagaatatgctgggtggcaagaaagtcactgttgtattcgttctaggtggtcctggaagtggaaagggtacacagtgtaccaacattgtggaacactttggattcacccatcttagtgctggagatcttttgcgtgcagagatcaaatctggctcagagaatggaaccatgattgacaacatgataaaggagggaaagattgttccatcagaagtaaccataaagctgttgaaggaggccatgataaaaagtgaaaatgacaaatttctgattgacgggtttccaaggaatgaagagaatcgtgctgcattcgagaatgttacaaaaatttctcctgcatttgttttattctttgattgtgctgaggaagagatggaaagacgtcttctggggcgcaatcagggaagagttgacgataacattgaaactatcaggaaaaggtttaaagtgtttgttgaatctagtttgcctgttattgagtactatagctcaaaggacaaggttaaaaagattgatgcagcaaaaccaattcctgaggtctttgaagacgtgaaggccatttttgccccatatgctccaaaggttgaatagagcaatatacaagagaggtcatggaggcaccggacaattgttactacatatatgttattatgaacttatttaatatagaagaaaagtttttgctcaaatgagctaccagcatatattagtaggcaattcaatttgttatcagcaataagtagatctgagtccctgtgttccctgctagagtagcattttaccaatgttggtgtatcctttgatattgttgtaccaacaatgtggcaatgtggtctggcttgtaccctcccatctgctatctggtagcattaagtgattatttattctt

SEQ ID NO: 1245 - DNA, 1157 bp, Saccharum officinarum
aacgcacagatctagaaggcgacggatccagccgcgctcaggctcgggctctcagcgacggcggggcagtcccaggctcggcggcggtgtcagcggctccccctctcgccagtcgcctccgtcctccgcacaccggccggcgaccctgcggtaactttgagccatgggcacagttgtggatgccgctccagctgttgtggctgaggaggtcactgagcacatgttgggtggcaagaaagttacagttgtatttgttctaggtggtcctggaagtggaaagggcacacagtgtgccaacattgtggagcactttggattcacccatcttagtgccggagatcttttgcgtgcagagattaaatctggctctgagaatggaaccatgattgagaacatgataaaggaggggaagattgttccatcggaggtgactataaagctgttgcaggaggcaatgataaaaaatgaaaatgaaaaattcctgatcgatggatttccaaggaacgaagagaatcgtgctgcatttgagaatgttacaaaaatttctcctgcatttgtgctattctttgactgttccgaggaagagatggagagacgtctcttggggcgcaatcagggaagagttgacgataacattgaaactatcaaaaaaaggttcaaaacctttgttgaatcaagtttgcctgtcattgagcattacaactcaagggacaaggttaaaaagatcgatgctgcaaaaccaattcctgaggtgtttgaagacgtcaaagccatttttgccccatattctccaaaggctgaatagagcaatctaagggacatgataaaggtgatacatgttgtcataggcaccacacaaacatatctgtgattatgaaccctttaatatagaaaaagttttggctcatatgagctacmagcatrtcagtaggcaattcgatttgttaccagcaataagtagatctgattcccagtgstcctgctagagtaracattttaccactgtgtttgtttatgtatcctttgatgttgtgctgtaccaatgtgtaattttactttatggactgatgagaccttgtgccattscaccaggtttcttgttttatggaaagtgtaaaactgctgccatattctttatgcgttgaaatatattcatt

SEQ ID NO: 1246 - DNA, 1127 bp, Saccharum officinarum
ggaagcgcacgcacctagcgaccagcacacagattcgttccacgcccccctcgtccgcgctctcagatctcgctcgtctcccgcaagggtaactttgagccatgggcacagttgtggatgccgcgccagcagttgtggctgaggaggtcactgagaacatgttgggtggcaagaaagttacagttgtatttgtactaggtggccctggaagtggaaaaggcacacagtgtgccaacattgtggagcactttggattcacccatcttagtgctggagatcttttgcgtgcagagattaaatctggctctgagaatggaaccatgatcgagaacatgataaaggagggaaagattgttccatcggaggtgactataaagctgttgcaggaggcaatgataaaaaatgaaaatgacaaattcctgatcgatggatttccaaggaacgaggagaatcgtgcagcttttgagaatgttaccaaaatttctcctgcgtttgtgctattcttcgactgttctgaggaagagatggagagacgtctcttggggcgcaatcagggaagagttgatgataacattgaaactatcaaaaaaaggttcaaaacctttgttgaatcaagtctgcctgtcattgagcattacaactcaaggaacaaggttaaaaagattgatgctgcaaaaccaattcctgaggtgtttgaagacgtcaaagccatttttgccccatattctccaaaggctgaatagagcaatctaagggacataataaaggtgatacatggtgtcataggcaccacacaaacatatctgtgattatgaacccttttaatatagaacaaaagttttggctcatatgagctaccagcatatcagtaggcaattcgatttgttacctgcaataagtagatctgattcccagtggtcctgctagagtaacattttaccactgtgttgtttatgtatcctttgatgttgtgttgtaccaatgtgtaattttactttatggactgatgagaccttgtgccattccacctggtttcttgttttatggaaagtgtaaaactgttgccacattctttatgcgttgaaaaatattcattacaccgaacttttgtcggataaacttgtaat

SEQ ID NO: 1247 - DNA, 1607 bp, Panicum virgatum
caccaccaccaccaccacaccaccgaccagttgccgcgttcccgggtcctcacacggccagcccacccggacccggaaacccgcgcgagcgtattaataacggccacctctatctctgtcccgccccgtagcccacgcacagattcattccacgcccccctctcccctcgcccgcgctcccagatctcgcacgcctcccgcaaggtacgtggattcctccaccgaccctcctaatgctcgtggtgttcgattgatttgtgcgacgctgcgagcggcgaggcaacccatagccgtctctcttccctcccggctcccgacttgtgcgcgactgccggccgtcttcctcgcccgatacgacgacgcctggccggtggccgcgtgacagcctcaccccgcctaggatcctggtcgacggccgcccgacgcaagccgccagccccacccgcttgccagatcccaggcgcgcggcgaccggcgagcagcaacaaccggcgcaggcgcacggcggcagcagccgtccgcccgctaccccttcccgttgtggcctcgttctgggtaaatttgagctatgggcacagttgtggatgctccagccgttgtgactgaggaggtcgctgagaacactttgggtggcaagaaagttacagttgtatttgttctaggtggccctggaagtggaaaaggcacacagtgtgccaacattgtggaatactttggattcactcatcttagtgctggtgatcttttgcgtgcagagatcaaatctggctccgagaatggaaccatgattgagaacatgataaaggaaggaaagattgttccatcagaggtaactataaaactgttgcaggaggcaatgataaaaaatgaaaatgacaaatttctgattgacggatttccaaggaacgaggagaatcgtgcggcatttgagaacgttaccaaaatttctcctgcattcgtgctattctttgactgttctgagaaagagatggaaagacgtcttttggggcgcaaccaggggagagttgatgataacattgagactattaagaaaaggttcaaaacttttgtggaatcaagtctacctgtcatagagtattataactcaaaggacaaggttaaaaagattgatgctgcaaaaccaattcctgaagtgtttgaagatgtcaaaaccatttttgccccatatgctcccaaggctgaatagagcaatacaaggggcaccataaaggtggtacttggtgccataggcaccgctcaaacatatttgtgattatgaaccctttaatatagaaaagttttggctcatatgagctaccagcatatcagtaggcaattcgatttgttaccagcaataagtagatctgattcccagctgtcgtggtagagtaactttttattgttgtcagtgtaccaacccttcgatgttgtaccagtaccaatgtgtaatttaccgcatggacgatgaaaaccttctgcctacccaccagctatctggtggcactacggaaagtaaaactgttgccatattctttttacaagccactattcttgtagtccttcaaatattactcttaacagcattttgctgaacttttgtttggtca

SEQ ID NO: 1248 - DNA, 1383 bp, Panicum virgatum
tgcggtctccggcggcggcggcggcatcccagccatcccctctccaccccttccaccgacgcctctggcgtctggtcaggcggtcaccaccaccaccaccacaccaccgaccagctgccgcgttcccgggtcctcacacggccagcccacccggacccggaaacccgcgcgcgcgcgtattaataacggccacggccacctctctctctgttccgccctgtagtccacgcacagattcgttccacgcccccctctcccctcgcccgcgctcccagatctcgcacgcctcccgcaagggtatctttgagctatgggcacagttgtggatgctccagccgttgtgactgaggaggtcgctgagaacactttgggcggcaagaaagttacagtcgtatttgttctaggtggccctggaagtggaaaaggcacacagtgtgccaacattgtggagcactttggattcacccatcttagtgctggcgatcttttgcgcgcagagatcaaatctggctccgagaatggaaccatgattgagaacatgataaaggaaggaaagattgttccatcagaggtaactataaaactgttgcaggaggcaatgataaaaaatgaaaatgacaaatttctgatcgatggatttccaaggaacgaggagaatcgtgcggcatttgagaacgttactaaaatttctcctgcattcgtgctattctttgactgttccgaggaagagatggaaagacgtcttttggggcgcaaccaggggagagttgatgataacattgagactattaagaaaaggttcaaaacttttgtggaatcaagtctacctgtcatagagtattataactcaaaggacaaggttaaaaagattgatgctgcaaaaccaattcctgaagtgtttgaagatgtcaaaaccatttttgccccatatgcacccaaggctgaatagagcaatacaagggcaccataaaggtgatacgtggtgccataggcaccgctcaaacatatttgtgattatgaaccctttaatatagaagaaaagttttggttcatatgagctaccagcatatcagtaggcaattcgatttgttaccagcaataagtagatctgattcccaactgtcctgctagagtaactttttattgttgtcagtgtacccttcgatgttgtaccagtaccaatgtgtaatttactgcatggacgatgaaaaccttctgcctacccacacccaccagctatctggtggcattatggaaagtaaaactgttgccatattcttttacaagccattattcttgtagtccttaaaacattactctgtagtccttaaaacattactcttaacagctttttgctgaactttgtttggtcatttgcacatg

SEQ ID NO: 1249 - DNA, 1942 bp, Arabidopsis thaliana
ctctcttgcccgcttcgtgcccgtctcttctctcttcttcgtattctctctccacagacatgaattccctttttgactaacctcctttttcccctaataagtgaatcttacttcttcttctcgccaagatcaaatttctgggattcttcttcttctctctaattcccttgcgtttgtttcctctgatcaagttccgtcctttttcctttttttgttcttgagttctcgtttgagctgctttttgggggagatgggtttcgattctgttaaagttatggagaattggcaatccaagacatctaatgagaatgagaagaagaagaagaagcggaggaggaagaagaacaacaatgtcagaaacagtgaacattatgaagaagaagcaaatgggtgttgggtcaaatttaggtatatagtctgttgcgcttcttcaacatcagacgttgagacctctctcactctctctactagcactgtgggaagtcagtccgcaattgtgcaatcaaatgaccaaccggttggcccagtctcttctactactacaactagcaatgcagaaagctctttgtccactcctatcataagtgaagaacttaacatctattctcaccttaagaagttttctttcattgatctcaagttggctactagaaatttcagacctgaaagccttctcggagaaggtggctttggttgtgtcttcaaaggctgggtcgaggagaacggaactgctcctgttaagcctggcactggccttactgttgccgtcaaaaccttaaatcctgatggccttcagggtcataaagagtggcttgctgagattaattatcttggtaatcttctccatcccaatcttgttaaactggtgggttattgtatcgaagatgatcaaaggctgcttgtatatgagtttatgcctcgaggaagtttggagaatcaccttttcagaaggtccttgcctcttccatggtcaattcggatgaagattgcattaggtgctgcaaagggtctcagtttccttcacgaagaagctttaaagccggtcatttatcgagatttcaaaacctcaaatattttactggatggggagtacaatgctaaattatcagattttgggcttgccaaagatgctcctgatgaaggcaaaactcatgtgtctactcgagtcatgggcacttatggttacgctgcccccgagtatgtaatgaccggtcacttgacatcaaaaagcgacgtttacagtttcggtgtggttcttctcgaaatgctgactggtagaagatcaatggacaaaaatcgaccaaacggtgaacacaacctcgttgaatgggcgagaccgcatctcctggacaaaagaagattctaccggttacttgatccgaggctggagggtcatttctcagttaaaggagcacaaaaagtgactcagcttgcagcacaatgccttagccgtgactccaaaataagacccaaaatgagtgaagtggtggaagtacttaagcctctcccacacctcaaggacatggctagcgcttcttactacttccagacaatgcaagctgaacgtttgaaagctggttctggttctggttctggtcgtggattcgggtcaagaaacgggcaaccagtgtttcggacattgtctagtcctcatggtcaagctggttcgtcgccttatcgtcatcagattccgtctcctaagcctaaaggtgcaactacttagattggctcgcaagtgtggacgcaagcaaacgtcttttttaaccgatgtaaaaccgacattgttaaccgatttaaagaaggaaaattaaggttgttccgaagaagatccgaatttgtgtatttactacctttgtgacctcatgtttcttcgtctgttgtaactcttgaacaaattgtctgttagggtaatattgtcattatgtattagtcgtttcgtatc

SEQ ID NO: 1250 - DNA, 1590 bp, Brassica rapa
aaagaagaagaaaaacaatggcggtggcgacgaagaagaagaagcaagtgggtgttggctcaacttaaggtttatgtttggttgcgtaccttcaaaaccagatgttgatggtgcttcttcttccccttctctctatgccactaccagccccatcgtggaaagtaaacaggcaaatgagaaaccaaatgatcaaccagtttcctccacgacaacaacaacaacaactagcaacgcgggaagctcttcctcaaccccaatgatcagcgaagaacttaaggtttattctaacctcaccaagttcactttcaacgaccttaagctagctaccagaaacttcagacccgagagtcttctcggagaaggaggttttggttgcgtcttcaaaggatggatccaagaacacggtactgctcctgttaagcccggtacaggtctcaccgtagctgtcaaaaccttgaatcctgatggacttcaaggtcacaaagaatggcttgctgagattaatttccttgggaaccttcttcatcctaatctagtaaagctggttggttactgcatagaagatgatcaaagactgcttgtttacgagtttatgcctagaggaagtttagagaatcatctttttagaaggtcgttgccacttccttggtgtatacggatgaagattgcggtaggagctgcaaaaggtctcagtttcctccatgaagaagctttgaagcctgtcatctaccgagatttcaaaacgtcaaacattttacttgattcagactacaatgcaaaactatctgattttggacttgccaaagaygctcctgaygaaggcaaaacacatgtytcyactcgwgttatgggtacwtatggttacgctgctccwgagtatgtwatgaccggtcacttgacrtcaaagagcgatgtgtatagtttcggtgtggttctyctcgaratgctwackggacgamggtcyatggacaagaaccgmccmaacggygarcacaacttagtggaatgggcragaccgcatctactygacaaaagaaggttytacmrgttrctygatccgaggctggaaggycatttctcgatcaaaggcgcwcaaaaggtgaytcagctcgctgcacagtgtctkagccgtgaccccaaggttaggccaaagatgagtgacgtcgtcgaagcgctcaaaccacttcctcatcttaaagacatggcgagctcttcttactactttcagacgatgcaagccgagcgtttgaaaaacgggtcgagtcggtctcagggaggaggaaacgggtttggatcaagaaacgggcagccgcagcctgtgtttaggacgctgtctagtcctcatggtcaacatggttcttcgccttatcgacatcaggtgccttctccaaagcctaaaggagcaactacataaagctctcttgtgtggacaaaagcctaaatggtcaaagaagcttttatcgtttttctaagcggctaaggagataaatttttaactratgatgttatggtaaactctttgatggawwaakgtaaaaaagacgatggaggacggtgaatccaattgggttgtttatggaagtctgattt

SEQ ID NO: 1251 - DNA, 2012 bp, Brassica napus
gaggggaatacgaaaaaaagcgttttgtaactgttgaggagtaagcaaacaaacacatgccaaatcgctctctctctctctctctctctctctctctctctctctcacatctctgcagacatcaattcccttttttgactaaaattctctctctctctatctgctttttaatccatttttcaaagtgattcttcttcttctctcttcaccaaaaatctctcctttcttcttcttccgcagctcggaactctctaatctcatttggattttgaagtttttttcttttctctctatctcgtgctctggtcaagttctgttcattttcctgcggatgagtttagattccgtcaaagtaatggagcaatcgaacaaacccaacgagagcgagaagaagaagaagaggaagaagcagaagaagaacaatgtcaggaacaacgaagaagaagaagaagaagcaaatgggtgctgggtcaaatttagggttatggtttgttgcctaccttcaacaacagacgttgatagctcmtctcccactctctctaccaccactctggggagtaagtckgyavcaactgtgaaatcaaatgagcaaccagctggccctgtttcttcttctacaaccgcaactagcaatgcagaaagctctttgtccactcctatgatcagtgaagagcttaagatctattctcacctcaagmagttttctttccttgatctcaagytagctactagaaatttcagacccgagagtcttctcggtgaaggcgggtttggttgtgtcttcaaaggatgggtsgaggagaacggaactgctcctgttaagcctggcactggccttactgtggcmgtcaaaaccttaaatcttgatggtcttcagggtcataaagagtggcttgctgagattaactatcttggtaatcttctgcatccgaatcttgttaaactggtgggytattgtatcgaagatgaccaaaggctgctggtttatgagtttatgcctcgagggagtttggagaatcacctcttcagaaggtcgttgcctcttccatggtcrattcggatgaggattgcattaggtgctgccaagggtctcagtttccttcacgaagaggctcttaagcctgtcatatatcgcgatttcaaaacctccaacattttactagattcagactacaatgccaaactatcagattttgggcttgctaaagatgctcctgatgaaggcaaaacscatgtctctactcgagtcatgggcacttatggttacgctgctcctgagtatgttatgactggtcacttgacatcgatgagcgatgtgtatagtttcggtgtggttctactcgaaatgctgactggtagaagatccatggacaaaaaccgaccaagcggtgagcaaaacctcgttgaatgggctagaccgcatctcctcgacagaagaagattctaccggctacttgatccgaggctggagggccatttctccatcaaaggagctcagaaagtgactcagcttgcggcccaatgccttagccgtgactccaagatcagacccaaaatgagtgaagtggttgaagtccttaagccactcccgcttctcaaagacatggctagctcttcctactacttccagacaatgcaagccgagcggttgaaagctgggtctgggtctggtcgtgggttggggtcgagaaacggacaacctgtgcttaggacactgtctagtcctcatggccaagctggttcttcaccttatcgtcatcagattccgtctcctatgcccaaaggtgcaactacttagctatatctcatttcctttagaggctctttcttgtgacgcaaggaaactgtctgtttttaaccaatattcttaaccgatttagagaaaggcaaattatggtgtataagactgatctgaaagaagatccaacgttgttgatttaccctttgtaaccgcctgtttcttcttatattgtactcttcgacttgtcttagtgtttatccgttagtcgcat

SEQ ID NO: 1252 - DNA, 1125 bp, Arabidopsis thaliana
attaaaccactccactcgaccactccaattcaaaactcgccattgatacacgagagatagagagagagatttgtgtgagagaaatccatggcggaatcttgcagagtgaggaggataaagctaggaagtcaaggcctagaggtatcggcgcaaggccttggttgcatgggactcaccggtcattacggtgcttccaagccggaaactgaagccatcgctctcatccaccacgctattcactccggtgttactttccttgacacttctgacatgtatggtcctgaaaccaatgaaattctcctcggaaaggctcttaaggatggtgtgagggagaaagtggagcttgcgaccaaatttggaatcagttatgcagagggaaacagagagattaagggagatcctgcttatgttagagctgcctgtgaggctagtttaaagagactagatgttacctgcattgatctgtattatcagcatcggattgatactcgtgttcctattgaaatcactatgggagaactgaagaagctaattgaagagggtaaaataaagtacataggtttgtctgaggcctctgcctcaactatcagaagagcgcatactgttcacccaatcaccgccgtgcagttagagtggtccttgtggacaagagacgtggaagaagaaattgtcccaacctgcagggaacttggaattgggattgtttcttacagtcctctaggaagaggtttctttgcatcaggacctaagcttgttgagaacctagacaataatgacttcagaaaggctctaccaagattccaacaggaaaacttggatcacaacaagattctctatgagaaagtttctgcaatgtctgagaagaaagggtgcactcccgcacaactagccctcgcttgggttcaccaccagggagatgatgtttgtcccattccaggaaccactaagattgaaaacctcaaccagaacattagagctttatcagtgaaactcactcctgaagagatgtctgagcttgagaccattgcccaaccagagtctgtgaaaggagaaagatacatggccacagtgccaaccttcaaaaactccgacactccaccattgtcttcttggaatgctgtgtaa

SEQ ID NO: 1253 - DNA, 1493 bp, Arabidopsis thaliana
acacggctttttcttcatcatcacattcacaccatcaccaccaacaacaacaactccactaaaaaattcatagctctacaagagtcacctcatagagaagtgaagagacagagatagttgtgacagagagattcatggcggaagcttgcggagtgagaaggatgaagctgggaagccaaggccttgaggtatctgcgcaaggccttggttgcatgggcctctccgctttctacggtgctcccaagccggaaaatgaagccatcgctctcatccaccacgctattcactccggcgttactctccttgacacctccgatatctacggccctgagaccaatgaagttctcctcggaaaggctctcaaggatggggtgagagaaaaagtggaacttgcgaccaaatttggaatcagttatgcagaggggaaaagagaggtcagaggagatcctgaatatgtaagggctgcttgtgaggcaagtttaaagaggctagatattgcctgcatcgatctctattatcagcatcgtgtcgatactcgtgtccctatcgaaatcactatgggagaactgaagaagctggttgaagagggtaaaataaagtacattggtttgtctgaagcctctgcctcaactatcagaagagcacatgctgttcacccaattactgccgtgcagatagaatggtccttgtggacgagagatgtggaagaagaaatcattccgacctgcagggaacttgggattgggattgttgcttacagtcctctaggacgaggtttcttcgcatctggacccaagcttgttgagaacctagaaaaggatgacttcagaaaggctctaccaagattccaagaggaaaacttagaccacaacaagattgtttatgaaaaagtttgtgcaatatcggagaagaaagggtgcactcctggacaactagccctggcatgggttcatcaccagggagatgacgtttgccctatcccaggaaccactaagatcgagaacctcaaacagaacattggagctttgtcagtgaaactcactcctgaagagatgactgagcttgaggccattgcccaaccaggttttgtgaaaggagatagatacagtaacatgataccaactttcaagaacgctgagacaccaccattgtctgcttggaaagccgcttaaaaccggctgaagtttctacggttgtggtggtgcatcatgacattgaagtggtcttaactttctgtcagctagatcagtgtgttggggaataatggtgcgtcttcgagagtagagtatcattcccacggaaacccaagtatcatggttaatgccttgaagaataaataatgtagagttccccaagtgaaaacttcaattttacatttccatacattgtaaccaaactctataaataaagtgttgtgatacataccttaccaaaaaaggctatctatattgtaaaattcatcttctactcaataacttgtgcttctcttacca

SEQ ID NO: 1254 - DNA, 1421 bp, Arabidopsis thaliana
tttaaattcacagctctataagagtcacctagacaagtcaagagagagagatagttctgacttctgacagagactcatggcggaagcttgcggagtgagaaggattaagctaggaagccaaggccttgaggtatcggcgcaaggtcttggttgcatgggtctctctgctttctacggtactcccaagccggaaaccgaagctatcgctctcatccaccacgccattcactccggcgtcactttccttgacacctccgatatctacggtcctgagaccaacgagcttctcctcagcaaggctctcaaggatggggtgagagaaaaagtggaacttgcgaccaaatatggaatcaggtatgcagaggggaaagtagagtttaagggagatcctgcttatgtaagagctgcgtgtgaggctagtttaatgcgagtagatgttgcctgcattgatctctattatcagcatcgaattgatactcgtgtccctatcgaaatcactattggagagctgaagaagctagttgaagaaggtaaaataaagtatatcggtttgtctgaagcttcagcttcaactatcagaagagcacatgctgttcacccgataaccgctctgcaaatagaatggtccttatggtcgagagacgtggaagaagatataattccaacctgcagggaacttgggattggaattgttgcttacagtcctctgggacgaggtttctttgcttcaggacccaagcttgttgagaacctagacaataatgacgtcagaaaggcaaactctaccaagattccaacaggaaaacttagaccacaacaagattctctttgagaaggtttctgcaatgtctgagaagaaaggatgcactcctgcacaactagcccttgcatgggttcatcaccagggagatgatgtttgccccatcccaggaaccactaagattgaaaacctcaaccagaacattggagctttatcagtgaaacttactcccgaagagatgtctgagctcgaatcccttgcacaaccaggttttgtgaaaggagaaagatccattagcatcctgaccacgttcaaaaactctgagactccaccattgtcttcttggaaagccgcttaaaatcgtctgagtttctctgattgttgtggggttcatgtcatttaagtggtctaagttatgtcagctagatcaaggtaataaaagtgctgtgtcttcgagagtggattatggtaggttcattcccagggaaagccaaaactatcaagggttgatgcctttaagagtaaataatgtatagagttccccaagtgagaacttcaatttacatttcatacattttgaccaaactctataaagaaagttatgtttagactttttttttgctaaaaatgttaattttcattatatgaataagaggctttt

SEQ ID NO: 1255 - DNA, 1367 bp, Brassica rapa
gaacccaactccaccaacctctccactcaattcaaaactctctctctcactacaaaagagtcaaagagagatagaaagaaagaaagaaagaaagaaagaaagaaatcgatggcggaagctagcggagtgaagagaatgaagctgggaagccaaggccttgaggtatctgcacagggcctcggttgcatgggcctctcctccttctacggtgctcccaagcccgaaactgacgccatcgctcttctccaccacgcaatcgaatccggcgttactttcctagacacttccgacatctacggtcctcagaccaacgagctgctcctcggcaaggctctgaagaatgggttgagggaaaaaatagagcttgcgtccaaatttgggatcagctacggagaggggaagagagagataaagggagatcctttgtatgttagagctgcttgtgaggctagtttaaagcggcttgatgtggactgcattgatctttactaccagcatcgcatcgatactcgtgtccctatcgaaatcactatgggggaactgaagaagctagttgaagaaggtaaaataaagtacattggtttatctgaagcctctgcctcaactatcagaagagcgcatgctgttcacccgattactgcagtgcagttggaatggtctttgtggtctagagacgtggaagaagatatcatcccaacctgcagggagcttgggattggaattgttgcttacagtcccctaggacgaggtttctttgcatcaggaccaaagcttgttgagaagcttgaccaaaatgacttcagaaagactctaccgagattccaacaggaaaacctagaccacaacaagatcatgtatgagaaagtttgtgcaatgtcagagaagaaagggtgcactccgggacaactagccctcgcgtgggttcaccaccagggagatgatgtttgccccatcccaggaaccactaagatcgaaaacctcaatcagaacattggagctttatctgtgaaactcactcctgatgagatgcttgagctcgagaacattgtccaagcagagtctgtgaaaggagaaagatatgggaacatgttggccactttcaagaactctgacactccaccattgtcttcctggaaacccgcataaaaccagctgagtttatctggttgtggtggtggatgacattgaagcagtcttaacttctgtgtcagtaagaagaaagtaattgatctgttgtgtcttgagagtagattatcaaatccaaatatcagtgtgaatgtattgtataataaattatctatagagttccccaagtgaaacttcaatctacaactccatacattgtgtccaaactctataaataaacg

SEQ ID NO: 1256 - DNA, 1371 bp, Brassica napus
gattctcattcaccaacccaattccaactccaccaacctctccactcaattcaaaactctctctctcacaacaaaagtatcaaagagagatagaaagaaagaaagaggtgggtgagggaaatcaatggcggaagctagcggagtgaagagaatgaagctgggaagccaaggccttgaggtatctgcacagggcctcggttgcatgggcctctcctccttctacggtactcccaagcctgaaagtgacgccatggctcttctccaccacgctatcgaatccggcgtcactttcctagacacttccgacatctacggtcctcagaccaacgagctgctcctcggcaaggcgctgaagaatgggtttagggagaaagtggagctcgcttcaaaatttgggatcagctacggagaggggaagagagagataaagggagatcctttctatgttagggctgcttgtgaggctagtttgaagcgtcttgatgtggattgcattgatctttattaccagcatcgcatcgatactcgtgtccctatcgaaatcactatgggagaactaaagaagctagttgaagagggtaaaataaagtacattggtttgtctgaagcctctgcctcaactatcagaagagcgcatgctgttcaccccataactgcagtgcagttggagtggtctttgtggtctagagacgtggaagaagaaatcaccccaacctgcagggagcttggaattggaattgttgcttacagtcccctaggacgaggtttctttgcatcaggacctaagcttgttgagaagcttgaccaaaatgacttcagaaagactctaccgagattccaacaggaaaacctagaccacaacaagattctgtatgagaaagtttgtgcaatgtctgagaagaaagggtgcactccgggacaactagccctcgcgtgggttcaccaccagggagatgatgtttgccccatcccaggaactactaagatccaaaacctcaatctgaacattggagctctatctgtgaaactcactcctgatgagatgcttgagctcgagaccattgtccaagcagagtctgtgaaaggagaaagatatggtaacatgttggccactttcaagaactctgacactccaccattgtcttcctggaaacctgcataaaccagctgagttgacattgaagcagtcttaacttctgtgtcagtatgatgaaagtaattgatctgttgtgtcttgagagtaggttatcaaacccaaatatcagtgtgaatgtattgtataataaactatctatagagttccccaagtgaaacttcaatctacaactccatacactgtgtccaaactctataaataaacgtctcttctat

SEQ ID NO: 1257 - DNA, 1288 bp, Brassica napus
aaagaaagaggtgtgcgagggaaatcaatggcggaagctagsggagtgaagagaatgaagctaggaagccaaggggttgaggtctcggctcaaggccttggttgcatgggcctctcaaccttgtacggtgctcccaagcccgaaactgacgctatcactcttctccaccacgcaattgataccggcgttactttcctagatacctccgacatctacggtcctgagaccaacgagctgcttctcggaaaggctctgaagaatgggtttagrgmaaaaatagagcttgctaccaaatttggaatcatttacggagagggggagagagagataaagggagatcctgcttatgtyagrgctgcttgtgaagcaagtytgaagcgycttgatgtggattgcattgatctttattaycagcatcgsatygatactcgtgtccctatcgaaatcactatgggagaactgaagaagctagttgaagaaggtaarataaagtayattggtttrtctgaagcctctgcctcaactatcagaagagcacatgctgttcaccccataacagcggttcagctagagtggtctttgtggacaagagacggggaagaagatatcattcctacctgcagggagcttgggattgggattgttgcttacagtcctctaggacgaggcttcttcgctgctggaccaaagcttcttgagaagctggacaatgatgacttcagaaagagactaccaagattcaaacaggaaaacttagaccacaataagattctctacgasaargtttgtgsaatgtcwgaraagaaaggwtgcactcctgsacaactagccctsgcwtggsttcaccaccarggagatgatgtttgccccatcccaggaaccactaagatwgaaaacctcaatcagaacattggagctttatctgtgaaactcactcctgaagagatgtctgagctcgagaccattggtcacccagagtctgtgaaaggagaaagattcagtaacatggtgcccaactttaagaactcagacactccaccattgtcttcttggaaagccgcttaaaccccccacctgaaagtttctcgggctgtggtggtagattggcattgataatagacaagttgaggtaactatatgtagaagttgtggtgtgatgttgcatcttagtgagttccacctatgcatgacccgtctttagtctctcagggtttacacctttttaagaataaaatatgcatattcaggagttcgccgagatatytacaaaactttgaacattttcctg

SEQ ID NO: 1258 - DNA, 1364 bp, Brassica napus
acctggtacgcacgcaggtaccggtctcggattcccggctckwycywcrmrtcykttcctctttgattacacaatggctgaagcttgcggagtacggaggatgaaactcgggagccaaggccttgaggtttcagctcagggacttggctgcatgggtctctctgccttctacggcgctccaacacctgagactaacgccgtcgctcttctccgacatgccattaaagccggcgtcacattcctagacacttcagacatatacggccctgagactaacgagctgctcctgggcaaggctttgaaagatgggttgagggagaaagtggaactggcaacaaagtttggtatcattgcttctgaagatggaaaatttggttttagggcagatccagagtacgtgaggtctgcttgcgaggcaagcttaaggcgtcttggtgttacatccattgatctttattaccagcataggattgataccactgtgcccatcgaagtcacgatgggagagttaaagaagctagtggaagaaggtaaaataaaatacatcggtttgtctgaagcctctgcctcaactatcagaagagcacatgcggttcacccgataactgctgtgcagatagaatggtccctatggtcaagagacgtggaagaagatatcattcctacctgcagggaacttgggattggaattgtagcttatagccctttaggaagaggcttcttggcagcaggacctaagcttgctgagaatttggaggacgatgattatcgaaagggtctaccgagattccaagaggagaatctaaaccacaacaagattctttatgagaaggttcaggcgatggcgacaaagaaaggctgcactcctgcacaacttgctcttgcatgggttcaccaccagggagatgatgtctgtcccattccaggaacctccaagattgaaaacttgaaccagaacataggagctttatctgtgaagcttactcctgaagagatggctgagctggaagccatcgcccgaccggattttgtgaaaggagaacgatacgacagcaacatggctacttacaaggactcggagactccactactgtcttcttggaaagcagcataaaccgcatctttggactgcagtttatgatcggtttgaggggtaaatgggatgaaggcgttggacgaatgccgttttattgtgcttttggttgtgtgtgtgtgtgtgtttgaataagtttagtttaatggatgggtctgcgagtttgcaataagaaaaattcaatgcctaagaaagaacaagtttatgtaatgtttgaggtttcctgtcttgcaatttaataatttgatcaagaatattttggtcgttgacc

SEQ ID NO: 1259 - DNA, 1289 bp, Raphanus sativus
ggaccaaaacattttctctttaaattatctatctctttgattcatcaatggctgaagcttgtggagtacggaggatgaaacttgggagccaaggccttgaggtttcagctcagggacttggttgcatgggtctctctgccttctacggtgctccaacaccagagacaaacgccgtcgctcttctccgtcatgccattaacgccggcgtcacattcctagacacttcagacatatacggccccgagactaacgagctgctcctgggcaaggctttgaaagatgggttgagggagaaagtggaattggcaacaaagtttgggatcattgcttctgaagatggaaaatttggttttagggcagatccagagtatgtacggtctgcttgtgaggcaagcttaaggcgtcttggtgttacctccattgatctttactaccagcataggattgataccactgtccccatcgaagtcacgatgggagaactgaagaagcttgtagaagaaggcaaaataaaatacataggtttgtctgaagcctctgcttcaactatcagaagagcacatgctgttcacccgataactgctgtgcagatagaatggtccctgtggtcaagagacgtggaagaagatatcattcctacctgcagggaacttgggattggaattgtagcttatagccctttaggaagagggttcttggcagcaggacctaagcttgctgagaatttggaggaygatgattatcgaaagggtctaccgagattccaagaggagaatctaaagcacaacaagattctttacgagaaagttgwggcgatggcgacaaagaaaagctgcactcctgcacarctagctcttgcatgggttcaccaccagggagatgaygtctgtcccattccaggaacctccaagattgaaaacctgaaccagaacatwggagctttatctgtgaagcttactcctgawgasatggctgagctggaagccattgcccgacctgattttgtgaaaggggaacgatacgacagcgacatgactacttacaaggactcggagactccaccactgtcttcttggaaagcagcataaatcgcatctttggaatgccgttttattgtgctttagtttgtttctgtgtgtttgaataagttcaggttaatggatgggtctgcgagtttgcagtaagaaaaatccaatgcctaagaaagaacaagttttatgtaatagtatttgtggtgtttttgtcttgcaatttaataatttgatcaagtatggtttagycgttgacca

SEQ ID NO: 1260 - DNA, 1320 bp, Raphanus sativus
ggaccatttattcaccaacccaactccaccaacctctctccactcaattcaaaaccctctctctctacaaaaggagtcagagaaggagagatagaggtgtgtgatctaaatcaatggcagaaacttgcggagtgaagagaatgaagcttggaagccaaggccttgaggtctctgcacaaggcctcggttgcatgggcctctcctccttctacggtgctccccagcccgaaaccgacgccatcgctcttctccaccacgcaattaactccggcgtcactttcctagacacctccgacatctacggccctcagaccaacgagctgctccttggaaaggctctgaagaataatgggttgagggaaaaaatagagcttgcaaccaagttcgggatcagctatgcagaagggaagagagagataaagggagatcctttgtacgttagagctgcttgtgaggctagtttgaagcgtctagatgtggactgcattgatctttactatcagcatcggattgatactcgtgtccctattgaaatcactatgggagaacttaagaagctagtggaagagggtaaaataaagtacattggcttgtctgaagcctctgcctcaactatcagaagagcgcatgctattcaccctattactgcagtgcagttggagtggtctctgtggtcaagagacgtggaagaagagatcatcccaacctgcagggagcttgggattggaattgttgcttacagtcctctgggacgaggtttctttgcatcaggacctaagcttgttgagaagcttgacaagaacgacttcagaaagactctaccaagattccaacaggaaaacttagaccacaacaagatcctctatgagaaagtttgtgcaatgtcggagaagaaagggtgcactccgggacaattagccttagcatgggttcaccaccagggggatgatgtttgccccatcccaggaaccactaagattgaaaacctcaaccagaacattggagctttatcagtgaaactcactcccgaagatatgactgagctcgagaccattgtccaatcagagtctgtgaaaggagatagatacggtaacatgatggccactttcaagaactctgacactccaccattgtcttcttggaaaactgcttaaaccagttgagtggtctccgagattatatcatttccagggaaaacccaaatattgttgttaatgcattgaaaaataaatcatgtatagagttccccaagtgaaatcttcaatctacacttccatacattgtgacctaactctataaataaactttatgttctaaaaa

SEQ ID NO: 1261 - DNA, 1308 bp, Brassica rapa
cttccttcaaagccaaaaaaaaataaaaatggcgaccctctataatcaagttccttctgtatctgcaattttctctctctacacatctttttctgccatcacgatgctctttcgtacaatcctcaacgagattgttcccaagcgaatcagagaatacgtcgctctgaaagctatggacttgttctcatcttactttcagtcgaatttcacgttcgtgatcgagcaacgttgggagtttgtggagaaccagactttccgtgcggctgaagtttacttaccaacacgtcttgccggactctccaccggcaaactcctcgtgggttcgagcaatcttaagaatccggcggctgagccaaaacttggaatccctgtgaatactaaaatcattgatgagtttgaagggattcatcttgaatggactctacactctgttgagacaaagaagtatctcccagagaaacggtactttcacttgacatgtaagaaggagtttcgtgagaagataatgacagattacttcacgtacttggcgaaatcagcagagaaaataatgagccatagagagaatctcaagatctacacttacaaccaagaccggtccaaatgggaatccgctattttcgagcaccacacgacctttgagaccctagccgttgagccgcaactgaagaacaccttgatcgaagatcttgatgctttctctaaaggaaaggacttcttcaagagtgtgggacgtgcctggaaacgtggatatcttctttacggtcctcccggtactggaaaatcctctatggtcgctgcaatagcaaatcacatgaagtatcatatatatgatcttcagatacagagcgttagagatgatggtgagttgcgtgagattctcacctccactaagaaccggtcaattcttctaattgaagacattgattgtggagccgatgcttctcgtagacgccagatcaagaaaaagaaagatgatggcggtgaagatgatggtgagccacaaaagggcaagaagaagtttgaagttggtatatccttgtccggtctactgaactttgtggatggactttggtcgagttgcggagaagaaaagatcataattttcacaacgaatcacaaggagaagctcgacccggcgttgttgaggccgggaaggatggacgttcacattctcatggacaattgcacaccctttgtgttcaagaagcttgtggctatgtaccttaagactgatgaccacgccctgtttgatcccattgagaagcttgtccttgaagtgagtgcaactccggctgaagtcacaca

SEQ ID NO: 1262 - DNA, 1683 bp, Brassica napus
gggtctaagtatmtcamygymkwkwmcrmrgsgcttcatcaccttccytcaaagccaaaaaaaaaawaaaaatggcgacyctctataatcaagttccttckgtatctgcaattttctctctctacacatctttttctgccatcacgatgctctttcgtacaatcctcaacgagattgttcccaagcgaatcagagaatacgtcgctctgaaagctatggacttgttctcatcttactttcagtcgaatttcacgttcgtgatcgagcaacgttgggagtttgtggagaaccagactttccgtgcggctgaagtttacttaccaacacgtcttgccggactctccaccggcaaactcctcgtgggttcgagcaatcttaagaatccggcggctgagccaaaacttggaatccctgtgaatactaaaatcattgatgagtttgaagggattcatcttgaatggactctacactctgttgagacaaagaagtatctcccagagaaacggtactttcacttgacatgtaagaaggagtttcgtgagaagataatgacagattacttcacgtacttggcgaaatcagcagagaaaataatgagccatagagagaatctcaagatctacacttacaaccaagaccggtccaaatgggaatccgcsattttcgagcaccacacgacctttgagaccctagccgttgagccgcaactgaagaacaccttgatcgaagatcttgatgctttctctaaaggaaaagacttcttcaagagtgtgggacgtgcctggaaacgtggatatcttctttacggtcctcccggaactggaaaatcatctatggtcgctgcaatagcaaatcacatgaagtatcatatatatgatcttcagatacagagcgttagagatgacggtgagttgcgtgagattctcacctccactaagaaccgctcaattcttctaattgaagacattgattgtggagccgatgcttctcgtagacgtcagaccaagaaaaagaaagatgatggcgatgaaggtgatggtgatggtgagccacacaagggcaagaagaagtttgaagttggtatatcgttgtccggtctactgaattttgtggatggactttggtcgagctgcggagaagaaaagatcataattttcacaacgaatcacaaggagaagctcgacccggcgttgttgaggccgggaaggatggacgttcacattctcatggacaattgcacaccctttgtgttcaagaagcttgtggctatgtaccttaagactgatgaccacgccctgtttgatcccattgagaagcttgtccttgaagtgagtgcaactccggctgaagtcacacagcagcttatggccagtaaggtcgctgacattgcgctcaaagttctccttgagttcctgaaaaccaagaagacgaaaaaggaagaagataccaaagtggaggaagatggagagattgaagatgctgagactaaagaagcagaaccagaagaagaaacttaagtggatctctagtgctattgattatgtcttgaagtagtagtagtaatcttgtatttcagtttcgttttgcaaattagaatcgtttgctgagagaagatgagacaaaattgtggctgaactacaagtttttatgtatgaaaaatttgggacatagagtctcataagt

SEQ ID NO: 1263 - DNA, 1699 bp, Raphanus sativus
ggacgtttaaactcataccaggagagagagagagagagagcaattaaggcaaaacttctcgcaaatcaaaaatgggaaaggataagactttgccgttgcttgacactcgtgaaccaccggaactcactgaaaccaaaccggcgtcaagagtatgggccaaagagttccgccaagagtcgaagcggctctgggagctagccgggccggccatcttcacagccataagtcaatactctctcggtgcactcactcagactttctctggtcgtatcggcgaactagagctcgccgccgtctccgtcgagaattctgtcatctccggtctcgccttcggtgtcatgttggggatgggaagtgcactggagacgttgtgcggacaagcatatggagccggacagcttaggatgcttggaatatacatgcagcgttcttgggtcattctttttaccactgctttatgtttgcttcccgtctacatttgggctcctcccattctttccttcttcggcgaggctcctcacatctctaaggccgcagggaaattcgcactgtggatgattccacaactatttgcatattcagccaacttcccaatacagaagttcttacagtcccaggggaaagtgcttgtgatggcttggatctccggggtggttctgattatacacgcagtctttagctggctattcatcatatactttaagtgggggcttgtagtgcagccatcaccctcaatacctcatggtggcttgttgtatcggtcagctttgtatatttaatcactaaatcagacggtgcwtggagtgatttctggcttgcgtttcgtgacctctatggatttgtcaaactatctctagcttctgctgtcatgctctgtttggagttttggtatttgatgattctggtcgttgtcacgggtcttcttctaatccattgatacctgtcgatgccatttccatctgtatgaacatagaaggttggacggcaatgatttcaatcgggtttaacgctgctataagtgtgagggtttcgaatgagctgggtgcaggaaatgcatatctagccaaattcgcagtgatagttgtctccataacatcaacccttatcggggtcgtgtgcatgattgttgtcttagccacaaaagatagcttccctcatcttttcacttctagtgaagctgtggccgcagaaaccacgagaatagctgtcttgttggcctttactgtccttttgaacagcctccagcctgtcttgtcaggtgttgctgttggagctgggtggcagagtctagtggcatacgtgaaccttgcgtgctattacattattggacttcctgctggtcttgttcttggattcacactwaacctcggagttcagggaatatggggaggtatggtagctggaatctgcttacagacacttatattgattggaataatctactacactaactggaacaaagaggcagagcaagccgagagtcgggttcagagatggggaggaacggcgcgggagtgatcaaccctatgtaggacgaggatcatttgttcgggtttagcaaattgttattcctgtggactatatcttttgacttcttgttggataatgtcgtgacttggtcaccatcctagatattcaaatttgtctttattgtttagacgaaaattttatctcttwaaaaaattaaactgaaaaccca

SEQ ID NO: 1264 - DNA, 1955 bp, Arabidopsis thaliana
gagaccaagacagatcgttttattttctcttctgggaatctcagctttttttaaaaaaatatccagagtccagatcatcgtattcaatttgattaatcataaatcagatttcatttcgttatcctttcccaggattcaatttcttcgaatccgatcgaatttcgaatattttcaatccgagttcgagcgttcatggcttccttgtcttgtcattaatgcttttggttcgaatccataaaaatcattgatttcacctattttcagaaatcagaaataatgggtttatcaaatgacaggatcaaattcaacgttggtggcagaatcttcgaaacgacagcgacaacgctcgctaacgcaggtcgcgattccttcttcggagcattattcgacgaaaattggaatctttcacaacccggggatctcttcatcgataggaatccagattgcttcgctgttcttctcgatcttctccgaacaggagacttaaacatcccgcctaatatcccggagcgtctccttcacaaagaagcaatgttctacggcttaatagaccacttacgaaccgcaaagtggggacctttcgacggtaacagactccacctatctcgttccgtcaccggcatagctcctggagacggaacggcgataagagctggtccggatggtggatgctgcatagctcatgggagtgtcgtccatgtctttgattggatgcttgaggagcatccaacgattaatcttgattaccagagagtgaacgatgttggttggattgattctggtaacattgtactctctgcttgtgagagattaggaagaggagatggaggaatgggattgtttagctcatcttctggtgagcttaggtataagtttcaggttagtcatgataatcaggttaagagttatagtgctggagctttgagttttagtcctgattctaagatctttacgagctgtaaaggaagaagtaatgagtatgggattggagtttgggatcaaagtactggaaagcaagtagatttcttttacgagagtcctggttggtctttaggagatgctgataagttgcaatggttgagtggtaagaattgtcttcttgtagctactttgtttccaaggaaagataactgttatattagcttgttggatttccgagagaagaacatggtctggtcttggtctgatatcggatttcttacaatggcggaagagaagagagtgagagacgcgatagcaatggaagagagcaattcgatatgtgtggtgaatgagtttgaagatctagggtttattgatctgaggatggatggaggagggagtagtgtgaggtggagttctaggagcaggttgatgaaaagcaagatgcctgatgagccttgttaccccaaacttgctttgcatgaaggccagctcttctcgtctatgaatgattccatctctgtgttttgtggatcagactgggttttgacttctaggttgaaaagaagctatggcggctccatttgtgatttctctattggtggggataggttgtttgcattgcacagtgaggagaatgtgtttgatgtgtgggagactcttcctcctcccatcatctgatttcacattttgatatcttgagcttagtctggtctgtttctgttgcttctggtttgcttcttttgttaatgttttagggttgttagaaaatatataggatgagagaaatagcaatagtcaagagaatataaacatagagaacatgatcatagacttttgttaggattgatattaatacgattttaagtttccagtttcaggttgtgttctgttttgtccttatatgactctttctcaatgtaaagaattaatcctcttttgacctttagctttaagctcctttcatggtggtgtgaactgtgaccacagtctcagatttctaaagatttgatgattcgctcccttattttgga

SEQ ID NO: 1265 - DNA, 2202 bp, Ricinus communis
gagagagagagagatatcagcattaaacaaatgagagagattatataagagaaatgagtcgacgtttttgaatttcaacagctataaattctctaatttccctctgttaatttccataaaattcaatacccatctccaaaaaccttaccttttcaaaacccagatctcagtttctttcaatttgatgaaaattttgttccttttgatcaatctttatacttctctgtttttgaagttctgttattttgtttggctgcctcaagcgacaggaacttgtgttgttgacttctttgttcaagaatcagcctgaaacttcgttcttttgcatctttctatccttctgtctgtataatcctcttatgatgatggtcttgtagcgattaaattacccagttattgaaattttatttttaatccatttatttatctcaaagtaaaacaaacacaatcccataattccctccagctttccaggaaaagatttgtctgattctcttatttttgaattctgtcttcagtgtgtccgattcttaaactatccagttaccacctctgattctcaattcaatttcctctgttttctctgtttttaaatccattaaacccttcaaattctccattaaaattccaacatgaaaattcccaaagatagaatcagattcaatgtaggaggcagaatctttgaaacaacctcaacaactttagctaatgcaggaagaaattcattttttggtgcattatttgatgataactggtcgtttatcatcaatgatacgaatcccaatagtgaattctttattgatagaaatcctgattgtttcagtatcctccttgatctcctccgcaccggtgatcttcacatcccttctcatgtccccgaaagaatgcttcataaagaggccgcattttatggtcttttagaccatgtaagatcagccaaatggggtccatttgatggcaataggctccgtcattcccggtcagtgaccggtcgggccccgggggatggcactgccattcgtgctgggccagatggtgggtgctgtgtagctcacggtagcatggttcatgtgtatgattggatgatggaagaacacccaccaattaatcttgattatcaaagagttaatgatgtgggttggattgattctgagaatgtgattgttagtgcttgtgaacgattaggccgtggtgatggggggatgggattgtttagtaagagtactggggagttgaggtataagtttcaagtttgtcatgaaaatcaatttaagagttatacagctggagctttgagtactagttctgattatagaatttttactagttgtaaaggaaggagcaatgagtatggtattggagtgtgggaccaaattactggtaaacagattgatttcttttatgagagtccaggttggtcattaggtgatgctgataaattgcagtggttgaatggaagtaattgtttgttggtggctactttgtttcctagaaaggataattgttacattagtttgttggattttagagagaagaggatggtttggtcttggtctgatattggtgctcctataactgtggatgagaaacgagttcgtgatgctatagctatggaggattgtaattctatttgtgtggtgaacgagtatgaggatttggggtttatggatttgagaattagtggaggaagtgtgaggtggagctcaaggagtcgactgatgaaggggaagatgcctgatgagccttgttatcccaaactggcattacatgagggacagttgttttcatcaatggatgattgcatatctatgttttgtggtcctgactgggtattgacatccaggcttcgacggagttatggaggttcaatttgtgatttttcgattggtggagatcgactctttgcacttcacagtgaggaaaatgtctttgatgtatgggagactacacctcctccaattatatgattcagcttataaggtgtgcttggttttgcagttaatgtttcttacatttagatataagttcttcctcacatattttcccccataatttatagaggatagaagatggatttctagttaagcttttaggttagataaaaatagctagggaatggaaatgttttatgtgtatatagccttcaaataccatgtaacttagagcaatgagtttgtatgggttttgcccattctcccagaa

SEQ ID NO: 1266 - DNA, 2044 bp, Gossypium hirsutum
agatcaatgtcagagagggaactcaaagaacataaaaaggagagagagagagaggaagagtcagtttatttgaaatttagacgctccaattctttaattctgcttcaccaaattccacgaaattcaaaacccagctttaaaaacctagcctttccaatacccagatctcaatttccttcagtttgattaaatttgcctcgtttaattcrtttcccctgtttctcgttcaaccagagcatcttctcttatagttcaaaaaaactgagcttttcattcatctttctttgttattagtttcgcagctagctatctttgattcctcttttgttcttaaattatctctaaattctctagaatttatatatcctctgccttgtatttttttcccaaacgctcaattcccagaccaaaaccaaattttacctctgtgtttcgatccaggattcttgaaactttgacaaagagtcgagccatgggagtccaaaaagatgtagtgaaattcaacgtagggggcagaatctttcaaacgacggcgacaacactcgcaaacgcaggcagggattcttttttcggtgcattgtttgacgacaattgggacttacaacaaccaccaaacaaccgccaagaattctttatcgacagaaaccccgactgtttcgctgtcctcctcgatctcctccgaacaggcgatctctacattccttccaatgtcccagaaaggcttctttacagagaagccatgttttacggcttaattgaccatgtccgttcggccaaatggggtccatttgatggtaacaggttaaagctatccaggtcagtaacgggacgagctccaggggatggaaccgccatccgagctggtccagatggcggctgctgcgtagctcatggtagcatggttcatatctttgattggatgttagaggaacacccgccaatcaatcttgactaccagagagtcaacgacataggttgggtcaactcggagcatgttttgataagtgcttgcgaaaggttagggaaaggagatggtgggatgggcttgttcagttcatcaactggagatttgagatacaagttcaacgttgttcatgataatcaaattaagagttacaccgctggggctttgagtttcagtccagattataagatttttgcaagttgtaaaggaagaagcaatgaatatgggattggggtttgggaccaagttactggtaaacaaatggatttcttttatgagagtcctggctggtcccttggtgatgctgataagctccaatggttgaatgagagcaactgtttattagttgccacgttgtttcccaggaaagataactgttacatcagtttacttgattttagggagaagagaatggtttggtcttggtctgatattggtgctccatttactgttgatgagaagagagtgagagatgctattgcaatggaggaatgtaattctgtctgtgtagtgaatgagtatgatgatttggggttcatagatttaagaatcaatggaggaagtgtgagatggagttccagaagtaggttgctcaaggggaaaatgcctgatgagccttgctaccccaaattggcattgcataatgggcagttgttttcatcaatgaatgactccatctcagtgttctgtggtcctgattgggtcctaacatcaaggcttcgaagaagttacggaggttccatctgcgatttctccatcgggggtgatcgtctcttcgcgcttcagagcgaggaaaatgtgtttgatgtatgggaaactccaccgccaccggttatatgattcaactcacggttgtagcagtcttttctttttcgttttttgttagtaaaagaacatagtggatgaacttacaattaagacaaaaaatcatataggttaggcaaagattacagccttaaaaggctcatatttaaagtcttgtactgtacagagtttgcttgcatgctgtttcaaagaaatgaaaattgattgctcaacgattatctctcaccctctccggcgccccgtcgacgcggccgc

SEQ ID NO: 1267 - DNA, 2180 bp, Nicotiana benthamiana
aaaaaagagagagaaaagatcaaaagcaaaacataacaagattcaatttttttgaaacccgacaccctccaattctccttttctcatttctagaccaaaaatctttgaaaaaatattcaaaacccatctctaaaatccttcaatcttaatacccagatcatagattttttaaaattttgatattttcttctatatttctctctgaccaccattttcctctgttttccttctttgtgatcatcattatgataggtgtcttactgtcttttccacgtgatttggcatttgaggctgtgtcctcttaattgtattgagtcttgaattcaaaattttcagtataattaattgtttgttcataaaaattccgttttgattactacctactttaattcttgaagttattgctcctgtattttctcaattcaactttgaatttcaagagccctgtttttttcttgactcatagtatcagatactgaaatttgaataatgggaattcaaaaagatagggtgaaatttaatgttggtggtagaatttttgaaacgacaactacaactttggcgaatgctggtcggaattcgctatttggagccatgtttgataatgattggaacctaaattctgatgccacaaccactgaacatttcattgataggaaccctgattgtttctcagtccttcttgacctactcagaacaggagagctttatttaccacaaaatcttcctgaaaaattgttatatagagagtctatgtattatggtttgttagatcatgtcaggtcagctaagtggggtccgtttgatggaaacaggctcggcctagccaagtcagtgacaggccgagctcctggtgatggcacagccatccgggctggcccggatggcgggtgctgtgtggctcatggtagtatggttcatgtctatgattggatgttagaagagcaccctgctattaatcttgattatcaaagggtgaatgatgcagggtgggttgattcggagaatatcgtgttaagtgcttgtgaaagattaggtaaaggggatggaggtatgggattgtttagtgcatccaatggggagctaaggtacaaatttcatgtcaaacatgaaaaccaagtgaaaagttatacagctggtgcattgagttttagctcagattataagttgttttctagttgtaaaggtagaagtaatgagtatgggattggtgtatgggaccaagttaccggaaaacagatagattttttctatgagccacctggttggtctcttggtgatgctgacaagttgcaatggttacatggtactaactgtttgttggttgctactttgtttccaaggaaggacaattgttacatcagtttattggattttagggacaagagtatggtttggtcatggtctgatgttggcgctcctataacggatgagagaagagttagggacgcgatagcaatggaggaaacaagctcaatttgtgtggtgaatgagtatgaagatttggggtttatggatttgaggagtgctggaagtgtaaggtggagttcaagaagcaggttgatgaaggggaaaatgccggatgagccgtgttatcctaaactggcattgcacgaggggcaattgttctcatcgatgaacgattgcatatctgtgttctgtggtcctgattatgttcttacgtcaaggcttcgacgaaactatggtggttctatttgtgatttctcaattggtggcgatcgtcttttcgctcttcatagtgaagaaaatgtatttgatatatggtaaactcctactccaccaattgtataacaacaacaacaacaacaaaaagaaaaaaaccagagaaatcccacatgtggagtctagcgagggtaatgtgtatgatttcgacagacattacctataccttgagaaagtagagatgatatttccgatagacctccaccaattgtatgatttttatgttttgttatccatagatgagtgagttttgttctctttttttcttcagattgttaagagtgatgtatcaagaaactacaacagatgattttaggatagagaaactaaatagaattcagtgtgtaatactatcaagattgtgagtttgtgtatctacatttgaaactgacatattaaggaaactgattgattagcaatcaaatatttcaactttt

SEQ ID NO: 1268 - DNA, 2204 bp, Populus trichocarpa
ggaaggaagaccaagggaaaaatagacgtggaaaaacaaagagagagggagagagatttcagatataaataaatcaaaatggaacaatattttttgaaatccaagtgcttcaattctccaattcctctctaccaaattccttaaaaattaaaaacccacctctaaaaaccttccctcttcaaaacccagatcttaattttccttattttcatcaaattctttacctttttgaacccctatatctgtatgtcccctgtctcaagctctgtttttgttcaagttctgtttttttgaacttctctcagttccagaatcaggccttgtggttcatgtgtttatgagctttctgtctctgttctcttcatgatcttgtctattttggtttctctttttaaagggctagtttttcctatttttagctcaaccaaactacatccaaattaacacaacacgatcccccgattccctccaacgttttaggaaactttatctctccttcaaattatatctacacgcactcctccatttttctcataattctaataatatcgaattcctaactttctctgtttcaaaattctgcctctcaaaactcattttcaccatgaaaatccccaaagacagagttagattcaatgtaggaggcagaatctttgagacgacctcaacaacgttagcaaatgcaggaagaaactccttttttggtgcattgtttagtgaaaactggaccttaaaacaaccaaatactgactcattttccaattgtgaattcttcattgacagaaaccctgattgtttctctgttctccttgatcttcttcgcaccggcgacctcaatatccctcctaacgtctctgaaagacatatttacagagaggcctccttttatggtttattagaccatgtaagatcagcgaaatggggccaatttgatggcaacaggctccgccattcgcgttctgttacggggagggcaccaggggatgggaccgcgattcgtgctggtcctgatggtgggtgctgtgtggctcatggaagcgtcgttcatgtttatgattggattatggaagagcaccctccattgaatcttgattatcaaagagtcaatgatgttgcctgggttgatagtgagaacataattattagtgcctgtgagagattaggccgcggagacggagggatggggttgtttagtaagagtacaggagaattgaggtataagtttcaggtgtgccatgagaatcaagtgaagagtttcacagccggggctttaagtactagttcagattataagatatttagtagttgtaaaggaaggagtaatgagtatggggttggagtttgggatcaggttactggaaaacagattgatttcctttacgagagtccaggttggtcattaggcgatgctgacaagttgcaatggttgaatgggagcaattgtttgttggtggccactttgtttcctaggaaagataactgttacattagtatgttggattttagggataagagaatggtgtggtcctggtctgattttggtgctcctataactgtggacgagaagcgagttcgagatgctatagctatggaggatagtaatgctatttgcgtggtgaatgagtacgaggatttgggatttatggatttgagaatgaatggagggagtgtgaggtggagctcaagaagtcggatgatgaaggggaaactgtctgatgagccttgttatcccaagctggcattacatggggggcagctgttttcatctatggatgactgcatttctgtgttttgtggtccggactgggttttgacatctaggcttcgtcagggttatggaggttcaatctgtgacttttcgattggtggggatcggctctttgcgcttcacagtgaggaaaatgtatttgatgtatgggagactccacccccaccaatttcatgattcaggtcatggtctgcttggctttatagccatgcgtaatatatcttacaaatggtttttctttcttttcctcgtcaacttatagaaaatgatagaagatgaatcttgttagaatttacagcatagagaaaccttgatatagagaggtctaatagttttgtgtgtgtacagattataactatcatataatctcgagtgctgaatttgtatgggtttttgacgattgtcacagaaatgaaacagattgtttgttactaca

SEQ ID NO: 1269 - DNA, 1969 bp, Populus trichocarpa
aggaagaccaaaggaaaggcagatagacgtggaaaaacaaagagagagagacatggagaaagaatgtaagagagagaaatggatatatattaaaatgaaccgatatttcttgaagttcaacagcttcaattttccaattcctctccaccgaatccctcaaaattgagaacccacctctaaaaaccatccctcttcaaaacccagttcttattttctcttaatttcatcaaattttcaatcttttttttgtaatcactgcatctcccctgtttcaagctctgtttttactcaagttctggtttcctgaacttctctcagttccaaaatcagaccttttcattcatgtgaatatagctttctatttctgctgtctttatgatcttgtctgttttggtttcttcttgaatgggttaattttgtcctatttttggctcaaccaaaacaaattcaaatttatagaacacgatcccccaattccctctaactttcttggagattttttttatccatctctatttttcaaattctatacacactcttactcctccagttttcctttctttccactgataacaaattttaaaccttctctctttcaaaattctgcctcacaaaacttattttcactatgaaaatccccaaagacagagttagattcaatgtgggaggcagagtctttgaaactacctcaacaacgttagccaatgcaggcagaaactccttttttggtgcattattcaatgaaaactggaccttaaaacaaccaaataatgactcgttttcccattgtgaattcttcattgatagaaaccctgattgtttctctgttctccttgatctccttcgcaccggcgacctcaatatctctccaaacatccctgaaagacaactctacagagaggcctccttttatggtttattagaccatgtaagatcagctaaatggggccaatttgatggcaacaggctccgccattcgcggtccgttacaggacaggcaccgggggatgggaccgcgattcgtgctggtcctgatggtggctgctgtgtggctcatggtagtgttgttcatgtttatgattggattatggaggagtaccctccattgaatcttgattatcaaagagtcaatgatgttggctgggtagatggtgagagcataattattagtgcttgtgagaaattaggccgcggggacggagggatggggttgtttagtaagactacaggagaattgaggtataagtttcaggtttgccatgagaatcaagtgaagagtttcacagctggggctttaagtactagttctgattataagatatttagtagttgtaaagggaggagtaacgagtatgggattggggtttgggatcaagttactggaaaacagattgatttcttttacgagagtccaggatggtcattaggtgatgctgataagttgcaatggttgaatgggagcaattgtttgttggtggctactttgtttcctaggaaagataactgctacattagtatgttggactttagggataagaggatggtatggtcttggtctgattttggcgctcctataactgtggacgagaagcgagtgcgagatgctatagctatggaggataataatgctatttgtgtggtgaatgaatatgaggatttggggtttatggatttgagaatgaatggagggagtgtgaggtggagctcaagaagtcggatgatgaaagggaaactgtctgatgagccttgctatcccaaactggctttacacgaggggcagttgttttcatctatggatgactgcatttctgtgttctgtggtcctgattgggttttgacatctaggcttcgccagagttatggaggttcaatctgtgacttttcaattggtggggatcggctctttgcacttcacagtgaggaaaatgtatttgatgtatgggagactccacctccaccaatttcatga

SEQ ID NO: 1270 - DNA, 2020 bp, Solanum tuberosum
gatcaaaaaaaaaaaagagaattaaaagagtagaaaagaaaaaaagatcaaagaaaaaacacaacaaaattcaatttttttgaaacccaataccctcccaagtccaaatccaaccaaaattctctcaagaaaattcaaaacccatctctcaaatcctttaatcttcaatacccatatcataaattttgtcaaaattgaatcttttcttctttttccaccattttccctctgttttttccttctttttggtcataatcatgataggtgccttgttaggaccattaaaaatcagttcttttccatattggtccttgtaagaagtcttgaattcaaaattttcagtagaatttaaagagcctttttttgacttctctgtttgtatcttcttcttttttttcaagttaggtgttttttttagttcaattcttgatttcaggtcccctgttttatcagattactgtaaatttgagttatggggattcagaaagacagagtgaaatttaatgttggtggtagaattttcgaaactacagcaacaaccttagctaatgctggtcgaaattctctatttggagctatgtttgatgatgaatggaacttgaattctgatgccacaatcattgaacatttcattgataggaaccctaattgtttctcagtgcttcttgatttgcttagaacaggggagctttatttacctcaaaatcttcctgaaaagttgttgtatagagaggctttgttttatggtcttttagatcatgtcaggtcagctaaatggggtccatttgatggaaacaggctccgtctggcccgttcagtaacgggccaggctcctggtgatggaactgccatccgggctggcccggatggcgggtgttgtgtggctcatggtagtatggttcatgtgtatgattggatgatggaggaacatcctcctattaatcttgattatcaaagggtgaatgatgctggttggattgattctgagaatattgtgttgagtgcttgtgaaagattaggtaaaggggatgggggtatggggttgtttagtgcatcaactggggagctaaggtataaatttaatgtcaaacatgaaaatcaagtcaagagttatactgctggcgcgcttagttttagttcagattataagttgttttctagttgtaaaggtagaagtaatgaatatggtattggtgtatgggatcaagtaactgggaaacagattgattttttctacgagccgcctggttggtcacttggtgatgctgataagttacaatggttacatggtacaaactgtttgttagttgctactttgtttccaaggaaggataattgttacattagtttgttggattttagggataaaagtatggtttggtcatggtctgatattggcacgcctataactgacgagaggagagttagggacgcgatagcaatggaggaaacaagttcaatatgtgtcgtgaacgagtatgaagatttggggtttatggatttgaggaggaatgctggaagtgtaaggtggagttcaagaagcaggctgatgaaggggaaaatgccagatgagccatgttatcctaaactggcattgcacgacggacagttgttctcatcgatgaacgactgcatctctgtgttctgtggccctgattgggtacttacatcaaggcttcgacgaagctatggtggttccatttgtgatttctctattggtggtgaccgtcttttcgctcttcatagcgaggaaaatgtgttcgatatatgggagacgtcgcctccaccaattatatgatttttatgtagttttggaggtgtttaagtgagtgattttgttatctttttcttcaggttgttaaagagtgactaatgtagatgtttttaggatagataaattgaatagaaatcagtgtttgtaatactttctagatttgtgaagtttgagtatacatatgaaaaactgacatgttaaagttaaaggaaaatgattgcttagcaatcaatatttcaaattttt

SEQ ID NO: 1271 - DNA, 1788 bp, Glycine max
ctgttctctgatcctatcacacacacccttccatccttccttcccctttgctttaattccaatccttcaaccataatcattcactcatctctcttcaccaaaagaaaggacatccctatttattcgccactcattttgtggcagttacacctctgcttctctgttcatccatccaattcaacccagaggcgttgaattgaacgaaccccatctccgggtttcttgaaaagtcacaaacttgggaggaatcaaaccatgggggttcaaaaagacagggtgaaattcaacgtgggtggcagggtgatggaaacaacatccacaaccctcgccaatgctgggcgcaattcaatgttcggcgcaatgttcgacgacaattggaacctaataccaaacaacgacgacaacaacaacaacgaaagattcatcgatcgcaacccggattgcttcgcgattctcctcgatctgctccgaaccggcgagctctacgtcccacccgatatcccggagaagctcctctacagggaggccctctactacggcctattggaccacgtgcgcgccgccaagtggggcccattcgacggcaacaggttaaggttgtcgcggtctctgcagggccaggcaccgggcgacggaaccgccattcgggcgggcccggatggcggctgctgcgttgcgcatggcagcatggttcatgtctatgattggatgttggatgaacacccacctcttaaccttgattaccagagggtcaacgatgttggttgggttgactccgacaacatcgtcatcggagtcagcgagcgccttgggcggggcgacggcgggatggggctgttcagctcccacaccggagagcttaggtacaagtttcacgtttgtcatgacaatcaggtgaagagttacactgctggggctttgagttttagttcggattacaagatattttctagttgcaaagggaggagtaatgagtatggggttggagtttgggaccaggttactgggaagcagattgatttcttctacgagcctttggggtggtctcttggggatgctgataagcttcagtggatggaagggagcaattgtttgttggtggctaccatgtttcctaggaaggacaactgttacattagtcttttggatttcagggacaagaagatggtgtggtgttggtctgatgtgggggctccttttgccgtggatgagaaacgggtcagggatgctattgccatggaggataataactccatttgtgtggtcaatgagtttgaggatttggggttcatggatttgagaagttctgctgccaatagcattaggtggagctccaggagtaggttgatgaaggggaagatgcctgaggaaccttgttatcctaaactggcattgcatgggggacagcttttttcgtccatgaatgattgtatttcggtgttctgtggtcctgaatgggttttgacgtctaggctcagacgaagctatggtggttcaatttgtgatttttccattggaggggataggcttttcgcgcttcatagtgaggagaatgtggttgatatttgggagactccaacaccaccaattatatgattttagttttttagtgataagttacttttctttggtttgctgtaaaccagactgcttctggttttctagatagagttgagtttaaaaacttggatatacgagattgagtagtttatagcttggcatacatgtaggtcttacctatactgaagatgtaatggattggggtatgtgaatatctatagaaaaaaa

SEQ ID NO: 1272 - DNA, 1353 bp, Glycine max
atgggggttcagaaagacagggtgaaattcaacgtgggtggcagggtgatggaaacgacatccacaacccttgccaatgcagggcgcaattcaatgttcggggcaatgttcgacgacaattggaacctcataccaaacaacgacaacaacaagaacgaaagattcatcgatcgcaacccggattgcttcgcgatcctcctcgatctgctccgaaccggcgagctccacgtcccacccaacatcccggagaagctcctctacagggaggccctctactacggcctattggaccacgtgcgcgccgccaagtggggcccattcgacggcaacagattaaggttgtcgcggtccctgcagggccaggcaccgggcgacggaaccgccgtccgggcgggcccggatggcggctgctgcgttgcgcacggcagcatggttcacgtctatgactggatgttggaagaacaccgtcctctgaacctcgattaccagagggtcaacgatgttggttgggttgactccgacaacgtggttatcggagtcagcgagcgcctcgggcgaggtgacggcgggatggggctgttcagctcccacacaggggagctgagatacaagtttcacgtctgtcatgacaatcaggtgaaaagttacactgctggagctctgagtttcagttcggattataagatattttctagctgcaaagggaggagtaatgagtatggtgttggggtttgggatcaggttactgggaagcagattgatttcttctacgagcctttggggtggtcccttggggatgctgataagcttcagtggatggaagggagcaattgtttgttggtggctactatgtttcctaggaaggacaactgttacattagtcttttggatttcagggacaagaagatggtgtggtgttggtctgatgtgggggctccttttgccgtcgatgagaaacgggtcagggatgctattgccatggaagataataactccatttgtgtggtaaatgagtttgaggatttggggttcatggatttgagaagttctgctgccaatagcattaggtggagctccaggagtaggttgatgaaggggaagatgcctgaggaaccatgttatcctaaactggcattgcatgggggacagcttttttcgtccatgaatgattgcatttcggtgttctgtggtcctgaatgggttttgacgtctaggctcagacgaagctatggtggttcaatttgtgatttttccattggaggggataggcttttcgcgcttcatagtgaggagaatgtggttgatatttgggagactccaacaccaccaattatatgattttagttttagttt

SEQ ID NO: 1273 - DNA, 1954 bp, Hordeum vulgare
gccccacacaccaagagcaagagcgagaggatcactcccagaatcaccggctaagcttaagctccctcgtgatctcaaaaccacctctttttccccccactttccacctcgtgctcaccgacggggtccctccctgccatggaggccgtcggcgtcgcccccgcccccgcggcggtggcggtggcggagcagaagatgaagcttctcgagccgaggaaggagcccctcgcctccgccgccgccgccgccaaggcgccgtgcaagtgggcgatgaagaagaagctcgtgggcggcgacgccggctacgtgctcgaggacgtgccccacctcaccgactacatgcccgagctcccgacgtacccgaatccactccaggacaaccctgcctactcggtcgtcaagcagtacttcgtcaacacggacgacaccgtcacgcaaaagattgttgttcgcaagaccagtgcgagaggcacacacttccggcgcgccgggccgcggcagagggtctacttccagcccgatgaggtgaacgccgccatcgtcacctgcggcggcctctgccccgggctcaacacggtcatccgcgagctcgtctgcgggctgtacgacatgtacggtgtcaccagcgtcgttggcatagagggtggatacaagggcttctactctcgaaacaccgttacgttgacacccaagtcgtgaatgacatccacaagagaggggggaccattcttggaacttcaaggggaggacatgacactgccaaaattgtggatagtcttcaggaccgtggcattaaccaggtctacattattggaggtgatggtacccagcaaggcgcttccgtaatatatgaggaagtacgtagacggggcctcaaatgtgcagtggttggtgtcccaaagaccatagataatgatatcgcggtgattgacaaatcttttggatttgacactgctgtcgaggaggctcaaagagctatcaacgctgctcatgttgaagctgaaagtgcagagaatggcattggtgttgtgaagttaatgggccgcaacagcgggttcatcgcaatgtatgctactctagctagtcgtgatgtggattgttgcttaatcccagagtctcccttctaccttgaaggaaaagggggcctccttgagttcgtcgagaaacggctcaaggacagtgggcatatggtcattgtggtggccgagggtgctggccaagatcttatagcccaaagcatgaattttgtggacactcaggatgcttctggaaataagctgcttctggatgttggcctttggctatcccagaagatcaaggatcatttcaagaagaagactaacttccccataactctcaagtacattgacccgacatacatgatccgcgcggtccggtcaaacgcctcggacaacgtctactgcactctgcttgcgcacagcgccctccatggcgccatggcaggatacagtggcttcaccgtcgcgcccgtgaatggcagacacgcttacatcccattctatagaatcaccgagaagcagaacaaggtcgtgatcactgataggatgtgggcgagggtgctgtgctcgacgaaccagccgtgcttcctcagccacgaggacgtggagaacatgaagcacgacgacgacgagcgccaccacctgcacaacacgcagctcctcgacggcgcaccggcaaagtgttcacccaactgtaatggatcagctggagcagagtgagaggcacaaagctattgggatttgggatggatatattgagcatgtgtagttatagccatcttttttttaactttctcttgtgttttttttagcttgccttgtagtagagacttcaccgaagaattactgtataattataaataagggttccacgatagcaatcttttgtggtaggagctcgattttgtagattagaaaaggataagttttagatt

SEQ ID NO: 1274 - DNA, 1871 bp, Brachypodium distachyon
ggggattactcccagaccacctaattaagctcccctctgtcttgtggtaatcgcggacgggggacaaatttattttctagcgtgtatttaactgcctcgtgcttgccgacggggaagggggccatggaatccgtcgtcgtcgctcctgccgctgctgctcaaggggcggtggcggtggcggagcagcagcagcagaagaagaagcttctggaccagaagatggagctgccccttgtcgccgccctgaaggcgcccgcgccggcgtcgccgtgcaagtgggcgatgaagaagaagctggtgggcggcgacgcggggtacgtgctcgaggacgtgccccacctcacggactacatgcccgagctcccgacgtacccgaatcctctgcaagacaaccctgcgtactcggtcgtcaagcagtacttcgtcaacacagacgataccgtcacgcaaaagattgttgtacataagaccagtgcgaggggcacacacttccggcgtgccggaccacggcaaagggtgtacttccagtccgatgaggtgaacgcggccatcgtcacctgtggcggcctctgccccggcctcaacacagtgatccgcgagctcgtatgcgggttatgcgatatgtacggtgtcaccagtgttgtgggcatagagggtggatacaagggtttctattctcgaaacacggttccattgacaccaaaatccgtgaatgacatccacaagagagggggtaccattcttggaacttcaaggggaggacacgacactgccaaaattgttgatagtcttcaggaccgtggtattaaccaggtttacattattggaggtgatggtacccagcaaggcgcttccgtaatttatgaggaagtccgtagacggggcctcaaatgttcagtagttggtgtcccaaagaccatagacaatgatatcgcggtgattgacaagtcttttgggtttgacactgccgtggaggaggctcaaagagccatcaacgctgcacatgttgaagctgagagtgcagagaatggcattggtgttgtgaagctaatgggtcgcaacagtgggttcatcgccatgtatgctactctggctagtcgagatgtggattgttgcttaatcccagagtcaccattctaccttgaaggaaaaggagggctccttgagttcatcgagaaacggctcaaagacagtggccatatggtcattgtggtggccgagggtgctgggcaagatctcatcgcccaaagcatgaactttgtggacactcaggatgcttctggaaataagctgcttctggatgttggcctttggctttctcagaagatcaaggatcatttcaaaaagaagaccaacttccctataactctcaagtacattgatccaacatacatgatccgtgcagtcagatcaaacgcctctgacaacgtttactgcactctgcttgcgcacagcgccctccatggcgccatggcagggtacaccggtttcaccgtagctccagtcaatggcaggcatgcctacatcccattctatagaatcactgagaaacagaacaaagtcgtgatcaccgataggatgtgggctagggtactgtgctcgacaaaccagccctgcttcctgagccacgaggatgtcgagaacatgaagcacgacgatgacgagcaacaccacctgcacaacacgcagctgctcgatggctcaccggcgaagtgctcaccaaagtgtaatgggtttgctgcaccactgtgagaggaacgacagtatttagatggatatattgagcatatgtatagcttctcgtctttttttagcttgccttgtaggtaccacgaagaattaatgtatgatacaataagggtttcacaatt

SEQ ID NO: 1275 - DNA, 2082 bp, Zea mays
gaatgcccaaaatcctggggaatattccactttccctatacattacattacatacacgccggagcggcatttctttcgtcctctccaaaccgtgtaaataaacgggaaccttctatcctcccccttttgggttcggtcctcctccgtccgtcgccgtcgtcaaacctcaagcgcgacgtgtgtaaacggcccgcgccttcggcagacgccaacaacagactcagactatactcgcagcagaaaggttagttagctgagctccgcggggggtcgaaccgagactcttcgtcgcgcgcgccgcagggccagcccagcaggcggcggacgcgaaagcttgctcagctctgtgttcaccggcggcacgggccgtcccggcgatggaatccttcggtgtccctcctgcgcccgtggcggcgccggagaagaggaagaagccgctcgacctcaaggaccccgtccccgccgccgccgccgccgccgccaacggcggcggcgccaccaaggcgtccccagcggcgaagtgggcggagaagaagaagctggtgggcggcgacgccggctacgtgctcgaggacgtgccgcacctcacggattacctgccccagctcccgacatacccgaaccccctccaagacaacccggcgtattcagtcgtcaagcagtacttcgtcaacccagacgacaccgtcacgcagaagatcgttgttcacaagaccagcgccaggggcacccacttccggcgcgccgggccacggcagcgggtgtacttccagcccgacgaggtgaacgccgccatcgtcacctgcggcgggctctgccccggcttgaacaccgtcatccgtgagcttgtctgcggcctgtatgacatgtacggcgtcaccagtgtcgttggcatagagggtggatacaagggtttctattccaaaaacacggtcgcgttgacaccgagatcagtgaacggcatccacaagagaggcgggacggtcctgggaacgtcgagaggagggcatgacactgccaagattgttgactgtcttcaggaccgtggtattaaccaggtctatattatcggcggcgacggtactcagaaaggcgcctctgtgatttacgaggaagtccgtagacggggcctcaaatgcgctgtggtcggcgtcccaaagaccatcgataatgacatcgcggtgatcgacaagtcgttcggatttgacactgccgtggaggaggcccagagggccatcaacgctgctcatgtcgaggctgagagtgcagagaacggcatcggtgtcgtgaagctgatgggtcgcaacagcggtttcattgccatgtacgctactctagctagccgcgacgtggactgttgcttaatcccggagtcgcccttctaccttgaagggaagggagggctccttgagtttgtcgagagacggctcaaggacaacggacacatggtcatcgtggtggccgagggtgctggacaggatctcatcgcgaaaagcatgaattccgtggacacccaggatgcttcgggaaataagctgcttctggatgttggcctctggctatcccagaagataaaggatcatttcaagaagaagccccgtttcccgataactctcaagtacatcgacccgacttacatgatccgcgccgtcagttcaaacgcttccgacaacgtctactgcactctgctagcccacagcgcgctccatggcgccatggcggggtacaccggcttcatcgtcgctccggtcaatggcagacacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgctgctcctggactcgccggaaaactcgtccaaatgaaatggggcacaagacttgttttgcttttttgggtgctggcgttgtagagattagcgaccgctatatgatagggttggataatgtgagcattttgtaataatataagcttcctgaagta

SEQ ID NO: 1276 - DNA, 2072 bp, Zea mays
accccaaccaatcccaagtctcatcacgaggacgaaagagagaagagaactcgtcgctctccctgtcaattcactcgccggacagtagcgccccctcctccgatcgattcggtcagtccgccgatcaaccgtcccgagcttgcttggatactgtgctgcgtgcgacagatggagaccgtcaccgtcgttgtcgcgccggctccggtggccgtcacccagcagccaccgcagcacaagctcgccgagttgaagccttcctccttcgccggcgtgccgaaatcgtcgccggcgaccaaggccaagccggccaagacgaagaagctcgccggcggctgtggcgggtacgtccttgaggacgtcccgcacctcaccgactacctccccgagctcaagagctacccgaatcccctacaagaccaccctgcctactctgtcgtcaagcagtacttcgtgaacccggacgacacggtggcgaagaagatcgtggtgcacaagagcggcgcgcgggggacgcacttccggcgcgccggcccgcggcagcgcgtgtacttccagccggacgaggtgacggcggcgatcgtcacctgcggcgggctgtgcccgggcctcaacaccgtcatccgcgagctcgtctgcggcctgcacgacatgtacggcgtggccaccgtctacggcatcgagggcgggtacaagggcttctacgcgcgcaacacggtggagctcacgccgcgctccgtcaacgacatccacaagcgcggcggcacggtgctgggcacctcccgcggcggccaggacacggccaagatcgtggacagcatccaggaccgcggggtcaaccaggtgtacatcatcggcggcgacggcacgcagaagggcgccgcgtccatccacgaggaggtgcagcggcgcggcctcaagtgcgccgtcgtcggcgtgcccaagaccatcgataacgacatcgccgtcatcgacaagtccttcggcttcgacaccgccgtggaggaggcgcagcgcgccatcaacgccgcgcacgtcgaggccgagagcgccgagaacggcgtcggggtcgtcaagctcatgggccggaacagcggcttcatcgccatgtacgccacgctcgccagccgcgacgtcgactgctgcctcatcccggagtcgcccttctacctcgacggcaggggcggcctcctcgagttcgtcgagaagcgcctccgcgacaacggccacatggtcatcgtcgtggccgagggcgccggccaggacctcatcgccaagagcatgaacttcgccgacacccacgacgcgtccggcaacaaggtgctccttgacgtcggcctctggctctcccacaagatcaaggagcatttcaagaagaagcccagcttccccatcaccctcaagtacatcgacccgacctacatgatccgcgccgtgccgtccaacgcctccgacaacgtctattgcacgctgctggcgcacagcgcactgcacggcgccatggccgggtacaccggattcaccgtcgcgccggtgaacggaaggcacgcctacatccccttctacaggatcaccgagaagcagaacaaggtggtgatcacggaccggatgtgggcacgggtgttgtgctccacgaaccagccgtgcttcctgacacaccaggacgtcgagggggcagggttggacgaggaggagccgcagatgccactcgtcgagggcgagaacgccttagtcaggaacccgtccatgtgcaacggcaatggccacctctgcagtggcgcggcctgaaaggcgcagggacagacagctcattcacgtgttacaaatgcggctgtgatgtaggttttctttttgttcattctttggttagtacgatggaataagtattggcgagaggagaattataattagccatgaagcacgcgatctggcccagcgttcacttggtacggaccaatctcggtcctgtggccatgccgtgcttagacaacatactctataaacaatataaatatatgtatatcatataattcataagtaaacaatagctctcttggctagatgattttactact

SEQ ID NO: 1277 - DNA, 2105 bp, Zea mays
attttttcttcctctccaaaccgtgtaaataaacgggaaccttctctcctcccccttttgggttcggtcctcctccgcccgtcgccgtcgtcaaacctcaagcgcgacgtgtgtaaaacggcggcgcagcgcgctatagccccgcccaaaccggcgatatatatatatgtaataacggcccgcgccttcggcagacgccaataacagactcagactatactcgcagcagaaaggttagttagctcgccgcgcgcggggggtcgaaccgagactcttcgtcgcgcgcgccgcagggccagcccagcaggcggcggacgcgaaagcttgctccgtgttcaccggcggcacgggccgtcccggcgatggaatccttcggtgtccctcctgcgcccgtggcggcgccggagaagaggaagaagccgctcgacctcaaggaccccgtccccgccgccgctgccaacggcggcggcgccaccaaggcgtccccggcggcgaagtgggcggagaagaagaagctggtgggcggcgacgccggctacgtgctcgaggacgtgccgcacctcacggattacctgccccagctcccgacatacccgaaccccctccaagacaacccggcgtattcagtcgtcaagcagtacttcgtcaacccagacgacaccgtcacgcagaagatcgttgttcacaagaccagcgccaggggcacccacttccggcgcgctgggccacggcagcgggtgtacttccagcccgacgaggtgaacgccgccatcgtcacctgcggcgggctctgccccgggttgaacaccgtcatccgtgagcttgtctgcggcctgtatgacatgtacggcgtcaccagtgtcgttggcattgagggtggatacaagggtttctattctaaaaacacggtcgcgttgacaccgagatcagtgaacggcatccacaagagaggcgggacggtcctgggaacgtcgagaggagggcatgacactgccaagattgttgactgtcttcaggaccgtggtattaaccaggtctatattatcggcggcgacggtactcagaaaggcgcctctgtgatttacgaggaagtccggagacggggcctcaaatgtgctgtggtcggcgtcccaaagaccatcgataatgacatcgcggtgatcgacaagtcgttcggatttgacactgccgtggaggaggcccagagggccatcaacgctgctcatgtcgaggctgagagtgcagagaacggcatcggtgtcgtgaagctgatgggtcgcaacagcggtttcattgccatgtacgctactctagctagccgcgacgtggactgttgcttaatcccggagtcgcccttctaccttgaagggaagggagggctccttgagtttgccgagagacggctcaaggacaacggccatatggtcatcgtggtggccgagggtgctggacaggatctcatcgcgaaaagcatgaattccgtggacacccaggatgcttcgggaaataagctgcttctggatgttggcctctggctatcccagaagataaaggatcatttcaagaagaaaccccgtttcccgataactctcaagtacatcgacccgacttacatgatccgcgccgtcagttcaaacgcttccgacaacgtctactgcactctgctagcccacagcgcgctccatggcgccatggcggggtacaccggcttcaccgtcgctccggtcaatggcagacacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgctgctcctggactcgccggagaactcgtccaaatgaaatggggcggcagcggcagtgtgaagggggggcacaagacttgttttgcttttttgggtgctggcgttgtagagattagcgaccactatgatagggttggataatgtgagcatttggtaataatataagctcctgaagtaagctcgttttggctgttcgtgtatt

SEQ ID NO: 1278 - DNA, 2028 bp, Zea mays
gcttctctcctcccgctgccccccttcggtcctcctccgtccgtcgccgtcgtcaaacacgacgtttaacgggcggcgcagagcgctaatccagcccaaacacgatatataacggtccgcgccttccgaagacgccaagaacagcctcaggttactcgcagaaaagatttattagctcgccgcgggggtcgaaccgaggctcctagctgatcgcgcgcgcacaaggcgagcggacaagaaagcttgctttgtgctcaccggcgggcggcggcacggaccccctgcgatggaagccgtcggcgtcactcctgcccccgtggcggcgccggagaagaagaagctgcttgacctcaaggaccccttccccgccgccgcgaacggcggcgccaaggcgtccccggcgagtaagtgggcgatgaagaagaagctggtgggcggcgacgccggctacgtgctcgaggacgtgccgcacctcacggattacatgccccagctcccgacatacccgaatcctctccaagacaacccggcgtattcagtcgtcaagcagtatttcgtcaacccagacgacaccgtcacgcagaagattgttgttcataagaccagtgccaggggcacccacttccggcgtgccgggccacggcagcgggtgtacttccagtccgatgaggtgaacgccgccattgtcacctgtggaggcctctgcccgggattgaacacggtcatccgcgagcttgtttgcggcttgtatgatatgtatggcgtctccagcgtcgtcggcatagagggtggatacaagggtttctattctaaaaacactgttgcgttgacaccaaagtcggtgaacgacatccataagagaggcgggactgtcctcggaacctcaagaggagggcatgacactgccaaaatcgttgattgtcttcaggaccgtggcattaaccaggtctatattatcggaggcgatggcactcagaaaggcgcttctgtaatttatgaggaagtccggagacggggcctcaagtgctctgttgtcggtgtcccaaagactattgataacgacatcgcggtgattgacaagtcgtttggattcgacactgctgtggaggaggcccagagggccatcaatgctgctcatgtcgaggctgaaagtgcggagaacggcatcggtgtcgtgaagcttatgggccgcaacagcggttttatcgcgatgtacgcgactctagctagccgtgatgtggactgttgtttaatcccggagtcacccttctacctcgaagggaagggaggactcctcgagttcgtcgagaggcggctcaaggacaacggccacatggtcatcgtggtggccgagggtgctgggcaggacctcatcgcgagaagtatgaattttgtggacacccaagacgcttctggaaacaagctgcttctggatgtcggcctttggctatcccagaagataaaggatcatttcaagaagaagcccagcttcccgataaccctcaagtacatcgacccgacctacatgatccgcgccgtccggtcgaatgcttctgacaacgtctactgcactctgctggcccacagcgccctccatggcgccatggcggggtacaccggcttcacggtcgctccggtcaacggcaggcacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccaccacatgcacaacacgcagctcctggaaggcgggagctcgccggtgtccaaatgcaatggctcggcagcggcagtgtgaggggcacgagaatacgcaaggatatagatatatatagtattaagcatgtagctatggatgttttttttccttttgcttttttgggtgctggcgttgtagagagtatttggtaataataatataatgcttcgctgagattaaatctc

SEQ ID NO: 1279 - DNA, 2093 bp, Sorghum bicolor
gcgacgtttaacggcggcgcagcgcgctaatcccgcccaaaacccgatatataacggcccgcgccttccgcagacgccaagaacagcctcagattactcgcacaaagatttagctggccgcggggtcgaactgaggctcttgatcgcgagcgcacacagggcgagcggacaagaaagcttgctttgtgttcaccggcggcacgggccccctgcgatggaagccgtcggcgtcgctcctgcgcccgtggcggcgccggagaagaagaagctgcttgacctgaaggatcccttccccgccgccgccaacggcagcgccaaggcgtccccggcggggaagtgggcgatgaagaagaagttggtgggcggcgatgccggctacgtgctcgaggacgtgccgcacctcacggattacatgccccacctcccgacatacccaaatcctctccaagacaatccggcgtattcagtcgtcaagcagtatttcgtcaacccggacgacaccgtcacgcaaaagattgttgttcataagaccagtgccaggggcacccacttccggcgtgccgggccacggcagcgggtgtatttccagtctgatgaggtgaacgccgccattgtcacctgcggaggtctctgccccgggttgaacacggtcatccgcgagcttgtttgcggattgtatgatatgtatggcgtcaccagcgttgttggcatagagggtggatacaagggtttctattctaaaaatactgttccgctgactccaaagtcggtgaacgacatccataagagaggtgggactgtccttggaacttcaagaggaggacatgacaccgccaaaattgttgattgtcttcaggaccgtggtattaatcaggtttatattattggaggtgatggtactcagaaaggtgcttctgtaatttatgaggaagtccgtagacggggcctcaaatgttctgttgttggtatcccaaagaccattgataatgacattgcggtgattgacaagtcgtttggatttgacactgctgtggaggaggcccagagggcgatcaatgctgctcatgtcgaggctgagagtgcagagaatggcattggtgttgtgaagctaatgggtcgcaacagtggttttattgcaatgtatgctactctagctagccgtgatgtggattgctgtttaatcccagagtcacccttctaccttgaagggaagggaggactccttgagttcattgagaaacggctcaaggacaatggtcatatggtcattgtggtggctgagggtgctggacaggatctcatcgcgaaaagtatgaatttcgtggacactcaagatgcttcaggaaataagctgcttctggatgttggcctttggttatcccagaagataaaggatcatttcaagaagaagcccagcttcccaataactctcaagtacatcgacccgacctacatgatccgtgccgtcaggtcaaatgcttctgacaatgtctactgcaccctgctagcccacagcgccctccatggtgccatggcggggtacaccggcttcaccgtcgctccagtcaatggcagacacgcttacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgcagctcctggaaggcgagagctcgccggtgaaggacgcgtccaaatgcaatgggacagtgtgaagggcacaagaatacgcaaggatatatattagtattataagcatgtaactatagatggggtttttgtctttttctttttattttgctttttgggtgctggcgttgtagagagtagcgaccactactatagataggcttggataatgtgagcatttggtaataatatatgcttcgctgaagtaagctcagttttggttgtgaatgagctaatagcgctgctacgtgtattaaatttcgtcaggtgagggcaaaattgagctcactacatgttatgctggttacgaac

SEQ ID NO: 1280 - DNA, 1835 bp, Sorghum bicolor
cccaagctttgcttgactgcgatcgatggagaccgccaccgtcgtcgtcgcgccggctccggtgtccatcacccagccgccgcagcacaagcttatggaattgaagccagccttcgccgccgtggcgaaaccgtcgccggcgaggaaggccaagccggccaagaagaagctcgccggcggctgcggcgggtatgtccttgaggacgtcccgcacctcaccgactaccttcccgagctcaagagctacccgaatcccctgcaagaccaccctgcctactctgtcgtcaagcagtacttcgtgaaccctgacgacacggtggcgaagaagatcgtggtgcacaagagcagcgcgcgcgggacgcacttccgtcgcgccggcccgcggcagcgcgtctacttccagcccgacgaggtgacggcggcgatcgtcacctgcggcggcctgtgcccgggcctcaacacggtgatccgcgagctggtgtgcggcctccacgacatgtacggcgtgagcagcatctacggcatcgagggcgggtacaagggtttctacgcgcgcaacacggtggagctgacgccgcggtccgtgaacgacatccacaagcgcggcggcacggtgctgggcacctcccgcggcggccaggacacggccaagatcgtggacagcatccaggaccgcggcgtgaaccaggtgtacatcatcggcggcgacggcacgcagaagggcgcggcgtccatccacgaggaggtgcagcggcgcgggctcaagtgcgccgtggtcggcgtgcccaagaccatcgacaacgacatcgccgtcatcgacaagtcgttcggcttcgacaccgccgtcgaggaggcgcagcgcgccatcaacgcggcgcacgtcgaggccgagagcgccgagaacggcatcggggtcgtcaagctcatgggccggaacagcgggttcatcgccatgtacgccacgctcgccagccgcgacgtcgactgctgcctcatcccggagtcgcccttcttcctcgacggcaagggcggcctgctcgagttcgtggagaagcgcctccgcgacaacggccacatggtcatcgtcgtggccgagggcgccggccaggacctcatcgccaagagcatgaacttcgccgacacccacgacgcctccggcaacaaggtgctcctcgacgtcgggctctggctctcccacaagatcaaggagcatttcaagaagaagcccagcttccccatcacactcaagtacatcgacccgacgtacatgatccgcgccgtgccgtccaacgcctccgacaacgtctactgcacgctgctggcacacagcgccctgcacggcgccatggccggctacaccggcttcaccgtcgcgccggtgaacggcagacacgcctacatccccttctacaggatcaccgagaagcagaacaaggtggtgatcacggacaggatgtgggcgcgggtgctgtgctcgacgaaccagccgtgcttcctgacgcacgaggacgtcgagggggcggcggggctggacgaggaggagccgcacatgccgctcgttgagggagagtacgcattggtcaggagcccgtccatgtgcaacggcaatggccacctctgcagtggcgcggcctgaaggcgcagcagggacagttcattcagatgtctatgcaaattgcaaagctaagagtccaaatgtggtttgtgatgtaggatttcttggtagcttccttttgttcattctttggatgatgtagtaagatgtataccaagtattggcaagaggagaataacttatttctgcgctgaatctatccagcagccatggttcaact

SEQ ID NO: 1281 - DNA, 1963 bp, Saccharum officinarum
agattactcgcacaaagatttagcttggactgagactcttgatcgcgcgcgcacaaggcgagcggacaaaagaagcttgtttcgtgttcaccggcggcacgggccccctgcgatggaagccgtcggcgtcgctcctgcgcccgtggcggcgccggagaagaagaagctgcttgacctcaaggaccccttccccgccgccgccaacggcagcgccaaggcgtccccggcggggaagtgggcgatgaagaagaagctggtgggcggtgacgccggctacgtgctcgaggacgtgccgcacctcacggattacatgccccagctcccggtgcgtgcgagagtcccccatcttcttggtgtctcacgttggggacagccggtttcctgacgacatatccgaatcccctccaagacaacccggcgtattcagtcgtcaagcagtatttcgtcaacccagacgacaccgtcacgcaaaagattgttgttcataagaccagtgccaggggcacccacttccggcgtgccgggccacggcagcgggtgtacttccagtctgatgaggtgaaggcagccattgtcacctgcggagggctctgccccgggttgaacacggtcatccgcgagcttgtttgcgggttgtatgatatgtatggcgtcaccagcgttgttggcatagagggtggatacaagggtttctattctaaaaatactgttccgttgacaccaaagtcagtgaacgacatccataagagaggtgggactgtccttggaacttcaagaggagggcatgacactgccaaaattgttgattgtcttcaggaccgtgatattaaccaggtttatattattgggggtgatggtactcagaaaggtgcttctgtaatttatgaggaagtccgtagacggggcctcaaatgttctgttgttggtatcccaaagaccattgataatgacattgcggtgattgacaagtcrtttggatttgacactgctgtggaggaggcccagagggcgatcaatgctgctcatgtcgaggctgagagtgcagagaatggcattggtgttgtgaagctaatgggtcgcaacagtggttttattgcaatgtacgctactctagctagccgtgatgtggattgttgtttaatcccagagtcacccttctaccttgaagggaagggaggactccttgagttcattgagaaacggctcaaggacaatggtcatatggtcattgtggtggctgagggtgctggacaggatctcatcgcgaaaagtatgaatttcgtggacactcaagatgcttcgggaaataagctgcttctggatgttggcctttggctatcccagaagataaaggatcatttcaagaagaagcccagctttccgataactctcaagtacatcgacccgacttacatgatccgcgctgtcaggtcaaatgcttctgacaacgtctactgcaccctgctagcccacagcgccctccatggcgccatggcggggtacaccggcttcactgtcgctccggtcaatggcagacacgcttacatcccgttctataggatcaccgagaagcagaacaaggtggtgatcacggaccggatgtgggcgagggtgctgtgctcgacgaaccagccgtgcttcctgagccacgaggacgtggaaaacatgaagcacgacgacgacgagcaccacctgcacaacacgcagctcctggaaggcgagagctcgccgctgaaggacgcgtccaactgcaatggagcagtgtgaagggcacaagaatacgcaaggatatatatatagtattaagcatgtaactagagatgggggttttgtctttttctttttcccttttgggtgctgtcgttgtagagagtagcgaccactactatagataggcttggataatgtgagcatttggtaataatatatatgcttcgctgaagtaggctcagttttggctgtg

SEQ ID NO: 1282 - DNA, 2070 bp, Panicum virgatum
gccgtcgccgtcgtcaaacgcgacgtttaacggcggcgctggccgctaatccagcccaaagcggatatataagctcgcgcggcatccccagacgccaagaagatcaccagattactcgcataaagatttagatagccgcgccatcggactgcaattgttgatcgcagaccaggcggacaagaagcttatctttgtattcactgacacgggcccccctgcgatggaagccgtcggcgtcgctcctgcgcccgtggcggcgccggtgaagaagaagctccttgacctggagaaacctttccccgccgccgccgccgcgaacggcgcgaaggcgtccccggcggggaagtgggcgatgaagaagaagctggtgggcggcgacgcggactacgtcctcgaggacgtcccacacctcacggattacctgcccgagctcccgactttcccgaatcccctccaagacaattctgcgtattcggtcgtcaagcagtatttcgtcaacctagacgacacagtcacgcaaaagattgttgttcataagaccagtgcgaggggaactcacttccggcgtgccgggccgcggcagagggtgtatttccagtccgatgaggtgaacgcggccattgtcacctgcggaggcctctgccccgggctgaacacggtcgtccgcgagcttgtttgcgggttatacgatatgtatggtgtcaccagcgttgttggaatagagggtggatacaaggggttttattctaaaaatactattccattgacaccaaaatcggtgaacgacatccacaagagaggcgggactgtccttggaacttcaagaggtgggcatgacactgccaaaattgtcgattgtcttcaggaccgtggtattaaccaggtttatattattggaggtgatggtactcagaaaggtgcctctgtaatttatgaggaagtccgtagacggggcctaaaatgttctgttgttggtatcccaaagaccatcgataatgacatcgcggtgattgacaagtcttttggatttgacactgccgtggaggaggcccagagagccatcaatgctgctcatgtcgaggctgaaagtgcagaaaatggcattggtgttgtgaagctaatgggccgcaacagtgggtttattgcaatgtatgctactctagccagtcgcgatgtggattgttgtttaatcccagagtcacccttctaccttgaagggaagggagggctccttgagttcatcgagagacggctcaaggacaatggtcatatggtcattgtagtggccgagggtgctgggcaggatcttatcgcgaaaagcatgaattttgtggacactcaggatgcttctggaaataagctgcttctggatgttggcctttggctatcccagaagataaaggatcatttcaagaagaagccccacttccccataactctcaaatacatcgacccgacttacatgatccgtgctgtcaaatcaaacgcatccgacaacgtctactgcaccctgctggctcacagcgccctccatggcgccatggcggggtacactggcttcaccgtcgccccggtcaacggcagacatgcctacatcccattctataggatcaccgagaagcagaacaaggtggtgatcacggaccggatgtgggcaagggtgctgtgctcaacgaaccagccctgcttcctgagccacgaggacgtggagaacatgaagcacgacgacgacgagcatcacctgcacaacacgcagctcttggaaggtgagagctcgccgatgaagaactcggccaagtgcaatgggtcagcagcaggagtgtgaggggcaaaaagagtacgccgagtattacgcatgtaattatagatgatcatttttaccttcttttctgattttggttttgggtgctggcgttgtagagagaccactacgatagaattgaatctactgtgagcatttcgtaataacatgcttcaccacagtaagttcagttttgttggtgaatgggctaatagtgttgtatgccttcctggatcaaggttatggtgcatacggataaaaaattatac

SEQ ID NO: 1283 - DNA, 2085 bp, Triticum aestivum
  misc_feature (2072)..(2072): n is a, c, g, or t
attcggacgagggtcaaaccccgtcgccgccgtcaaacccagcggctaacggcggcgcgaacgacgctaatccgaatatataatcccccgccccccgctgctctcctccccacacaccaagagcaggggatcactcccagaatcaccggctaagcttaagctccctcgtgatctcaaaaaccatctttttttcctctttccacctcgtgcttaccgacggggtccctccctgccatggagtccgtcggcgtcgcccctgcccccgcggcggtggcggtggcggagcagaagatgaagcttctcgagccgaggaaggagcccctcgcctccgccgccgccgccgccgccaaggcgccgtgcaagtgggcgatgaagaagaagctcgtgggcggcgacgccggctacgtgctcgaggacgtgccccacctcaccgactacatgcccgagctcccgacgtacccgaatcccctccaggacaaccctgcctactcggtcgtcaagcagtacttcgtcaacacggacgacaccgtcacgcaaaagattgttgttcgtaagaacagtgcgagaggcacccacttccggcgcgccgggccgcggcagagggtgtacttccagcccgacgacgtgaacgcggccatcgtcacctgcggcggcctctgccccgggctcaacacggtcatccgcgagctcgtgtgcgggttgtacgacatgtacggtgtcaccagtgttgttggcatagagggtggatacaagggtttctattctcgaaacaccgttacattgacacccaaatcagtgaatgacatccacaagagaggggggaccattcttggaacttcaaggggtggacatgacactgccaaaattgtggatagtcttcaggaccgtggcattaaccaggtctacatcattggaggtgatggtactcagcaaggcgcttctgtaatttatgaggaagtccgtagacggggcctcaaatgtgcagtggtcggtgtcccaaagaccatcgataatgatattgcggtgattgacaaatcttttggatttgacactgctgtggaggaggctcaaagagctatcaacgctgctcatgttgaagctgaaagtgcagagaatggcattggtgttgtgaagctaatgggccgcaacagtgggttcatcgcaatgtatgctactctagctagtcgtgatgtggattgttgcttaatcccagagtctccattctaccttgaagggaaaggaggcctccttgagttcgtcgagaaacggctcaaggatagtggtcatatggtcattgtggtggccgagggtgctggccaagatctcatcgcccaaagcatgaactttgtggacactcaggatgcttctggaaataagctgcttctggatgttggcctttggctatcccagaagatcaaggatcatttcaagaagaagaccaacttccccataactctcaagtacattgacccgacatacatgatccgcgcggtccggtcaaacgcctctgacaacgtctactgcaccctgcttgcgcacagcgccctccatggcgccatggcaggatacagtggcttcaccgtcgcgcccgtgaacggcagacatgcttacatcccattctatagaatcactgagaagcagaacaaggtcgtgatcactgacaggatgtgggcgagggtgctgtgctcgacgaaccagccctgcttcctgagccacgaggatgtcgagaacatgaagcacgatgacgacgagcgccaccacctgcacaacacgcagctcctcgatggctcacgggcgaagtgctcacccaactgtaacgggtcagctggagcagagtgagaggcacaaagctgttgggatggatatattgagcatgtgtaattatagctattcttttttaaccttctcttgtgagttttttagcttgccttgtagtagagacttctccggagaattactgtataactatatataataagggttccacgatggcaatctttggtggtagaagctcgattttgtagattagaaaatgctaagttttgggttcgagctcttcgcaacagaagctncttttgcaacact

SEQ ID NO: 1284 - DNA, 1995 bp, Oryza sativa
atgcggatccccaccacggagacggagacggggacggggacacggattcccagccacaggcggcgcaagggatcgtccgacggttcgcgggccagggccgacgcatcccgtcgcggaccaacgccgaccaaggagacggagattcccgggcggccgctgaagcgatcctcctcaaccctatcgttggacgacgccgccggcgcctccaatccgacctcgacctgggcgatcctgaatcggtacggcgcccggagggattccttccgccgcgacgaccgcgaccgcaccacgtcggcggtctcctacacctccggcggcgaccagatctccgtctccttcgagctcgtgaagccgccggagacctccctcctcaccctcgactggccgcaggggccccgcccgtcgctgggaaccacatcctacccatacgtcatcgccgcgcacggcaacgtcgtcctgttccagatcgtctcccccgacaagcacgctcgcccttccgccatcgactacttcgtctacaatgccagccgcagcagcagcagcaaccaccacccctccttgacgcggctgcccgtttcctactggaggaggggagacaccatccgcccgcgcatcatgagcagggaaggcacatgtattttgtcctgcggcagcaagaattcttcgtcgttcgttgtggctgagctcgagagaagatcatgccaatcttccgaaaccaacgtctacctcttcgcttctggctctgacgactggagagtcttcaggaatgtgccgatccgccatggcgacgccctcgctcacctgtgctgctggacgactgatgcggtgttgtcgtgccacgatcgctacatgatctgggtggactacttggtagcagggatgatcgtcgccaatgtagaacatccaggaagggttgacccaccggagcctgttctatggtacgtgccacttccggtcgatccagttgctgacattgatcgtgggcgaggatgccctcaagcctcccgtagtctgtgtgccacccaccatggcatcaagttcgtcaatgttaaccaacatggcggcagcagcagcagaagcttcagcatcaccctgtggtcgtggcacgaggatcagacatggcgagaagatgcaacattggatgctgcccaactttgggaactcgattctgaaaaccgccttccaaatgtccgacctgaattccccgttgttgatatggaaaacccttacgccgtttgcttcttgttgaacgagcgctaccacactgctgaccccaatgccacaacgtggatgatcaaggtgcacatgaagaagaaggttctactagattgtaccggttattccaacaaaggaagctcttctactgccagaaggatgtctgaggggctctccttcatctccagcgaaatgccatcttacctgtctggaaaaaccatcaaaaggtttttggaaggaccgctatggccagcaactcatgatgcgatcgagatcgaagagaatgggaagatgggatttccaaaaaaacaaaaaaagtatactggtaaattggcgatcgatgctgattacaccgacgcggaggacgagcggcatctggagaacgccatgaccagcaattcatcagctggtgggcttcggtgaattaaattccgaccctcctcctctctctcctcggtgaccttgatcgatcggcgtccgcctccacgggaacgctatcagagcattgagctttgaggcgatgggagatgagattagtagatgtgaggcagtttatatgcatggttgttcgaatcgaacgtcaatgcctcaattgccgaacctgcaacttatgatttttggctttaatttcagactttgtcagtatgttagcatgtagaatttgcatgctttgatgcagttcctcatcaacatcgatcacgagatgtacgggactcccctcgtgtattcccaaagaaaacagagatgggcccggcccaacttgtgtatgctatgctatag

SEQ ID NO: 1285 - DNA, 1058 bp, Brachypodium distachyon
ctggcaatggaggtgaccccgaaccacacgcagacggtgagcgggtgggcggccacggacgaatccggcaaggtggcgccgttcatcttcaagcgccgtgagaacggcgtggacgacgtgacgatcaaggttgagtactgcgggatgtgccacacggacctgcacttcgtcaacaacgactggggcatcaccatgtaccccgtggtgccaggccacgagatcacgggcgtcgtcaccaaggtcggcaccaacgtgtcaaccttcaaggccggcgaccgcgtcggcgtcggctgcatctcgggctcctgcctcgactgcgagcactgcgcccggtccgaggagaactactgcgacaaggtcacgctcacctacaacggcgtcttctgggacggcagcgtcacctacggcggatactccggcatgttcgtggccaacaagcggttcctcgtcaggatccccgatagcctccccctggacgccgccgccccgttgctctgcgccgggatcactgtgtacagccccatgaaacagcacgggatgctggaccagaggggtgctggaaggaggctcggggttgtcggcctcggcgggctcggccatgtcgcggtgaagttcgggaaggcgtttgggctccgtgtcaccgtcatcagcacgtcccctgcgaaagaacgcgaggccagagagaacctcatggccgacgacttcgtcctcagcaccgaccagaagcagatgcaggctatggcgaggagcctggattatgtgatcgacacggtgtcggcgtcgcactcgctggggccgatcctggagctgctcaaggtgaacgggaagctggtgctggtggcggcgccggacaaacccgtggagctcccttcgttcccgctgatattcgggaagaggacggtgagcgggagcatgacgggggggatgaaggagacgcaggagatgatggacctctgcggcgagcacggcatcacctgcgacatcgagctcgtcttcacggacaggatcaacgacgccctggcgcgcctcgcaaggaacgacgtccgctaccgtttcgt

SEQ ID NO: 1286 - DNA, 1358 bp, Zea mays
cgcgcgcggctactgcagcttccattccatcacagccaactaaagagaaggagagcgtgtgttcgtttcgaggacgcacacacagacgccatggaggtgacaccaaaccacaccctgaccgtgaccgggtgggcggccatgaacgagtccgccggcaaggtggagcccttcgtcttcaagagaagggagaacggccctgacgacgtgacgatcaaggtgcagtactgcggcatgtgccacacggacctgcacttcatcaacaacgactggggcatcaccacgtacccgctggtcccggggcacgagatcacgggcgtggtcaccaaggccgggcgcaacgtcacgggcttccgcgtcggcgaccgcgtcggcgtgggctgcatcgccgcctcctgcctggactgcgaccactgccgccgctccgaggagaactactgcgaccgtgtggcgctcacctacaacggcgtcttctgggacggcagcgtcacgtacggcggctactcgcgcgcgctggtggcggacaagcgcttcgtggtgcgcgtccccgacgcgctgccgctggacgccgccgcgccgctgctgtgcgcgggcgtcacggtgtacagccccatgaagcaccacggcatgctggggcaccccggcgccagcctcggcgtcgtcgggctcggcggcctcggccacgtcgccgtcaagctcgccaaggcgttcggcctccgcgtcaccgtcgtcagcacgtcgccggccaaggaggccgaggccagggcccggctcggcgccgaccgcttcgtcgtcagcaccgacgacgcgcagatgcgggacgcggccaggtccctcgactacgtcatcgacaccgtctccgccaagcactcgctcggacccatcctggacctgctcaaggtcagcggcaagctcgtgctcgtcgccgcgccggaccagcccgtcgagctcccctccttcccgctcatcttcgggaagaggaccgtcagcgggagcatgacgggagggatcagggagacgcaggagatgctcgacctctgcgcccgccacaacatcacctgcgacatcgagctcgtctccacggacgggatcaacgccgcgctcgcgcgcctcgcgcgcaacgacgtccgataccgcttcgtcatcgacatcgccggcgactccacctcaaaactatagttcattcaattcgttgcattaccattatgggcaccaaacctattatcatctatcaatatcgtcaccagtggcaggcatggcctctggttgcttgcattttgctctctatccatatcaagtgtgtgtcagcatgggccagcgtgcatattgcgccattgcttgcagcaaataaacgttcatat

SEQ ID NO: 1287 - DNA, 1017 bp, Sorghum bicolor
gccatggaggtgacaccaaaccacacgcagaccgtcgccggatgggccgccatgaacgagtccggcaagctcgagcccttcatcttcaagagaagggagaacggcgtggacgacgtgacgatcaaggtggagtactgcggcatgtgccacacggacctgcacttcatccaaaacgactggggcatcaccatgtacccactggtgccaggccacgagatcacgggcgtggtcaccaaggtgggcagcaacgtgaccggcttcggcgtcggcgaccgtgtcggcgtgggctgcatcgccgcctcctgcctcgactgcgaccactgccgccggtccgaggagaactactgcgacaaggtgacgctcacctacaacggcgtcttcccggacggcagcgtcacctacggcggctactcgaagatgctcgtggcgcacaagcggttcgtggtgcgcgttccggacacgctcccgctcgacgccgcggcgccgctgctgtgcgcggggatcaccgtgtacagccccatgaagcaccacggcatgctgcgatccgccggggcgagcctgggcgtggtagggctgggtggactcggccatgtcgccgtcaagttcgccaaggcgttcggtctccgcgtcaccgtcgtcagcacgtcgccggcgaaggagaaggaggcgagggagcggcttggcgccgacgacttcgtcgtcagcagcgaccagaagcagatgcaggccatggcgagaagcctcgactacgtcatcgacaccgtctcggcgaagcattccttgggacctatcttggagctgctcaaggtgaacggcaagctcgtgctcgtcgcggcgccggaccagcccgtcgagctgccgtcgttcccgctcatctttgggaagaggacggtgagtgggagcatgacgggagggatgaaggagacgcaggagatgctggacctgtgtggacagcacggcatcacctgtgatatcgagctcgtctccaccgacgggatcaatgacgcgctccagcgc

SEQ ID NO: 1288 - DNA, 1315 bp, Saccharum officinarum
ccacacgcagaccgtggccggttgggccgtcatgaacgagtctggcaaggtcgagcccttcgtcttcaagagaagggagaacggcgtggacgacgtgacgatcaaggtgcagtactgcggcatgtgccacaccgacctgcacttcatccagaacgactggggcatcaccatgtacccgctggtcccggggcacgagatcaccggcgtggtgaccagggtggggagcaacgtctccggcttccgcgtcggcgaccgcgtcggcgtgggctgcatcgccgcctcctgcctcgactgcgaccactgccgccggtccgaggagaactactgcgacaaggtgacgctcacctacaacggcgtcttctgggacggcagcgtcacgtacggcggctactcccggatgctggtggcgcacaagcggttcgtggtgcgcgtcccggacacgctcccgctggacgccgcggcgccgctgctgtgcgcsgggatcacsgtgtacagccccatgaagcaccacggcatgctgcggtcrcccggcggcagcctgggcgtggtggggctgggaggactggggcacgtcgccgtcaagttcgccaaggcgttcggcctccgcgtcaccgtcatcagcacgtcgccggccaaggagagggaggcgagggagcggctcggcgccgaccatttcgtcgtcagcaccgaccagaagcagatgcaggccatggcgagaagcctcgactacgtcatcgacaccgtctcggccaagcactcgctgggccccatcctggagctgctcaaggtgaacggcaagctcgtgctcgtcgccgcgccggaccagcccgtcgagctcccgtcgttcccgctcatctttgggaagaggacggtgagcgggagcatgacgggaggaatgaaggagacgcaggagatgctggacctgtgcggccagcacaacatcacctgcgacatcgagctcgtctccacggacgggatcaacgaggcgctcrcgcgcctsgcgcgcaacgacgtccgctaccgcttcgtcatcgacatcgccggcgactcaaactcaaagctstagttcaattaattcgttgcattatatcaagtmtcaacaatcaacattgccggcacggttggtggttgattgctatatctatatctatatctatatctatatctatatctatatctatatctatatctatatctatatctatgtctatatctatagtgtgtgtcagctttagcaatatgatcagtggtgatcacttgagccacgagagtgtatgtaatggttgatgtactagctgcctcttgatgtgggaca

SEQ ID NO: 1289 - DNA, 1515 bp, Panicum virgatum
gacagccatctcaagacacagagaagctctttctccgtccgcacgcctctctccttcagaacgcacatacgcagagcagagtcatggaggtcacaccaaaccacactcaaaccgtgaccgggtgggcggccatggacgaatccggcaaggttgagcccttcatcttcaaaagaagggagaatggcgtggacgacgtcacgatcaaggtgcagtactgtggcatgtgccacacggatctccatttcatccaaaacgactggggtatcaccatgtaccccgttgtccccggccacgagatcaccggcgtcgtcaccaaggttggcagtaacgtctctggcttcaaggtcggcgatcgtgtcggtgtgggatgcatctctgcgtcgtgcctcgactgcgagcactgccaccgctccgaggagaactactgcgacaaggtcactctcacctacaacggcatcttctgggacggtaccgtcacatacggcggctactcgaacatgctcgtggcgaacaagcggttcgtcgtgcggatcccggacaacctgcctctggacgcggcagcgccactactgtgcgcgggcatcacggtgtacagcccgatgaagcagcacggcatgctgcagtctggtgggaacctcggcgtcatcggtctaggcgggctcggccacgtcgcggtcaagttcggcaaggcattcggcctccgcgtcaccgtcatcagcacgtcgccagccaaggagcgggaggccagggagcgcctcaaggccgacgacttcattgtcagcaccaaccagaaacagatgcaggccatgaccagaagcctcgactacatcattgacactgtctcggcgaagcattcgctgggcccaatcttggagctgcttaaggtgaacggcaagctggtactcgtcgcggcgccggaccagcccgtcgagcttccttctttccctctcatatttgggaagaggacagtgagtgggagcatgacgggagggctgaaggagacgcaggagatgctggacctgtgcggcgagcacaacatcacctgcgacatcgagctcgtctcgacagacaggatcaacgaggcgctggcacggctggcgcgcaacgacgtccgataccgcttcgtgatcaacatcgggggcaattcaaagctctagttggtgtttgctgtgctgtcgcatcatcagcagcatattggagcagtaaaaaagtcagatgagaagacaagtgtatggaggatggctttattgttcgcgcggtggtcgtatattccatccctgtttgatgtatgtttaaagctctaggatgccattgcttggagcaaatttatacaaacttggttgttttcaacttattattggaaggataatgcgtgggtttgtgtccacatcaatccattgagatacttttcttagatattgttatctatgactaagaaattgtgactgaggaccacggaggtttacctactttcttctaataatatggatccacgcgtaccgatttgtgtgtcaa

SEQ ID NO: 1290 - DNA, 1137 bp, Hordeum vulgare
gggaagagagagggggctttggctggccccagcggtccgtcatccgtcatcgtcttggctacgtcttcaccatattctccattcccccacactgcacgggacagcacagcggagaagaggaaggagagcagagatgactgcgtcggtgtcctacgggctgcgagctcttccgacgtggtctagctctgtgtccggtgacgaccactgctcggcgctggccatgtcggtgtcggcgcggccgcggtcggcgcggccccttcggacgcccgccaggatgggcaatgtaaacgagggcaagggcatcttcgcgcccttggtggtggtggtgcgcaacatcgttggacgcaagcgcttcaaccagctcaggggcaaggccatcgcgctgcactcccaggtgatcaccgagttctgcaagaccatcggcgctgaccccaagcagaggcagggcttgatccgcctcgccaagaagaacggagagaagctcggattccttgcttgacctcacaatcaccccttccttctcctacccttttctactagcaaaaggcaatcatcaacctaccttttctactagcaaaagggagtcatcaaccgctcttccatctttccttggagttgggagattgcatgcatgtatgtatactagtcgtatatcttttcttctcttctcttctcttctggagagggagcaattacttaaaccaacattgagttcagttaaagttcatttcaacctggatggatggacaaatgatgtatatatcctctactgatggcctcagcggtagagtgtgttatacatagggattgactattcgtcaccctggatgaataatagttattcttcaccctagcggccgctgaacgggcgcgccaagaacccggatctcaaccaggcgcccagcccggacacctccgacgccgagtgaagcagccggaagaagcggcggcttccagtcatctacaaccaaccagtcgaccatgcagccagtctccggagagcagccagcagcgtatgttgatgaagcagcacaagcaactcaatccagtccaccacccaacggtctccctagcaagctccgccgcgtcggcgggcgaggtgccggtggtcggtgggtcggtggcgagattattttt

SEQ ID NO: 1291 - DNA, 409 bp, Brachypodium distachyon
agatggctgcgtccgtgtcttctgggctgcgagctcttccgacgtggtccagctccgtctctggcgacgaccgctgctccccgctggtcatgtcggtatcggtgcggcagccacggtcggcgaggccccttcggacgccggcgaggatggggaatgtgaacgagggcaaggggatcttcgcgccgctggtggtggtggtgcgcaacatcgtcggacgcaagcgcttcaaccagctcagaggcaaggcaatcgccctacactcccaggtgatcacggaattctgcaagaccatcggtgccgacccgaagcagaggcagggtttgatccgactcgcaaagaagaacggggagaagctcggattccttgcctgactcaactcaatcaatcctccattcattcccccttttct

SEQ ID NO: 1292 - DNA, 673 bp, Festuca arundinacea
ggcacgaggctctcgttcttgctcattctctcccactctcggcacgaggcacagagcagcacagcacagaaggggaaagatggctgcttctgtgtcatccgggctgcgagctcttccgacgtggtcgagctctgtgtccggtgacgaccacctggccatgtcgtcggtgtygatgcggccccggtcggcacggcctcttcggacacccgccaggatgggcaacgtaaacgagggcaagggcatcttcgcgcccctggtggtggtgacgcgcaacatcgtcggacgcaagcgcttcaaccagctcagggggaaggccatcgcgctgcactcccaggtgatcaccgagttctgcaagaccatcggcgccgacccgaagcagaggcagggattgatccggctcgccaagaagaacggagagaagctyggattccttgcctgacttccccttcccctcttatcttctctactagcacaagggaattatcgactactcttctatccttccttggagttggagatscatattcatgtatactagttttytgytctggaracggagcaactacttgaagcaacactgagttcagttaacttttcagttcaaactggatggatggatagatgatgtatyctctacggagtagcagcatacatatatatcatgtttatctgc

SEQ ID NO: 1293 - DNA, 820 bp, Leymus cinereus x Leymus triticoides
ccgttgctgtcgccccattctcskcyacmctsywckscmsmrcacwgcactgcacagaagaggagaggaaggagagcagagatgactgctgcgtccgtgtcctacgggctgcgagctcttccgacgtggtccagctctgtgtccggtgacgaccactgctcggcactggccatgtcggtgtcggcgcgggggccccggtcggcacggccccttcgggcgcccgcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgatcaccgagttctgcaagaccatcggcgctgaccccaagcagaggcagggcttgatccgcctcgccaagaagaacggagagaagctcggattccttgcttgactgctcccacctcacaatccccttcattctcctaccttttctactagcaaaagggaattatcaacctgccttttctactagcaaaagggaattatcaacctgccttctctactagcaagagggaattatcaaccgctcttctatccttccttggagttggagattgcatgcatgtatgtatactagtcgtatattttcttcttcttctcttctcttctcttctggagacggagcaattacttaaaccaacactgagttcagttaaagttcagttccaactggatgatggacagatgatgtacctatcctctactcatggcctcagcggtagagtatatatatgcgcaatgctactggataaaaaaaa

SEQ ID NO: 1294 - DNA, 635 bp, Pseudoroegneria spicata
ctaccatatccccattctcattctcccccacgctgcactgcaaagagcacagtggccattctcattctcccccacgctgcactgcaaagagcacagcggagaagaggaaggagagcagagatgactgcgtccgtgtcctacgggctgcgagctcttccgacgtggtccagctctgtgtccggtgacgaccactgctcggcgctggccatgtcggtgtcggcgcgggggccccggtcggcacggccccttcggacgcccgcgaggatgggcaatgtaaacgagggcaagggcatcttcgcgcccctggtggtggtggtgcgcaacatcgtcggacgcaagcgcttcaaccagctgaggggcaaggccatcgcgctgcactcccaggtgatcaccgagttctgcaagaccatcggcgctgaccccaagcagaggcagggcttgatccgcctcgccaagaagaacggagagaagctcggattccttgcttgacctacctcacacccccccctctcttttccttctcctacctttttctactagcaaaagggaattatcaacagctattctatctttccttggagttggagattgcatgcatgtatgtatactagtcgtatattcttcttaaaaaaaaa

SEQ ID NO: 1295 - DNA, 962 bp, Oryza sativa
ggctggctgcacgccgcaaccaaattcggcgcgctacgtactctactggctcggattcactcccgtcccggccctctactccactccacccaccggattgctaacttgcttcctccgtccgcggccaccactttctcctctcctcctcagagcaagatcattcaagtataatcctgcctcctactagctataatggcagcagctgcagcatcatccgtgtccctccccggggcgagggctctcccgacgtggtccagctccgtgtccggcgactcgcactcgttggcgctgagctcgtgggcggcgcggcctcggtcggcgcggccactgcgggcgccggcgaggatgggcaacgtgaacgagggcaaggggatcttcgcaccggtggtggtggtggtgcgcaacatcgttggccgcaagcgcttcaaccagctcaggggaaaggccatcgcgctgcactcgcaggtgatcaccgagttctgcaagaccatcggcgccgacgccaagcagaggcagggcttgatccgccttgccaagaagaacggcgagaagctcggtttccttgcctgatcgacatgcccttcctaattcctactagctcatttgattggtgtggatttcctctctgaatgaatgaatttcctgtagctagctagccagccgcgccttcctccctgcgtataaatgtgtcttgtgcgtacgtatacctcctcttctgaccttcaattccatccatccatgccatggcggcatgaacgaatgaattagtagtaagtaatacgcgcatgcatgaacgaatgaataatatactatataatgcgtgtatacagacactagcgctggctagcatgtatgatgatcatgatgtatatgtatgagactgagactgtatgtagccagttaagcgacatcattgccgtcaagctccaatcggatggatctggatctcctagtcaatcttt

SEQ ID NO: 1296 - DNA, 498 bp, Sorghum bicolor
ccaagcttcagcttcagcttcagctccgtgcttctctttactctcctactacacgtccggtgccgttcgagcgtggtggtaagcttagaccagccatcgagggcaaagggcatggcggcggctgtgtccttctcccgggtgcgagctctcccgacgtggtccagctccgtgtccggcgacgaccaccacgcctactcctccgtgctggcgatgtcggtgtcggcgcggccccggtccaccggcgcgcggccgctgcggtcgccggcgcggatgatgggcaacgtgaacgagggcaaggggctgttcgcgccgctcgtggtggtgacgcgcaacatcgtcggccgcaagcgcttcaaccagctcagggggaaggcaatcgcgctgcactcgcaggttatcaatgagttctgcaaggccatcggcgccgacaacaagcagcggcagggcctcatccgcctcgccaagaagaacggagagaagctcggattccttgcctga

SEQ ID NO: 1297 - DNA, 771 bp, Triticum aestivum
ggacaccagcggtccgtcatcgtattggctaccatatccccccattctcattctgcacggcacagcacagcacagcacagcggagaagaggaaggagagcagagatgactgcgtccgtctcctacgggctgcgagcacttccgacgtggtccagctctgtgtccggtgacgaccactgctcggcgctggccatgtcggtgtcggcgcgggggccccggtggacgcggccccttcggacgccggcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgattaccgagttctgtaagaccatcggcgctgaccccaagcagaggcagggcttgatccgcctcgccaagaagaacggagagaagctcggattccttgcttgacctgcctcacaatccccctttccttctcctaccttttctactagcaaaaaggaaattccttggaattggagattgcatgcatgcatgtatgtatactagtcttatatattttttcttcttttcttctcttctcttgtggagacagcactgggttcagttaaatttcagttccatgtggatggatggatggatggatgatgtatctatcctctactgatggcctcagcagtagagtatatatatgcgcaatgctactggataaataattcaagtatttgtctcattactccttttgtat

SEQ ID NO: 1298 - DNA, 1331 bp, Arabidopsis thaliana
atagggctatcgaagccccaagaaaactcactctctatacctcctcaagaaaatcaaagcagcagttatggccgacgtagcaacaaagcaccccatggaagatgaggtgaagaagacggaggcgtctagtttggtggggaagctagagacagacgtggagatcaaggcttcggctgataagtttcaccacatgttcgctgggaaaccacaccatgtctccaaagcaagtccaggcaacattcagggatgtgatctgcacgaaggcgactggggcacagtcggctctatcgtcttctggaattacgtacatgatggggaggcaaaggtggcgaaggagaggatcgaggcggtggagccagataagaacttgatcacgtttagggttatagaaggtgatctgatgaaagagtacaagagcttcttgctcaccatccaggtgacccctaagcctggaggccctggaagtattgtgcactggcaccttgagtatgagaaaattagcgaggaggtagctcacccggaaactctcctccagttctgtgtcgaggtctccaaagagatcgacgaacatctcttggccgaggaagaggaggtgaagacaccagagacgcctagtttggtgggaaagctagagacagacgtggagatcaaagcttccgctgagaagttccatcacatgttcgccgggaaaccacaccatgtctctaaagcatctccaggaaacattcaaggttgtgatcttcacgaaggcgactggggtcaagtcggctctatcgtcttctggaactacgttcatgatagagaggcaaaggtggctaaggagaggattgaggcagtggagccgaataagaacttgatcacgtttagggttatcgacggtgatctgatgaaagagtacaagagcttcttgctcacgatccaggtgaccccgaagcttggaggccctggaagtattgtgcactggcaccttgagtatgagaaaataagcgaggaggtagctcatccggaaactctcctccaattctgtgtcgaggtctcgaaagagatcgacgaacatcttttggccgaggaatagaggagtactactactcttcgtgtttgaatttaaatgcaataaataaggactaagagccatgtctttgtgagatatatgaatgtgagtgtgcatcatgaatgtatgtatactaagatcgttttacgttggctactgtaactttgagaagcaatgtgtagtagctgtgatgaagctagtataaatatataataagtatgttatatatgtttgctaataataaatgtttggactagcgaagccctatgtttatgctttc

SEQ ID NO: 1299 - DNA, 1336 bp, Arabidopsis thaliana
tatagggctatcgaagccccaagaaaactcactctctatacctcctcaagaaaatcaaagcagcagttatggccgacgtagcaacaaagcaccccatggaagatgaggtgaagaagacggaggcgtctagtttggtggggaagctagagacagacgtggagatcaaggcttcggctgataagtttcaccacatgttcgctgggaaaccacaccatgtctccaaagcaagtccaggcaacattcagggatgtgatctgcacgaaggcgactggggcacagtcggctctatcgtcttctggaattacgtacatggcaaatggggaggcaaaggtggcgaaggagaggatcgaggcggtggagccagataagaacttgatcacgtttagggttatagaaggtgatctgatgaaagagtacaagagcttcttgctcaccatccaggtgacccctaagcctggaggccctggaagtattgtgcactggcaccttgagtatgagaaaattagcgaggaggtagctcacccggaaactctcctccagttctgtgtcgaggtctccaaagagatcgacgaacatctcttggccgaggaagaggaggtgaagacaccagagacgcctagtttggtgggaaagctagagacagacgtggagatcaaagcttccgctgagaagttccatcacatgttcgccgggaaaccacaccatgtctctaaagcatctccaggaaacattcaaggttgtgatcttcacgaaggcgactggggtcaagtcggctctatcgtcttctggaactacgttcatgatagagaggcaaaggtggctaaggagaggattgaggcagtggagccgaataagaacttgatcacgtttagggttatcgacggtgatctgatgaaagagtacaagagcttcttgctcacgatccaggtgaccccgaagcttggaggccctggaagtattgtgcactggcaccttgagtatgagaaaataagcgaggaggtagctcatccggaaactctcctccaattctgtgtcgaggtctcgaaagagatcgacgaacatcttttggccgaggaatagaggagtactactactcttcgtgtttgaatttaaatgcaataaataaggactaagagccatgtctttgtgagatatatgaatgtgagtgtgcatcatgaatgtatgtatactaagatcgttttacgttggctactgtaactttgagaagcaatgtgtagtagctgtgatgaagctagtataaatatataataagtatgttatatatgtttgctaataataaatgtttggactagcgaagccctatgtttatgctttc

SEQ ID NO: 1300 - DNA, 1195 bp, Hordeum vulgare
cgcctttattctcctctcccccccttccttcctcccccccaccacctatccgccgcctccccccatcctccacaaacccacgcagctccagcggcgcaggcgcatcccagctcaccggcggaaatgggcgggccaggcctctactccgggatcggcaagaaggccaaggatctgctctacagggactaccagaccgaccacaagttcaccctcaccacctacaccgccaatggcgccgcaattactgctaccagtacaaagaaggctgatctgatactcggtgagatccaatcacagatcaagaacaagaacatcaccgtagatgtgaaggcaaactcggcatcaaatgtcattacaacaattaccgctgacgatcttgcagcgccagggctgaagaccatcttgagctttgctgttcctgatcagaaatctggaaaggtggagctccagtacttacatgattatgctggtattaatgcaagcattggcttgactgccaatcctgtagtcaacctctctgctgcgtttggaactagtgctctagctgttggtggtgatgtgtcgcttgatacatccaccaagaatttcaccaaatacaatgctgcgtttagctacactaaccaagatcttatcgcatccctgaacctgaacaacaagggagacagcctcaccgcatcctattaccactttgtggagaagtccagcacagctgttggggcggagctgacccacagcttctcgagcaacgagaacagcctcaccttcggcactcagcataccctagacccgctcaccctcgtgaaggctcgcatcaacaactctggcaaggcaagcgcgctgatccagcacgagttcaggccgaagtcgctctgcaccatctcggcggaggtggacaccaaggccatcgagaagagctcgaaggtcggcattgcgattgctctcaagccttgatggcgaaatcaagccctctcttttctgaactctcaggggtgttcctcggtttcggatggaatcgtggcgatttgacaaatacttcacacgccttgggcgcgttgtcgcagtctgttagatttgaagaactgccgtgtttcattcctgaggaattttgtctttggtcggtgtagtgcctgtccgttgagccacactttgcagtaataattcaagctctgaaaatcctgaacttgattcagcattc

SEQ ID NO: 1301 - DNA, 1110 bp, Brachypodium distachyon
ccgccgcctccccgccccaacccacgaacccgcaggcgcatcgcaccgagctcagcggaggagatggttgggccaggcctctacaccgagatcggcaagaagaccagggatctgctctacagggactaccagaccgaccacaagttcaccctcaccacctacaccgccaatggcgtcgcaattactgctacaagttcaaagaaggctgatctgatatttggtgagatccaatcacagataaagaacaagggcgtcactgttgatgtgaaggcaaactcagcctcaaatgtcattactacagttaccgttgatgagcttgcagcgccaggactgaagaccatcttcagctttgctattcctgatcagagatctggaaagcttgagcttcagtacttgcatgattatgctggtattaatgcaagcattggattgactgccaatcctgtagtcaacctatctggctcgtttggaactaatgctctagctgttggtgctgatgtttcacttgatactgccacgaagaatttcaccaaatacaacgctggtcttagcttcactaatgatgatctcactgcatccctgaacctgaacaacaagggagacagcctcaccgcatcctattaccactttgttgagaaatccacaaagacagctgttggagcggagctgacccacagcttctcaagcaatgagaacaccctcatcttcggtacccagcatactctggacccactcacccttgtgaaggcccgcatcaacaactctggcaaggccagcgctttgatccagcacgagttcaggccaaggtctctgtgcacaatctcagcagaagtcgacaccaaggccatcgagaagagctcgaaggttggcattgcagtggccctgaagccttgattaccaatcaagcctcccgtaatctcagatatgtaccccagttttggtcgaaattggggagagttgacagtcttccacttctttcggttgttgcagtctgtaagattcaaagaactgctgtgtttcattccgaggaattttgtcttggtcattgtagtacctgtccattgagcaaccttcgcaataattcaagctctgtaatttggaacttgcttc

SEQ ID NO: 1302 - DNA, 1214 bp, Cenchrus ciliaris
ctcccaatcatcctccccaaccccccgcgcccgccgccgcacctcgtcgcagccgccgccaccgccaccgccaccgacgagaagatggtcgggccaggcctctacaccgagatcggcaagaagaccagggatctgctgtacagggactaccagacggaccacaagttcactctcaccacctacacctccaatggcgtcgctgtcacagctactagcactaagaaagctgacttgattattggtgagatccagtcacagataaagaacaagaacatcaccgtagatgtgaaagcaaactcagactcaaatgttattaccacgtttactatggatgaggttgcgacaccaggactgaaggccatcttaagctttgctgttcctgatcagagatctggaaagtttgagcttcagtatttgcatgattatgctggagttaacacaagcatcggtttgactgcaaatcctatagtcaacctctccggctcctttggaaccaaggctctggcagttggtgcagatatctcacttgataccgccactggaaacttcaccaaatacaatgctggactgagcttcactcatgaagaccttatcgcatccctaaacctgaacaacaagggagacagcctaactgcagcgtactaccatagcgtgagccaattgactagcacagctgtcggggcagagctgacccacagcttttcaaccaacgagaacaccctcaccttcggcacccagcacgctctggacycactgactgttttgaaggcccgcttcaacaactcgggcaaggccagcgcgctgatccagcacgagtggaggccgaagtcgctggtgaccatctcagccgaggtcgacaccaagaccattgagaagagctcgaaggtcggaatcgctgtggccctcaagccctgattggttacaagtccctctttttctctcttarctcccagcatgtacttccttcccagctgaaattggggccagttcaactggggaaacagaacagtttggggttccctctccctgcttttggccgttgcagtctaccgatttcctgaactgcgatgtttccttgaggcaatttttcggtcgtcggtgtagagctctgttaaatgagcaaccttcacaataattcatgctcggtagaattctgmacttgttttactatatcaacttaaatcaatggccactctgctggtggttttcaatta

SEQ ID NO: 1303 - DNA, 1034 bp, Festuca arundinacea
gcacgaggcagccgctctcgccatcgccgcgtgcgctgtagatttcctccgcctttattcccccgtcccccgctcctctcgtccatcccctccacccatccgccgcctcccaacaccctcctccacaagcgcaacgcagctccagcggcgcaagcgcatcgcaccgcaccgagctcgccggaggagatgggcgggccaggcctctacaccgggatcggcaagaaggccaaggatctgctgtacaaggactaccagaccgaccagaagttcaccctcaccacctacgccgccaatggcgccgcaattactgctaccagtacaaagaagggtgatctgatactcggtgagatccagtcacagatcaagaacaaaggaatcactgtagatgtgaaggccaactcagcatctaatgttattactacaattaccgctgatgagtatgcggcgccagggctgaagaccatcttcagctttgctgttcctgatcagaaatctggaaaggtcgagctccagtacttgcatgattacgctggtattaatgcaagcattggtttgactgctaatcctgttgtcaacctctctgctgcatttggaaatagcgctctagctgttggtgctgatgtctcacttgatactgccacaaagaatctgaccaaatacaatgctgggcttagctacaccaataaagatcttattgcatccctgaacttgaacaacaagggagacagcctcactgcatcctattaccacattgtggagaaatccaacgcagctgttggggcggagctgacccacagcttctcgagcaacgagaacagcctcaccatcggcacccagcatattcttgacccgcttaccctcgtgaaggcccgcttcaacaactctggaaaggtcagcacgctgatccagcacgagttcaggccgaagtcgttgatcaccatctctgcagaagtcgacaccaaggccattgagaaaagctccaaggtcggcattgctttggccctcaagccttgattgctggtcatcgtaagctc

SEQ ID NO: 1304 - DNA, 1161 bp, Leymus cinereus x Leymus triticoides
ctggaagaatccgctgcctccccccagcctccacaaacccacgcagctccagcggcgcaggcgcatcccagctsagcggcggagatgggcgggccrggcctctacaccgggatcggcaagaaggccaaggatctgctgtacagggactaccagaccgaccacaagttcaccctcaccacctacaccgccaatggcgtcgcaattactgctaccagtacaaagaaggctgatctgatacttggtgagatccaatcacagatcaagaacaaaaacatcactgtagatgtgaaggcaaactcagcctcgaatgtcattactacaattaccgcygacgaycttgcagcgccagggctgaagaccatcttgagctttgctgttcctgatcagaaatctggaaaggttgagctccagtacttrcatgattatgctggtattaatgcaagcattggyttgacygccaatcctgtagtcaacctctccgcygcgttcggaactagygctctagctgttggtggtgatgtgtcgcttgatacagccactaagaatttcaccaartacaatgctgggcttarctacactaaccaagatcttatcgcwtccctgaacctgaacaacaagggagacagcctsacygcatcctattaccacattgtggagaaatccggcacagctgttggggcggagctgacccacagcttctcragcaacgagaacagcctcaccttcggcactcagcatacyctggacccgctcacccttgtgaaggcccgcatgaacaactctggcaaggccagcgcgctgatccaacacgagttcaggccaaagtcactgtgcaccatctcggcggaggtcgacaccaaggccatcgagaagagctcgaaggtcggcatcgcgattgctctcaagccttgatsgcgaaatcaagccccccytctctaarctctcaggggtgttcctcggtttcggatgaaatcggggcgrgttgacaatacttcacacgccttgggcggttgtcgcagtctgttagatttraagaactgccrtgtttcattcctgaggaattttgtctttggtcggtgtagtrcctgtccgttgagccacacttcgcagtaataattcaagctctggaaaattctgaacttgattyaaaaaacctcgtgc

SEQ ID NO: 1305 - DNA, 1286 bp, Zea mays
gtattaggacagaagtcgattctttaagaccagcatctggagctgctccaaatgcagccctaattttccggcgctacttccaaatagtcgccctctcaacttttgttgggtccgtctgtggattgtccccggcctcctttccgtcgcgtccaaatcatcctcacaccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgttgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagccaacctctctgctgcctttggcactaaggctctcgcagttggtgcagaaatctcatttgattctgccactgggaacttcaccaaatacaatgctggattgatgttcactcatgaagaccttatcgcatcccttaatatgaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccgtcttgaaggcacgcatcaacaactcgggcaaagccagcgccctgatccagcatgagtggaggccaaagtcgctggtcaccatctcggctgaggtcgatacaaagaccattgagaagagctcgaaggttggaattgctgtggccctcaagccctgattgattatcaagactattttttcttctaaggtcctagcatgactgtttgggtcatatcaggtcagctggggaaaacaaaactgttggggttaccggcatcttttggtcgttgcagtctgttgatttcatgaactgcgaaatgtttcattgaggaaatttttgggtcatctgcttagcgctctgttaaatgagcaacttccaaaataattcgagcccagtagaattctgaact

SEQ ID NO: 1306 - DNA, 1282 bp, Zea mays
ccccacagaaggagaaggaaaataaactagggtttagccggggccacacggcaggctccacggcgtggttatgtccgcctttattctccccccactcgtctgcttcgcctccacctatccgccgcctcccaatcatcctgcccccaaactcccaccccgcagcatccccacgccaccacacctcgtcgcgtcgcgtcgtcaccggcgtgaagatggtcgggccaggcctctacaccgagatcggcaagaagaccagggatctgctgtacaaggactaccagactgaccacaagttcaccctcactacctacacctccaatggcgtcgctgtaactgcttctagcacaaagaaagctgacctgatccttggcgagatccaatcacagataaagaacaagaacatgaccatagatgtgaaagcaaactcggagtcaaatatcattacgacaattactgttgatgagattgcaacaccagggctgaagaccatcttaagctttgctgttcctgatcagagatctggaaaggttgagctccagtatttgcatgattatgctggagttaatgcaagcatcggtctgacagccaatcctgtagtcaacctctctgctgcctttggtactaaggctgttgcagttggtgccgatatctcacttgatactgcaactgggaacttgactaaatacaatgctgcactgaggttcactcatgaagaccttgtcgcatccctgaacctgaacaacaagggagacagccttactggagcctactatcacaaggtgagcgaattgaccaacacagctgttggggcagagcttacccacagcttctcgaccaatgaaaacaccctcacctttggcgggcagcacgccctggacccactaaccgtcttgaaggcccgcattaacaactctggcaaggccagtgccctgatccagcacgagtggaggccaaagtcgctggtcaccatctcggccgaggtcgacacaaagaccatcgagaagagctcgaaggttgggattgctgtggccctcaagccctgattggttatacagaccattttttccccttctaagttcctagcatgactgtttgggtcagatcagatcagctggggaaaacaaaactgttggggttcctggcatctttgtttgctgtagtcagttgatttaatgaactccgaaatgtctcatggaggaaaattttcggtcgcctgtgtagcgctctgttaaatgagcaaccttcacaataattcaagctcggtagaattctgaacttgtta

SEQ ID NO: 1307 - DNA, 1185 bp, Pseudoroegneria spicata
  misc_feature (1172)..(1176): n is a, c, g, or t
cctatcctccgcctccccscmccctccacaaccccacgcagctccagcggcgcaggcgcatcccagctcaccggcggagatgggcggcccaggcctctactccgggatcggcaagaaggccaaggatctgctgtacagggactaccagaccgaccacaagttcaccctcaccacctacaccgccaatggcgccgyaattactgctaccagtacaaagaaggctgatctgatactcggtgagatccaatcacagatcaagaacaaaaacatcactgtagatgtgaaggcaaactcagcatcgaatgtcattactacaattaccgctgacgatcttgcagcgccagggctgaagaccatcttgagctttgctgttcctgatcagaaatctggaaaggttgagctccagtacttacatgattatgctggtattaatgcaagcattggcttgactgccaatcctgtagtcaacctctctgctgcgtttggaactagtgctctagctgttggtggtgatgtgtcgcttgatacagccaccaagaatttcgccaaatacaatgctgcgcttagctacactaaccaagatcttatcgcatccctgaacctgaacaacaagggagacagcctgaccgcatcctattaccacattgtggagaaatccggcacagctgtcggggcggagctgacccacagcttctcgagcaacgagaacagcctcaccttcggcactcagcatacactggacccrctcacccttgtgaaagcccgcatcaacaactctggcaaggccagcgcgctgatccagcacgagttcaggccgaagtcgctgtgcaccatttcrgcggaggtcgacaccaaggccatcgagaagagctcgaaggttggcatcgcgattgctctcaagccttgatggcgaaatcaagccccctcttctctaggctctcaggggtgttcgtcrgtttcggatgaaatcgtggcgatttgacaaatacttcacacgccttgggcgagttgtcgcagtctgttagatttgaagaactgccgtgtttcattcctgaggaattttgtctttggttggtgtagcgcctgtccgttgagccacacttcgcagtaataattcaagctctgaaaattstgaacttgattcagcattcgtcaaattttttaaaaaaaannnnnaaaatcggt

SEQ ID NO: 1308 - DNA, 1184 bp, Oryza sativa
gcgccgtgttttttttttcctccgcctttattttctcctctcctctcctctcccgcaacctccacctcctatccgccgccgccttcttcttcctcctcccacccgcgcaagctatccgccgccgcatcgcgtcgtcgacgaggagatggtggggccaggcctgtacccggagatcggcaagaaggccagggatctgctgtacagggactaccagaccgaccacaagttcaccctcaccacctacaccagcaatggcgtcgcaatcactgctaccagtacaaagaaggctgatctgatttttggtgagatccaatcacagataaagaacaagaacatcactgtagatgtgaaagcaaactcagactcaaatgttgttactactgtaaccgttgatgagctaacaccaggattgaagtccatcttgagctttgctgttccggatcaaagatctggaaagtttgagcttcaatactcgcatgattatgctggtgttagtgcaagtattggtttgactgccagtcctgtagtcaatctctccagtgtttttggaaccaaggctcttgctgttggtgctgatgtctcacttgataccgccacggggaacttgaccaaatataatgctggattgagcttcagtaatgatgatcttatcgcgtcattgaacctgaacaacaagggagatagtctcactgcatcttattaccacattgtgaaccattcggccacagctgttggagctgagctgacccacagcttctcgagcaacgagaactccctcaccttcggtacccagcacactctcgacccgcttaccgtcgtgaaggcccgcttcaacaattccggcaaggccagcgcgctgctccagcacgagtggaggccaaagtctgtgtggaccatctcagcagaagttgacaccaaggccattgacaagagctcaaaggtcggcattgcggtggccctcaagccttgatttttctcagggtgtacttacatttcaaagatgaaattgagatgagttgaaaaacatcttggcgcatgcgcatcttttggttgttgcagtctattagattccaagaactgccatgtttaatttgaggattttttttttctgttatcggtgttagcacttgttcaatgagcaacccttgcaccccaataattcaagctcggcaaaattatgaact

SEQ ID NO: 1309 - DNA, 1342 bp, Saccharum officinarum
tccttccccaacttccctcccaccccgcagcatctccacgccgccacacctcgtcgcgtcgtcaccggcgagaagatggtcgggccggggctctacaccgagatcggcaagaagaccaaggatctgctgtacaaggactaccagactgaccacaagttcaccctcactacctacacctcccatggcgtcgctgtcactgcttctagcacaaagaaagctgacctgatctttggtgagatccaatcacagataaagaacaagaacattacagttgatgtgaaagcaaactcagagtcaaatatcattactacagttactgttgatgagattgcaacgccaggactgaaaaccatccttagctttgctgttcctgatcagaggtctggaaaggttgagcttcagtatttacatgattatgctggagttaatgcaagcattggtctgacagccaatcctgtagtcaacctctctgctgcctttggcgctaaggctcttgcagttggtgcagatgtctcacttgatactgccactgggaacttaaccaaatacaatgctggactgaggttcactcatgaagacctcatcgcatccctgaccctgaacaacaggggagacagccttactggagcttactaccacaaggtgagcgaattgagcaacacagctgttggggcagagcttacccacagcttctcgaccaatgaaaacaccctcacctttggcgggcagcacgctctggacccactaaccgtcttgaaggcccgcatcaacaactctggcaaggccagcgccctcatccagcacgagtggaggccaaagtcgctggtcaccatctcggccgaggtcgacaccaagaccatcgagaagagctcgaaggtcgggatcgctgtggccctcaagccctgattggttatcaagaccatttttttcccttctaagctcctagcatgactgtttgggtcagatcaggtcagctggggaaaacaaaactgttggggttcccggcatcttttggtctttgcagtctgttgatttcatgaactgcggaatgtttcattgaggaattttttcggtcgtctgtgtagcgctctgttaaatgagcaacctttacaataattcaagctcggtagaattctgaacttgcttacaatggttgaggtgactttgtgtcaattgaggtagacttggttctgttttttctgtcaattgaggtaggcgtggttctgttctctgcaactgtttttggtcctgttcggctggctggaaaaacggatgatgttgatgctgatctattgtaagagaaaaacactgttgaatgactgactaataagttcaagcgaac

SEQ ID NO: 1310 - DNA, 1214 bp, Panicum virgatum
atcctccccacccctcgacccgccgccaaacctcgtcgcgccgccgccaccggagagaagatggtcgggccaggcctctacaccgagatcggcaagaagaccagggatctgctgtacagggactaccagaccgaccacaagttcaccctcaccacctacacctccaatggcgtcgctgtcacagctactagcacaaagaaagctgacctgatttttggtgagatccaatcacagataaagaacaagaacgtcaccatagatgtgaaagcaaactcaggatcaaatgtcattactacggttactgttgatgagattgctacaccaggactgaagactatcttgagctttgctgttcctgatcagagatctggaaagtttgagcttcagtacttgcatgatcatgctggggttaatgcaagcattggtctgactgccaatcctgtagtcaacctctccggctcctttggaaccaaggctgtggcagttggtgcagatatctcacttgataccgcatctgggagcttaaccaaatacaatgctggactgagcatcactcatgaagaccttatcgcatccctgaacctgaacaacaagggagacagcctaactgcagcttactaccacaatgttaacctattgactagcacagctgttggggcagagctgacccacagcttctcaaccaacgagaacaccctcacctttggcacccagcacgctctggatccactgaccgtcgtgaaggcccgcttcaacaactccggcaaggccagcgcgctgatccagcatgagtggaggccaaagtcactggtgaccatctcggctgaggttgacaccaagaccattgagaagagctcgaaggttgggatcgccgtggccctcaagccctgattgttttaccaagtccctttttctctttctaaagctcccagcatgtacttatttcccagctgaaattgggaccaggtcggcttgggaaaacaaaaaactttgggttcccggcatcttttggtcgttgcagtctattgatttcatgaactgcgatgtttccttgaggattttttttgcagtcgccggtgtagcactctgttaaatgagcaaccttcacaataattcaagctcggtagaattctgaacttgttttactatgcattttagtatataagtttacactccaatcaatggcttggtggttttcatgttgctggcagatt

SEQ ID NO: 1311 - DNA, 1208 bp, Panicum virgatum
ccacgcgtccgcccaatcatcctccccagtccccacccctccgacccccgccgctacacctcgtcgcgccgccaccgccacacctcgtcgcgccgccaccgccaccggcgagaagatggtcgggccaggcctctacaccgagatcggcaagaagaccagggatctgctgtacaaggactaccagaccgaccacaagttcaccctcaccacctacacctccaatggcgtcgctgtcacagctactagcacgaagaaagctgacctgatttttggtgagatccaatcacagataaagaacaagaacgtcaccgtagatgtgaaagcaaattcaggctcaaatgtcattactacagttactgttgatgagattgctacaccaggactgaagactatcttgagctttgctgttcctgatcagagatctggaaagtttgagcttcagtacttgcatgatcatgctggggttaacacaagcattggtctgactgccaatcctgtagtcaacctctctggctcctttggaaccaaggctctggcagttggcgcagatttctcacttgatactgcatctgggaacttaatcaaatacaatgctggactgagcatcactcatgaagaccttatcgcatccctgaacctgaacaacaagggagacagcctaaccgcagcttactaccacaatgttaaccaattgactagcacagctgttggggcagagctgacccactgcttctccaccaacgagaacaccctcaccttcggcacccagcatgctttggatccactgactgtcgtgaaggcccgcttcaacaactccggtaaggccagcgcgctgatccagcatgagtggaggccaaagtcactggtgaccatctcagctgaggtcgacaccaagaccattgagaagagctcgaaggttgggatagccgtggccctcaagccctgattgttcaccaagtcctttttttctctctcttaagctcccagcatgtacttccttcccagctgaaattgggaccaggtcagcttggggagacaaaacagtttgggttccccgcatcttttggtcgttgcagtctgtctattgatttcatgaactgtgatgtttccttgagttttttttttcagtcgccggtgtagcactctgttaatgagcaaccttcacaataattcaagctcggtagaattttgaacttgtgttaccatgc

SEQ ID NO: 1312 - DNA, 1163 bp, Triticum aestivum
cctctccaccacctatccgccgcctcctcccaccctccacaaacccacgcagctccagcggcgcaggcgcatcccagctcaccggcggagatgggcggcccaggcctctactccgggatcggcaagaaggccaaggatctgctatacagggactaccagaccgaccacaagttcaccctcaccacctacaccgccaatggcgccgcaattactgctaccagtacaaagaaggctgatcttatacttggtgagatccaatcacagatcaagaacaaaaacatcactgtagatgtgaaggcaaactcagcatcgaatgtcattactacaattaccgctgacgatcttgcagcaccagggctgaagaccatcttgagctttgctgttcctgatcagaaatctggaaaggttgagctccagtacttgcatgattatgctggtattaatgcaagcattggcttgactgccaatcctgtagtcaacctctccggtgcgttcggaactagtgctctagctgttggtgctgatgtgtcgcttgatacagccaccaagaatttcaccaaatacaatgctgcacttagctacactaaccaggatcttattgcatccctgaacctgaacaacaagggagacagcctgaccgcatcctattaccacattgtggagaagtccggcacagctgtcggggcggagctgacccacagcttctcgagcaacgagaacagcctcacctttggcacccagcataccctggacccgctcacccttgtgaaggcccggatcaacaactctggcaaggccagcgcgctgatccagcacgagttcatgccaaagtcgttgtgcaccatctcggcggaggtggacaccaaggccatcgagaagagctcgaaggtcggcattgctattgctctcaagccttgattgcgaaatcaagccccccattctctaaagctctcagtcaggggtgttcctcggtttcggatgaaatcggggcgggttgacaatacttcacacgccttgggcgcgttgttgcagtctgttagatttgaagaactgccgtgtttcattcctgaggaattttgtctttgctcggtgtagtgcctgtccgttgagccacacttctcagtaataattcaagctctgaaaattccgaacttgattcagca

SEQ ID NO: 1313 - DNA, 1146 bp, Triticum aestivum
accctccacaaacccacgcagctccagcggcgcaggcgcatcccagctcaccggcggagatgggcggcccaggcctctactccgggatcggcaagaaggccaaggatctgctatacagggactaccagaccgaccacaagttcaccctcaccacctacaccgccaatggcgccgcaattactgctaccagtacaaagaaggctgatcttatacttggtgagatccaatcacagatcaagaacaaaaacatcactgtagatgtgaaggccaactcagcatcgaatgtcattactacaattaccgctgacgatcttgcagcaccagggctgaagaccatcttgagctttgctgttcctgatcagaaatctggaaaggttgagctccagtacttgcatgattatgctggtattaatgcaagcattggcttgactgccaatcctgtagtcaacctctccggcgcgttcggaactagtgctctagctgttggtgctgacgtgtcgcttgatacagccaccaagaatttcaccaaatacaatgctgcacttagctacactaaccaggatcttattgcatccctgaacctgaacaacaagggagacagcctgaccgcatcctattaccacattgtggagaaatccggcacagctgtcggggcagagctgacccacagcttctcgagcaacgagaacagcctcaccttcggcacccagcataccctggacccgctcacccttgtgaaggcccgcatcaacaactctggcaaggccagcgcgctgatccagcacgagttcaggccaaagtcgctgtgcaccatctcggcggaggtggacaccaaggccatcgagaagagctcgaaggtcggaatcgcgattgctctcaagccttaatggcgaagtcaagcccctcttctctaagctctcaggggtgttcctcggtttcggatgaaatcggggcgggttgacaatacttcacacgccttgggcgcgttgttgcagtctgttagatttgaagaactgccgtgtttcattcctgaggaattttgtctttgctcggtgtagtgcctgtccgttgagccacacttctcagtaataattcaagctctgaaaattctgaacttaaaaaaaaacctcggccgcgaccacgcta

SEQ ID NO: 1314 - DNA, 1224 bp, Triticum aestivum
  misc_feature (1208)..(1208): n is a, c, g, or t
ccccgctccttccctcccctccaccacctatccgccgcctccccccaccctccacaaacccacgcagctccagcggcgcaggcgcatcccagctcaccggcggagatgggcggcccaggcctctactccgggatcggcaagaaggccaaggatctgctgtacagggactaccagaccgaccacaaattcacccttaccacctacaccgccaatggcgccgcaattactgctaccagtacaaagaaggctgatcttatactcggtgagatccaatcacagatcaagaacaaaaacatcactgtagatgtgaaggccaactcagcatcgaatgtcattactacaattactgctgacgatcttgcagcaccagggctgaagaccatcttgagctttgctgttcctgatcagaaatctggaaaggttgagctccagtacttgcatgattatgctggtattaatgcaagcattggcttgactgccaatcctgtagtcaacctctccggcgcgttcggaactagtgctctagctcttggtgctgatgtgtcgcttgatacagccaccaagaatttcaccaaatacaatgctgcacttagctacactaaccaggatcttatcgcatccctgaacctgaacaacaagggagacagcctgactgcatcctattaccacattgtggagaaatccggcacagctgttggggcagagctgacccacagcttctcaagcaacgagaacagcctcaccttcggcacccagcataccctggacccgctcacccttgtgaaggcccggatcaacaactctggcaaggccagcgcgctgatccagcacgagttcatgccaaagtcgctgtgcaccatctcggcggaggtggacaccaaggccatcgagaagagctcgaaggtcggcattgctattgctctcaagccttgattgcggaatcaagccccccttctctaagctctcagtcaggggtgttcctcggtttcggatgaaatcggggcgggttgacaatacttcacacgcccttgggcgcgttgttgcagtctgttagatttgaagaactgccgtgtttcattcctgaggaattttgtctttgctcggtgtagtgcctgtccgttgagccacactcgcagtaataattcaagctctgaaaattctgaacttgattcagcattcgtcaattttttaacttgctgtggtgtagncctactttaccaaggg

SEQ ID NO: 1315 - DNA, 2146 bp, Zea mays
atcgtcgtcgtcgtcttccacaatccaatcggtgctcaccccgccggccggccggccggagcacctctataaatactagcctagggtaccccggaccggccggccggccggctgcacgcacgcatcctccgcctgccgcacccgccaccgcaataagagggttcaaaatactcaagatggctccgccggcacggccgccacgtgttggggaggacttggaggagggcacaggcgagagctccccacctcctcggtcgccacgtgcgtccaaccccgactgccacgaggtgcagaggaagatctgcgagcgcctccgccagacggggcggcacgaccgtacgctcgccgaccccaccttcaacgcccgcttcgcccgccacctcgagaggttgccgcggaggtacctactcgacctcgacctggacgacaagctcgaggatgtcttgctgcactgggggattctcgacgagtgcgccgaccccaataagcgacccgtctttcgcgcgcggttcataaagtataagacagttcctagggaggatgacggcattggtcatgatcaagatcacgaggagccgtgtcaaaagttgttggaggacctcagtttggaaagaagaaagatcgcggacagaaatgattccctgtctatctcctctaggggcgatttgaaaactgtcctccttcatgagatcattttctcctccatcgacaagcccaagctcctaagtcggctaactgcgttgctctctgaggttggactgaatatccaggaagctcatgtgtactccacgaaggatggtttttgtttggatgtttttgttgttgatggctggaagacagaggagactgatgagctgatcgcggcgattaaggagacattaacacaaaaaaatgcatcaccatctaattcaacaaattcttcgacgccggagaaaatagttgacctacaacaacaggttggagattatgaaattgacttaagcatgctaactaggggggacaagatcgcatctggatcatccgcagacttatatcgaggaacttataaaggccatgatgttgctatcaagtgtctcagatctctatatctcaacaatccttcagaagttgagtttctgcaggaagtacttattctaaggcaagattttgctatacataatttggtgttaatcatgaaaatattctgcaattttatggggcatgcacaaaacatccaaactattgcattgtaacagaatacatgcctggagggaatatatatgactttcttcacaagcaaaataacttcttggacctccataaaattctaagatttgctatcgatatctcaaaaggaatggattatctgcaccagaataacattatacacagagatttgaagtctgcaaatcttctgctaggccatgaccaagttgttaagatcgcagactttggtgtggcgcgacatggaagtcagcaggggcagatgactgctgaaactggaacctaccgatggatggcaccagagataattaatcataagccgtatgaccacaaagcggatgtattcagctttgccattgttctttgggagctggcaacttcaatggtcccatatgacaacatgacacccttgcaagctgcattaggagtaagacagggattgcgcttggacattccgggcagcgtgcacccaagattgaccaagctgattcgacagtgctggaacgaagatcctgatgcgcgtctgacttttgcagagattactaaagaactccaagatagtctacaccatatcgaggcacccaagggagccagccgtcgatctagagcaaagatgcagaagaaataagagggcaaggtttcctacttttttttgggtgtgttacactagttgtagtatgagtgtttaaggtgtatgtcgcggttataaatattttaaggccaaggaagtgttaaaaaccgaccttagctcagttggtagagcggaggactgtagtggattgcagatgaaatccttaggtcgctggttcgaatccggcaggtcggagttgtttttaaaataacatttttgctcaacaatgttaggctactcgcctactcacctgtcgctactctgtactcactacggttaaagtcgtgctctttttcttaacatttttacaaa

SEQ ID NO: 1316 - DNA, 1874 bp, Aquilegia formosa
catatctctctctctcgctttatttacacctacaggctacaacaacaacgaaagtgaaaaagaatatctctctctctctctctctctctctctctcttgtgcaatactccctctgtattaccgccagatccaaactctcgatctaaactgttgtttatctttgtgttcgaagacgacggtgagaacaatggtagagagaagatacttatgaacttggaacacttgtgtaactatggatctaattaacttattaagaaagttagagactttgtgactgttttgaactagtttttgttagggttttatcatcaattacaattcatggcgactgcggaggctcatcagagttggacattggcttataaaggaatgtcttctgataatatcaagggtttggttttagcattatcttctagctttttcattggtggtagcttcattgttaagaaaaaaggattgaagaaagctggtgcttctggaattagggctggatctggaggttattcttatttatatgaacctctgtggtgggcgggaatgataacgatgattgtcggtgaaattgctaattttgctgcttatgcattcgcacctgctattctggtcacgcctcttggtgcactcagtattattatcagtgctgtacttgcgcatattatcttaagagagaggctacacatctttggtattcttggctgtgttctttgtgttgtggggtcaactacaattgtcctacatgctcctcaagaacggatgattgagtctgttgcagaagtatgggatcttgctacagagccagcttttcttttgtatgctgctttggtgataacagctgttttcattcttataatccgttttataccacattatggccagactcacataatggtgtatattggggtttgctcgctagtaggttctttgtcggtcatgagcgttaaagcacttggaattgctttaaagttgacattttctggaacgaaccagttaatatatccccagacatgggctttcgcgctagttgtactgacctgtgttcttacacaaatgaactatctaaacaaggccctcgacacattcaacacagctgttgtatcaccaatatactatgtgatgtttaccacattaaccattttggccagtgtgatcatgtttaaggactgggatagacaaaatccaactcagattgtcacagagatgtgcggatttgttacaattctttctgggacatttcttttacacaaaacaaaggacatgtcagatggtatgtcttctcgcctccctaagcacatagatgaagaggatggctttgcttcagaaggaattcctcttaggtgccaagaatctttgagatcatagtccgcagatttctgtttagcgcttttattgaaggaaggtagggctgtggggttctatactgggtcgacctgtatttttagtacttggttgacccctctataccccttttgcaaacatatagaaaaggcaaggaggtgccttttgatcaaagtgagcaacagatttagcagcttccttttgtaacctccctactcagctctccccttgtgacacactgcagttttggggcttattgtttatatacactatatggtggtcgtccatttgccaatgtagatctccttcgagtcatagagcttgttgcaagtatgattcatgattttatcggaggaaatttctgaagtgcagatgttgttttgaaaggatgttttaatgcatgaatgtctaagttgtaagtatcacattgttgtgaatcttatggtcgttctaggaaaatgaaaaaaagagaaaacaatggaaaacaatttgttacttgtgaagttcctttttgtctgtaatgttgcttgattgttgct

SEQ ID NO: 1317 - DNA, 1658 bp, Arabidopsis thaliana
gctagagaaatcttttacctttttcgtaaatttagatgcttcttcatcactacaatttctctcctgtcactctcttcttctacgctcttgtctttatatccgatctacctcgttccctctcaaatccctaaatcgtctcctatatcctttcgcaaatggacaaacccaagatctgaaaaagtttttgtcttttctctcccaatcgcctgattcaagcctaaagctcggtttttttcttctgggtatttaggggttaagtgtattgtagaaaagcatggcgagtttgagtgggagttggagagatgcgtataaaggaatgtcatcggataatataaagggtttagtattggctttatcttcaagcttattcattggtgctagtttcattgttaagaagaaaggtctcaagagagctggtgcttctggtctcagagcaggttctggaggttattcttacctgcttgagcctctctggtgggtaggcatgataacgatgattgtaggggaaattgccaattttgctgcttatgcctttgcgcctgccattttagtaactcctcttggtgctctcagcataattatcagtgctgctcttgctcatgtcatcctacacgaaaagttgcatactttcgggcttcttggttgtgtcttatgtgttgttggttcgataactattgtcttacatgctcctcaagaacaagagattgattctgtgttacaagtatggaatcttgcgacagaacctgcttttcttctctacgctgcagcagtagtaggagcagccattatactcatagttcagtttgtaccacagtacggtcagtcacatgtcatggtatatatcggggtttgttctcttgttggatcattgtcggtcatgagcgtcaaagcgctcgggatagcattaaagcttacgttttcaggaatgaatcagttaatttaccctcagacatgggtcttcacgctgatagttctcacctgcgtgataacccaaatgaactatctaaacaaggcgcttgacactttcaacacggctgtagtttcacctatatactatgttatgttcacatcattgaccatcctagctagtgtcatcatgtttaaggactgggatcgacaggacggaactcagatagtgacggagttgtgtgggtttgtgacaatcctttcaggaacctttttgcttcacaaaacaaaggatatggttgatggttcttcgtccttgggaaatttggctcttcgccttcctaaacaattggaagatagtaatgggtttgagcaagaagggatcccactcactctcagacgccacgagtgtaccaagtcgccaaggccaatgcgtcaattcattctaccgcaagacggtcctgaagctgtgtaaggagatacaaagtagattcaatatatgtaaaccacgcggcttcagagacagcatgaagaaaaagagaagatagattattggtacaaattgcatagggaatttttcacatattcatttgttatgctttctctagagatgtgaaaatgtgtctgacagattgatttaactgttatataaacacatataagtatagtaattggtttccgtcgtcacgttttagcaaagcatgtttcatttatcataacattagtctaagaatctttggttagcatctgaa

SEQ ID NO: 1318 - DNA, 1470 bp, Ricinus communis
gtttacacctctctctctctctctttcttgctttgagcgccgacacaatctatacttcctccttctcctctcaagatccaatctttctttgcaagtttagtatcccagtccaaacctaagtcaagttttcttttaaagttttgatcttccactcatttttcagttacccacttgataaatttgagatttttgtattaaatctaaccaaaatgagttgtgtcttctccaaatttatgtatatattctagaaatcacatttgcagacttgggtctttgtcaattcttaacttttttgtcatctgtattttattgaagttggtgctgagttgggagtttgtgaagaaatggtggttttgtgatacaaggtgaaaaaaaataaaaactttagaattttggcttctctttagtgggcagttttagttagttactgcaatggctacacagagctggagagactcttacaagggtatgtcctctgataatatcaaaggtttggttttggcattatcttctagcttctttattggtgctagcttcattgtcaagaagaagggcttgaaaaaagctggtgcttctggtctcagggcaggaagtggaggctattcttacttatatgaaccactttggtgggtgggaatgataacaatgattgtcggggaaattgctaattttgctgcttatgcttttgcacctgctatattggtcaccccccttggtgctctcagtattattatcagtgcggttcttgcacatatcattttgaatgagaagctacatatttttggaattcttggttgtgttctttgtgttgtgggttctacaacaattgtcctgcatgctcctcaagaacgtgaaattgaatctgtaaaagaagtttgggatcttgctacagaacctgcttttcttttctatgcagccttggtcataacagctgtctttatacttatattccactatatccctgactacggccagacacatataatggtttacattggggtttgttctcttgttggttcattatcggttatgagtgttaaagcacttggaattgcattgaagttgacactatcgggaatgaatcagctaatatatccccaaacatgggcctttgcgttagttgtaattacttgtgtggttactcaaatgaattatttgaacaaggcgcttgatacatttaacacagctgtcgtatctcccatatactatgttatgttcacatcactaacaattgtggctagtgtaatcatgttcaaggattgggataggcaaagtccaacacagattgtcactgaaatgtgtgggtttgtgactattctttcaggaacatttctgcttcacaagacaaaggatatggttgatgggccaacttctctgcctgtgcgactccctaagcacacagaagaggacagctttggtgccgaaggcatccctctcagacgtcaggagtcattgagatcacaaagttga

SEQ ID NO: 1319 - DNA, 1023 bp, Ricinus communis
atgggggatagttacaagggaatgtcatctgataacataaaagggttagtgttggcattgtcttctagcttctttattggagccagctttattgtcaagaagaaaggtttgaagaaagctgcttcttctggtctcagggctggtgctgggggttattcttacctgtatgaaccactttggtggattggaatgattacaatgattgttggggaaattgctaattttgcagcttatgcatttgcaccagctattctggtcactcctcttggtgcacttagcatcattatcagttctgtgctagcacatgttattttacgagagaggttgcacatgtttgggattcttggttgtgctctatgtgttgtgggttcaacagcaattgtattgcatgctccccaagaacgtgagattgagtctgtcaaggaagtgtgggaacttgcaacagagccagcttttcttttgtatgctgcttttgtcataggagcagtgttcataatcattatccgtgttataccccagtatggccagagtcatgttttggtctatatagcagtttgttcacttgttggttcactgtcggtcatgagtgtcaaagcgcttagtattgctctgaagctaacattctcaggaatgaatcagttagtctatccccaaacgtgggtctttacattggttgtaattacctgtgtgatcactcagatgaactatttaaacaaggctcttgatacatttaacacagcagttgtatcccctatatactatgtgatgtttacatccttaaccattttggccagcgtcatcatgtttaaggattgggaccggcagaatccaactcaaattgttactgaaatgtgtggattcgtgactatcctttcgggaacttttcttcttcataaaacaaaggacatggttgagggttcgtcgccatctctaccattgagcattcccaagcattcagaagaagatgggtttcaacctgaaggaatccctcttcgacgtcaagcatccctgcggcaggcataa

SEQ ID NO: 1320 - DNA, 1781 bp, Vitis vinifera
aagtcattcttcaagtaaaaaaaaatccactttaaaaaaaaaaaaaatcttctattttctttttcatttccatttccatttccctttttatctgattttcttgcgatccaagaaaccttcgcagctgtttccaccgtcccgctttgtcttcaagcgccgacagatcttcagctttttctctctctaagatcgttgattcttcactgagtcaaagtcttgagatgaattgcggaaaaccgagttaatcgtgaatctgctttccatggcagttgaaacctagggtttggggttgctgttgggtttagggttagggtttcgcagccatggcggcggccggggaggagggggcttactcctacaagggcatgtccgctgacaacatcaagggtttggttcttgcgctgtcttctagctttttcattggtgctagcttcattgtcaagaagaaggggttgaagaaggctggggcttctggaatcagagcaggggttggaggttattcttacttatatgagccactttggtgggtgggcatgataacaatgatcgtcggggaaattgctaattttgctgcttatgcgtttgcaccagctattctggtcactcctcttggtgcactcagcattattatcagtgctgtacttgctcatattattttaagggagaagctacacatttttgggattcttggttgtgttctttgtgttgtgggttctacaacaattgttcttcatgctcctcaagaacgtgagattcaatctgtgatagaagtgtgggatcttgctacagagccagcttttctcttttatgcagccttggtgataacagctgtgtttgtacttataatccacttcatcccacaatatggccagacccatataatggtttacattggagtttgctctcttgtaggttccttatcggtcatgagtgttaaagcacttggaattgctttgaagttaacattatcaggaatgaatcagctaacatatcctcagacatgggccttcactatagttgtaattacttgtgtaattacccaaatgaactatctaaacaaggcccttgatacatttaatacagccgttgtatctcccatctactatgttatgtttacatcactaaccattttggctagtgtgatcatgttcaaggactgggatagacagaatccaacacagattgtcactgaaatgtgtggatttgtaaccattctttctggaacttttcttcttcacaaaacaaaggacttgtctgatggcctgtcaacgtctttgtccatgagactttctaagcatatagaagaggatggctttggtcaagaaggcatccctctcagacggcaggagtccttgagattaccatgatgcacttcctccattgcatctccctgattttccggccgaaatcaacctgtgtgttatcaagttcatgacttatcccagtgttcatttttggagaacctagaaaaggaaggaagagtttttcttcatctctttctttttctcattttggaccaacggcctatacgcaaatcaccggccaccacgttgcatacccattcttgtttgatgaaatctcgaacatattggttgagtagagtatattgtattgatagccaagaaccttaagaacttaatgaaagaaggcgtacaacatgtatctccgtatttggaaggacaattcaacagtggaaaaagcttcttcaagtaaatagttttctcatgttcttgtaaaaacagtagtgttatactttattatcattttactcgtttgacacc

SEQ ID NO: 1321 - DNA, 1380 bp, Raphanus sativus
ggaaaggcgtttcctcttttgattcaaaacctctcactcactcctcacccaatctcccccagatctcaccggagaaagcagagattagcaccgtgtgaagtcaatctctgcttggatctctcacatctcaagtccgatctgggttttcaagaaagattcgatctttggggtcagaagaatggcgggatcaggaggaggaggaggaggagggtggagagactcttataargggatgtcctctgataacatcaagggyttggtcttagccatttcctcyagcttattcatcggagctagcttcatcgttaagaagaaaggtctcaagaaagcaggagccactggcactagggctggtgttggtgggtactcttatctttacgagcctctttggtggatcggtgtgacaacaatgttacttggtgagattgcgaattttgctgctatgcttttgctccggctatacttgtcacacctcttggcgcactcagtatcattatcagtgctgtcttagctcatatcatattacttgagaagctacacatctttggagttcttggctgcgccttatgcgttgtgggttccaccacaatcgtcctacatgcccctcaagagcaagagattggctctgtgcttgaagtttggaatcttgcaacagagccagcattcatgttctatgcgagcctgatcattggggcagctgtgtttctcatcatccgttatgtgcctcaatatgggcagamaaatgtaatggcctacatcggtatctgttcgcttgtcggctcattatcggtratgagcgtwaaagcactwggaatagcrctraagctgacattttctgggacaaatcaattattttatcctcaaacttgggtttttaccttggtcgtacttacctgtgtgattacccaattgaactacttaaacaaggctcttgatacattcaatacagctatagtatctcctatatactaygtaatgttcacatcactaactatattggccagtgttatcatgtttaaggactgggataggcaaaatggtactcarattgtyacagagatgtgtggatttgttacaatactttcaggcacttttcttctccatagaaccaaggacatggtcgagggttcaccggtgatattaccagtgcgtataagcaagcatgtggatgaggatgggtttgaatcagaaggcattccacttagacgccaagartctctcmkgtcasyttaaaagmtgttattgctttttgttttccgctctagtgcaagccagagagcctcaactttttttttcaccttatctcgatctacgatgaacgcgtggaccatggttcttctgttctaacaatcacatatggttcacgaagwtcaagaaggt

SEQ ID NO: 1322 - DNA, 1635 bp, Zea mays
atcacttgcgatcggttcttatcgccccctttcccatttctcccctcgattctccgggctgatccggtcgctgtccgggcctgttcgattggaggagaatcgcctggtttgaaggaaaggcttgggaagaaaggtaattatcactgtatctgacatggatgagcacatgggaagacgaacagtcggcggcctcctcttcaccaagggaggatccatccttctcttcagagaagacggctcgcgccccaaggccaagaactgctgcacgcgccatggctgtagcggtcagcatcctgctgacagagccaagggcaaggaggtgcacagggcagcagcggtgggcagtgaatcgacaccggctacccctcggagatcacaagcttttaggaagcccaacagaaggcctccacatgaaggcagtgcctcaggcagcatcgtcagggatgtaggaggcccttgtagcgaaaccggcagcgggtcaagagatgctcctgggcgtgatctgcttgctcggcttaaggagagggtcaacacatcaaggaaacgatcgttgaacagggagaacagcccgcagtcgccgagtggactcagtgtctgtgccagttccccgagcaacagtcggtcagtctcaaggccgtcgcaccggacagcttcgaggataagagaagctgacgaaggcgcgaatgcaggagctgacagtgtagtgcgcagaaatgctgctaggaggggttcagagaggagtgacgatgacttgctgctggtcgagcaggtaacaagaaaccaagcgccttctgaagggtttctctctggattcatggctagatacagaagcgatcttcagggagagctttcgtccctggacgacagcatggaggatccaaatggatacttgcgctttgatgtgggcgggattgaagagctcgagaactatttcatattcaatgatcggcatagaggaatgaggatggatatcgacggcatgtcctacgaagagttgcttgctttgggggagcgaattggtaccgtaaacacaggtctttcagacgacgcgttatccgcgtgcctgaacaggaggctctacatgcccacagcttcaggttctcatgaagattgtgaaagaaaatgcagcgtatgccaggaggagtatttagcaggcgaggaggtgggcgagatggcatgtaaacactactaccacctttcctgcatagatcactggcttcggcagaagaactggtgtcctatctgcaaatctgtcgccctgaaaatcaactagcaacgtgtttcatgtttcttcataaatgaagtgtatagattcttcatctcctgtattccttccccaccccactccttttcccttttggaattttttttctttctttctttttcttttactcaaagcactcattttttattatcaatttaaatcagaaaagaaaatcttgtgttgggttagggcttgctgcgagccttactcgtgttggcccatggcccagtaagaacagccccaatttatgatgggaaaagttcatttgacacctcaactatcgacgtcatctgattagctaagggtgtttggaacttctaaaactaactattaccgtttaaagttaccaaaacgaaccttagtcacccctt

SEQ ID NO: 1323 - DNA, 1561 bp, Zea mays
atcgctccctcccaattcctcccctcgattctccgggtcgatccggtcgctgtccggcccggttccagtggaggagaatcgcccggtttgaaggaaaggcttggaaaggaaggataggaataatttcagacaggaaggggaaaaggttgctagtacagcaaattcgtttgggcgctttggttgtgctatgagcaggcacatatatatctagactgattataataggcagttatctgacatggaggagcacatgggaagacgaacagtcggcggcctgctattaaccaagggaggatcaattcttctcttcagagaggacggttcgcgccccagggccaagaactgctgctcgcgccatggctgcagtggtcatcattctgttggcaaagccaaaggcaaggaggtgcacagggcagcggtggccaatgaatcaacaccggctaccccacggagaccaaagatttgtaggaatcccgacagaatgccaccacatggaaccagtgctccaggcagcatcagcaaggatgcaggaggctcttgtagcgaaaccggcaacaggtcaagagacactcccggtcccgggcgtgatctactggctcggctcaaggagagggtcaacacatcaaggaaacggtcattgaacagggagaacagcccacagtcaccgagtggattcactgctagttccccgagcaacagtcgatcagtctcgctctcaaggccgtcgcaccgggcagcttcgagggtaagaagagctgatgaaggtgcaaatgcaggagctgacagtgtgcacagaaatggtgctgggggtgctaggaggagttcacagaggggtgacgcaggcttgctgctagttgagcagcaggtagcaagaaaccatgtgccttctgaagggtttctttctgggttcatggcgagatacagaagcgggcttcaggaagggctttcgtccctggacgacagcgtggaggattcaaatgggtacttgcgctttgatacgggtggaattgaagagctccagaactatttaatattcagcgatcggcacagaggaatgaggatggatatcgacggcatgtcctacgaagagttgcttgctttgggagagcggattggtactgtaaaaacaggtctttcagacgatgcattgtccacgtgcctaaataggagcctctacatgcccacagctccagggtctcatgaagattgtgaaacaaaatgcagcatatgccaggcaagttcatttgaggagtatttatcgggtgaggatgtgggcaagatggcgtgtaaacactactaccacctttcctgcatagagcactggcttcggcagaagaaccggtgtcctatatgcaaatctgttgccctgaaaaccaagtagcaacgtgtttcatgtttctttatagattcttcatatcctttatcccctccgcacctctcacattttcccttttggaattcttttccttcctttttcttactcaaagcactcatttttgtatcaatttaaatcagaaaaggaaatcttgtgttgtgttagcaacttgctgcgagcctggac

SEQ ID NO: 1324 - DNA, 1493 bp, Panicum virgatum
ctattcctcccctcgatcctccgagttgatccagtcgctgtccaggcctgttccattggaggagtatcgctcgggtggaaggggaggcttgcaaagcaaggtgattgcctgacatggatgaacacatgggaagacgaacagtcggcggcctcctcttcaccaagggagggtcaattcttctcttcagagaagacggttcgcgtcccaaggctaagaattgctgctcgcgccatggttgtagcggtcggcattcagttgacaaagccaaaggcaaggaggtgcacaggacagcggcgcccaatgaatcagcaccggctacccctgggagatcacaaattttgaggaagccgagcagaaagcctccacagcaacaggaaagcagtgcttcagacagcatcagcagggatgcaggaggctcctgcagtgagaccgggaacaggtcaagagacactcctgggcgtgatctattggctcggctcaaggatagggtcaatgcatcaaggaagcgatcactgaatagggagagcagcccaccgtcaccgaacggactcaatgctagttccccgagtagtagccgctccatctcaaggccatcgcatcgggcagcttcaaggataagaaaagcagatgacagtgcaaatgcaggaactgacagtgggcacagaaatggctctggagatgctaggaggaattcagagaggagtgacgatgacttgctgctagttgagcaggtagcaagagaccatgtgccttctgaagggtttctttctggattcatggcaagatacagaagtggccttcagggaggagtgtcatctctggaggacagcgtggaggattcaaatggatactggcgctttgatacgggagtaactgaagagctcgagaactacttcatattcaatgatcgccatagaggaatgaggatggatatcgacggcatgtcttacgaagaattgcttgccttgggggagcgaattggtactgtaaacactggcctttcagacgatgtgttggcaaagtgcctgaataggagcatttacatgctcacagcttcaggttctcatgaagattgtgacagaaagtgcagcgtttgccaggaggagtatttagccggtgaggagctgggcaagatggcgtgcaaacactactaccacatgtcctgcatacagcgctggctcaggcagaagaactggtgccccatctgcaaatcagttgctctgaatacgaactagcaaattacttccccagcaatgatgtgtatagattgctcatgtctagacacaatattattttctccctctctctctacttcttcctagaacaaacctgtcatttgtttggaccttcaagcactaccttcagctcagaatccagcgactgggcaaggaaaaggaaacatggaataactctagaagtgagaaattccactttctcctactgttgaagacagaagttgttaccagtcaattcatgttctttgtctgtgttgc

SEQ ID NO: 1325 - DNA, 762 bp, Saccharum officinarum
gtataccaggctcgccccacgcgtccggactccgcaaggaagcggaacgaaacgcaagcgactgaaacgcaagagagcagcgtttctctttgggtcgggtgagctcagctgctagcgagagcggagacggggtgaggcttgccgttgcagagcgacatgagctacaggctcggggacgcggcgggccgcgaggagggggacgaggagctgttcgagacagcgtcgtccttctccggcggcgagtccgacgacgacgacgacgagggggaccacttcccgggcggcggcggcggcggcgcggccgggggcgagggggcgagggcagtgcgaccaccaggaccgccgcgcgttcgtgccggagccgctgcggaggatgaactcggacagcatctacgacatgacgtccatgatatcgcagctcccagccaagaaaggtctgtcgcggtactacgagggcaagtcgcagtcgttcgcgtgcatgtcggaggtgcgctgcctggaggacctgcgcaagaaggacaacccctacaagcagaagatcaagtcgtgcaagagctacgtcgcgctgggaggtatgatggccaagaagcagcccgcctccagctcctgcgccaacctcgacctcgtcgccgccaacgggttcaggacgccgcccattcggaacgggtaccaccagtaggcarcagcargcarcaagctggscgctkgcgacacagcgctgaaactgcakgaacaccgtttttgtttctcggggggtcactg

SEQ ID NO: 1326 - DNA, 751 bp, Saccharum officinarum
aaggaagcggaacgaaacgcaagagagcagcgtttctctttgggtcgggtgagctcagctgctagcgagagcggagacggggtgaggcttgccgttgcagagcgacatgagctaccgtctcggggacgcggcgggccgcgaggagggggacgaggagctgttcgagacggcgtcgtccgtctccggcggcgagtccgacgacggcgacgacgagggggaccacttcccgggcggcggcggcggcgacgggggcgagggcgagtgcgaccaccaggaccgccgcgcgttcgtgccggagccgctgcggaggatgaactcggacagcatctacgacatgacgtccatgatgtcgcagctcccagccaagaaaggtctgtcgcggtactacgagggcaagtcgcagtcgttcgcgtgcatgtcggaggtgcgctgcctggaggacctgcgcaagaaggacaagccctacaagcagaagatcaagtcgtgcaagagctacgtcgcgctgggagggatgatggccaagaagcagcccggttccagctcctgcgccaacctcgacctcgtcgccgscaacgggttcaggacgccgcccattcggaacgggtaccaccagtaaggcagcaggccgcaggctggccgctggcgagacagcgctgaaactgcaggaacacgtttttgttyctcgagggtcactgaactgtttttttcttctttttccctttctttctacttggtctgcgaggattttttt

SEQ ID NO: 1327 - DNA, 2614 bp, Zea mays
aaagccaaacaatttctttcctttttctctctctcccttcttccacttatctgcaaaaaaaaaaaaaatcgttctgctaatttcggagctcaagacgctcgccccatctctcctctcgtcgtctctctcatccatcctgccaaacaaaaaacgaaaaaaaaaaatactcctgctgtttgctagagcgagtgaaaaaaaaagaatagtctcagaaccatctagagacagcggcccgtggagcggacagctgagcgagcaagcctgcgcccttccgaagtagaagctgttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctcttcaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtgatggagttgttgcccactgaccagatatgcagtggacatgaaaacattgatatgttgcagggtggaaaccagtattcatctgaacatacaattcaaggtattgaagacaagaaattttctatagcatcaacttctcagctgagctcctctcagaatttactgaagcaaaggcaccacttagattccaattcaccaagcaacattacttatgaggcctatgaagaaaagttcggtccatctagtggttcttttgcacaaaggaatttaaaagtgcagaagaaaactatgaacatgcaaccaacacagccgataaatgataatgtcatgaacagacatcctcaaacattgacaagaagtgcttcttatccttgtgagaacaatgaatctgaaagaagaggattagggaaaagaactctgggggatcctcaagttacaatgggtacttcaatggtagtggatggctcatttgtatcatccatgtcctctgatatctctgttgaagaaagcagctttcgacaactgcagaatgctgttagtcagctggatgtgcaaaccaaattgtgcattagagatggtttataccgattggcacgaagtgcgcagcacaggcaagttattccaaatatgatgagcagcaatgaagacaacccggatataaaggatctgcagaatgcagaaactttgcgcaaattcgtcgatcctcggagcatcgagacacagacaaacccgatcgaccggtctatcgctctgctacttttccaccagtcatcggaccatgcggctgtggctgtcgacgatgcctcatcacttaaaccccctgctggtagcaaacaccaccagggccctgctgctaaccaaaaccaaggcctgataccagattcatcggtgtattcccctggagatggggcccccaaggatgtacagtccctggacaagttctgaatttatgtccctgctctccatgggcacgttcggttcccggggaatggtcgtctggaacgaatcctggtcggattgcttctctaattgatataagctttgatcggttggaacgattcttggtggaatttcgggataaatgaacaggccctaatgcgtctccgtgacctggttaaggcggcataatacggctttcacatgatgtttctaggcagatgtaaaaaacaagtatattgtgtacccaatagtctgtagcctgttccaatcacattggttttgacatgcgtgtatcctatgggtaggcggccgttgtgctctctagtggcgttgactcacatctgtgtaatctaaaaaaaattctttctttccgtggatctctaactatacctttgaactgatatacgggagtggatggattcggccaacgatcattatgccatgttgctaagaaatgattgcgtgagcctgctgcttctac

SEQ ID NO: 1328 - DNA, 2488 bp, Sorghum bicolor
aaaaaaaacttccttctttcggtgctcaagacgccccatctcccctctcgtcgtcttctctctcatcccatcctgtgccaaaacaaaacgaaaaaaaatactcttcctgcaagctgctagcctagagcgagaggggaaaaaaagaaaagaaaaggaaaagaaaggggggtaatctccggaaccatctagagacagcgagcggcgcgtggagcggagcggagcgagcaagcctactgcgccggtggtggtggtggcggcggcggccgcgtcctcacgaagcagaagcggttctgatccgcagctctcgattccggaaggagttggtcaagaactggggatcctgagttgaatatgatatcaaatccggtggactggtatagtttcggacccggatagaattcgcagggatgccagattggagggtgcgtgagtttgaaggtaaattcactgatgagtttgcccacagtaatggcaaggaacatgaaggtggagttgaggctccaggtgtcactagtagtaagaagttgaagcatgcagtcgccaatgagaaagcccaaggtcccatccccagaacgaatagctcagattcacagaaatgtaatttagaggacaaccaatgtgagaacgggatagtatcccagaatataaacagtgccgctgactgcataggagactgcaaaaatggttccaatgcctttctttcaagagaagaaaatacaatcgttgaaaccagatgtccaacagataactggaactcctgtcagtttgcactgagcaatggttcgtccattctcaataaccacagtgctccacaggatagcctcacttatggagataatgatctaaactacatcgattggcctggcattgataattttgaggatgtcgacacattattcaggtcatctgattccacatatggtcagcagcagctggagaatgcagatgggttatcttggattccttcttcagatgctgtttactcttctgatgttgctatgcagcaagggtttgactcgtcttattcagattatggtattttggatgatctctcagcattccattgtgcagaagataaatcactaccctcagttgatccttcatcagctttatgtgataatcaattcaatgatacctacctgttcagtgagcaaaagaatgtgaatgcatatggtgaacaggcaagtcaactgttccattttccttctatataccaagaggatgtgatggagttgttgcccactgaccagatatgcagtggacatgaaaacattgatatgttgcaggttggaaaccagtattcatctgaaaatgcaattcaaggtattgaagacaagaaattctctatagcgtcaacttctcagctgagctcctctcagaatttactgaatcaaaggcaccacttaaattccagttcaccaagcaacattacttctgagtcctatgcagaaaagtttggtccatctagcggttcttttgcacaaaggaattcaaaagcgcagaagaaaactttgaacatgcaaccaagacagccaacaaatgataatgacataaacagacatcctcaaacattgacaagaagagcttcttatccttgtgagaactatgaaactgaaagaaaaggattagggaaaagaactctgggggatcctcaagttacaatgggtacttcaatggtagtggatggctcatttgtatcatctgtgtcctctgataactcagttgaagaaagcagctttcgacaactgcaggatgctgttagtcagctggatgtgcaaaccaaattgtgcattagggatggtttataccgattggcacgaagtgcgcaacataggcaagtttttccaaatatgatgaacaacaatggagatagccaggatgtaaaggatttgcagaatgcagaaacttcacacaagttcgtcgatccccggagcatcgagacgcagacaaacccgatcgatcggtctatagctctgctacttttccaccagtcatcggaccaggcggctgtagctgtcgacgatgcctcgtcactaaaatcccctgctggtaacaaacagcacccgggccctgcctctaaccaaggcctgatgccagcttcatcggtgtattccccaggaggtcaggggacccccaaggatgtacagtccctggacaagtactgaatttgtggcgctgctctccatgacctggttaaagcgccatgatgtggagcgttcaacgtccgtgattttcaatgcaatatttttacagacgtatgggggggctttcacatgatgtttctaggcttatatgtaaaaacaagcatattgtgtacccagtagtctgtagtcggttccaatcacattggttttgacatatgcttgtatcctattgttagacggccgctgtgctccctagtgagtgttgactcacatttcttgtgtaatttaaaaagaaaaaattcttttcccctagctatataacctttgaactggtgcacaggagt

SEQ ID NO: 1329 - DNA, 2375 bp, Saccharum officinarum
ctgaaaaaatattccttctggtaatttcgctgctcaacacgctcatctcctctcatcgtcgtctctctctcatccatcctgtgccaaaacaaaacgaaaaaatactcctgctgctcctgctgctagagcgagaagaagaaaaagaaaagaaaagaaagggggtaatctcaggaaccatctagagacagcgagcggcccgtggagcggagcggagcgagcaagcctactgcgccggcggcagcggcgtcctcccgaagcagaagcggttctgatccacagctctcgattccggaaggagttggtcaagaactggggatcctgaattgaatatgatatcaaacccggtggactggtatagtttcggacctggatagaatttgcagggatgccagattggagggtgcgtgagtttgaaggtaaattcgctgatgagtttgcccacagtaatagcaacgaacatgaaggtggagttgaggctcctggtgtcactagtagtaagaagttgaagcatgcagttgccagtgagaaagtccaaggtcccatccccagaacaagtagctcagattcacagaaatgtaattcagaggacatccaacgtgagaacgggatagtatcccagaatataaacagtgccggtgactgcaaaaatggttccaatgcctttccttcaagagaagaaaatacaatcgctgaaaccagatgtccaacagataactggaactcctgtcagtttgcactgagcaatggttcgcccattctcaataatcacagtgctccgcaggatagcctcacttacggagataatgatctaaactacatcgattggcctggcattgataattttgaggatgtcgacacattattcaggtcgtctgattccacatatggtcagcagcagctggagaatgcagatgggttatcttggattccttcttcagatgctgtttactcttctgatgttgctatgcagcaagggtttgactcgtcttattcagattatggtattctggatgatctctcagcattccaatgtgcagaagataaatcactaccctcagttgatccttcatcagctttatgtgataatcaattcaatgatacctacctgtttagtgagcaaaagaatgtgaatgcatatggtgaacagatataccaagaggatgtgatggagttgttgcccactgaccagatatgcagtgaacatgaaaacattgatatgttgcaggttggaaaccagtattcatctgaaaatgcaattcaaggtattgaagacaagaaattctctatagcgtcaacttctcagctgagctcctctcagaatttactgaatcaaaggcaccacttagattccagttcaccaagcaacattacttctgagtcctatccagaaaagttcggtccatctagcggttcttttgcacaaaggaattcaaaagtgcagaagaaaactgtgaacacacaaccaagacagacaacaaatgataatgtcatgaacaggcatcctcaaacattgacaagaatagcttcttatccttgtgagaactatgaaactgaaagaagaggattagggaaaagaactctgggggatccacaagttacaatgggtacttcaatggtagtggatggctcatttgtatcatctatgtcctctgataactcagttgaagaaagcagttttcgacaactgcaggatgctgttagtcagctggatgtgcaaaccaaattgtgcattagagatggtttataccgattggcacgaagtgcgcaacataggcaagtttttccaaatatgatgaacagcaatggtgatagccaggatgtaaaggatttgcagaacgcagaaacttcgcgcaagttcgtcgatcctcggagcatcgagacgcagacaaacccgattgatcggtctatagctctgctacttttccaccagtcatcggaccatgcggctgtagctgtcgacgatgtctcatcactaaaatcccctgctggtaacaaacaacaccagggccctgctgctaaccaaggcctgatgccagcttcatcggtgtattccccaggaggtcaggggacccccaaggatgtacaatccctggacaagtactgaatttatggcgctgctctctatgacctggttaaagcggcatgatctggagctttcaactccgtgattgttcatggtgtcatattgttacaaacgcatgggggtgcattcacatgatgttcctaggcttatatgtaaaaacaagcaattgtgtacccaatagtctgtagtcggttccaatcacattggttttgacatgcttgtatcctattgttagacggctgccgtgctccttagtaagtgttgactcaaatttcttgtgtaatctaaaaag

SEQ ID NO: 1330 - DNA, 2555 bp, Panicum virgatum
gaaagccaatcccccattccctcagctcgcttctggtaatttcggtgctcaagcaaggcacatctctcccctctcctcctcttcgtcgtcgcctctctctcatccgtctgggtgctaggaggagaaagattattatattctagggttactgctggaggctggaaaaagaaaaaggaggaattttccggaagcatctggagacagcgcggtacggcctgacgagcggagcgagcaggacttccctgcggcggcggcggcggcggcgccaagggatctgatctacagcttcttgatatcagcaaggagttgatcaagaactggggatcctgagttgaatatgatatcaaatcctgtggattggtacagtttcggacccggatagaatttgtagggatgccagattggagggtgggcgagtttgaaggtaaattcaccgatgactttgcccagagtaatagaaacgaacatcaaagtggagttgaggctcctggtgtcactaatagtaagaagttgaagcatgcagttgccagtgagaaaatcaaccagggtgtcatctctggagaaaataactcagattcgcagaaatgtaattcagagcacatccaatgtgccaatgggatagtatcccagaatataaacagtactggtgactgcaaagatggctcaaatgcttttactttgagagaggaaaatacaattgccgaaaccagatgtccaacagataactggaactcctgtcagtttggactgagcaatggttcatccattctcaataatcacagtactccgcatgatagcctcgcttatggagataatgatttaaactatattgattggcctggcattgacaattttgaggatgtcgacacattattcaggaggtctgattctacatatggtcagcagcagctggagaacacagatagcctatcctggattccttcttcttcagatgctgtttactcttctgatgttgctttgcagcaagggtttgaatcgtcttattcagattatggtattctggatggtctctcagcattccaatgtgcagaagataaatcactaccctcggttgatccttcaactgctctatgcgacaatcaattcaatgatacctacctgttcgatgagcaaaagaatgtaaacacatatgatgaacagatctaccaagaggatgtgatggagctgttgcccacagaacaaatatccaatggacatggaaacattgatatggttggaaatcagttttcatctgaaaatgccattcaaagtatagaagacaagaaattttcgatagcctcaacttctcagctgagctcctctcagaatttactgaagcaaaggcactatttagattccagttcaccaagcaacattacttctgagtcctatccagaaaagttcagtccatctggtggttcgtttgcacaaaggaattcaaaagcgcagaagaaaactgtgatcatacaaccaagacagcttgcaaccgataatgtggtgaacatacatcctcaaacattgacaagaagagcttcatatccttgtgagaactatggaactgaagaaaaggggttagggaaaagaactttgggggatcatcaagttacaatgggcacttcaatggtagtggatggatcatttgtatcatctatgtcctctgataactcagttgaagaaagcagctttcgacaactgcaggacgctgttagtcagctggatgtccaaacaaaattgtgcattagagatggtttataccgattggcacgaagcgcacaacataggcaagtttttccaaatacgatgaacagcaatggagatagccaggatgtaaaggatgcagaaacttcgcacaagtttgctgatcctcagagcattgagacgcagaccaacccgatcgaccggtctatcgctctgttacttttccaccagtcatcggaccatgctgctggagctgtggacgacgcctcatcactaaaatcccctgctagcaaaaaacaacaccagggccctactggaaaccaaggcgtgatgccagcttcatcgtcgatatattcgccaagagggcaggttgggcccaaggatgcacaatcccgggacaattactaagcatacgatgcttctctccattgtccgggttaaagccacatgatgtgggagcttccaacgtctgtgattgttcatagtgtactattgctgcagacgtgtgggggcgttcacatgatgtttcttagctacgatctgtcaagcaagcttatggtgtacccagtagtctctagtcagtcccaatcacattggttttgacatgcgtgtaccctattgtgaaggctgctgctgtgaccatagcagtctgctgactcacatttcgtgtaatctcaaaacatagttccttttttctcccagaggatttacctatttttttgaagtgctcaagtgttcggatggtctctagatgtacctttgaactggtacagaagatggacagggttgggttttaaaactttcagtctcaacaaatgccatgctagtaaaatgacggttgtattatgttgtttatt

SEQ ID NO: 1331 - DNA, 2251 bp, Panicum virgatum
aaaaagaaaaaggaggaattttcgggaagcatctggagacagcgcggtccggtccggctcgacgagcggagcgaaccagcaaggcttccctgcggcggcggcgacgcgaagcaccgctctgatctacagcttcttgatatcagcaaggagttgatcaagaactggggatcctgagttgaatatgatatcaaatcccgtggattggtacagtttcggacccggatagaatttgtagggatgccagattggagggtgggcgagtttgaaggtaaattcactgatgactttgcccagagtaatagaggcgaacatcaaagtggagttgaggctcctggtgtcgctaatagtaagaagttgaagcatgcagttgccagtgagaaaatcaaccagggtgtcatctctggaacaaataactcagattcgccgaaatgtaattcagagcacatccaatgtgccaatgggatagtatcccagaatataaacagtactggtgactgcaaagatggctcaaatgcttttactttgagagaggaaaatacaattgccgaaaccagatgtccaacagataactggaactcctgtcagtttggactgagcaatggttcatccattctcaataatcacagtactctgcaggacagcctcgcttgtggagataatgatttaaactatattgattggcctggcattgacaattttgaggatgtcgacacattattcaggaggtctgattctacatatggtcagcagcagctggagaacacagatagcctatcttggattccttcttcagatgctgtttactcttctgatgttgctttgcagcaagggtttgagtcatcttattcagattatggtattctggatgatctctcagcattccaatgtgcagaagataaatcactaccttcggttgatccttcaactgctctatgcgacaatcaattcaatgatacctacctgttcggtgagcaaaagaatgtaaacacatatggtgaacagatctaccaagaggatgtgatggagttgttgcccaccgaacaaatatccaatggacatggagacatggttggaaatcagtttccatctgaaaatgccattcaaagtatagaagacaagaatttttctatagcctcaacttctcagctgagctcctctcagaatttactgaagcaaaggcacaacttagattccagttcaccaagcaacatcacttctgagtcctatccagaaaagttcagtccatctggtggttcgcttgcacaaaggaattcaaaagcgcagaagaaaattgtgaatatacaaccaagacagattgcaaacgataatgtggtgaacagacatcctcaaacattgacaagaagagcttcatatccttgtgagaactatggaactgaagaaaaggggttagggaaaagaactttgggggatcctcaagttacaatgggcacttcaatggtagtggatggctcatttgtatcatctatgtcctctgataactcagttgaagaaagcagctttcgacaactgcaggatgccgttagtcagctggatgtccaaacaaaattgtgcattagagatgctttataccgattggcacgaagcgcacaacataggcaagtttttccaaatacgatgaacagcaatggagatagccaggatgtaaaggatgcagaaactttgcgcaagtttgctgatcctcggagcattgagacgcagaccaacccgatcgaccggtctatcgctctgctacttttccaccagccatcagaccatgcggctggagctgtggacgacgcctcatcgctaaaatcccctgctagcaaaaaacaacaccagggccctgctggaaaccaagccgtgatgccggcttcatcgtctatatattcaccaagagggaaggttgggcccaaggatgcacaatcccgggacaattactgaatatacgatgcttctctcctttgaccgggttaaagccacatgatgtgggagcttccaacgtctgtgattgttcatagtgtaatatcgccgcagacgcatgggggcgttcacatgatgtttcttagctatgatctgtcaagcaagcttattgtgtacccagtagtctctagtcagtcccaatcacattggttttgacatgcgtgtaccctattgtgaagactactgctgtgaccctagtagtctgctgactcacatttcgtgtaatctcaaaacatagttccttctttttcagagttttacctattttttt

SEQ ID NO: 1332 - DNA, 1655 bp, Zea mays
acacatcacaagagagccaagggctagccgatcaacaacaccactagcctctcctatcctagctagctagcttccaccggccggaagaaaaaaaaatggtggcgagcaaggccgccccgttcgacgaggtgtcctcggtggaggcgggggcctacgggggccgcgacgacgacgggcggccgcgccggacgggcacggtgtggacggccagcgcccacattatcacggccgtcatcggctccggggtgctctcgctggcgtgggccatcgcgcagctgggctgggccgcgggccccgccgtcatgctgctcttcgccgtcgtcatctactacacctccacgctgctcgccgagtgctaccgctccggcgacccagtggcggggaagcgcaactacacctacatggacgccgtccgcgcaagcctcggcggcgccaaggtcaggctctgcggcgccatccagtacgccaacctcttcggcgtcgcaatcggatacacaatcgccgcatccatcagcatgctcgccatcaagagggcggactgcttccacgccaagggccacaagcacgcgtgccgcagctccagcaacccctacatgatcctcttcggcgtcgccgaggtcgtcttctcgcagataccggacttcgaccagatttggtggctctccatcgtcgccgccgtcatgtccttcacctacgccaccatcggcctcgtcctcggcatcatgcagaccgtcgccaacgggggcttccagggcagcctcaccgggatcagcatcggcgccggcgtcaccccgacggagaaggtctggcggagcctgcaggccttcggcaacatcgccttcgcctattcctactccatcatcctcatcgagatccaggacacggtcaaggcgccgccgccatccgaggccaaggtgatgaagagggcgaccatggtgagcgtggccaccacaacggtgttctacatgctgtgcgggtgcatgggctacgccgccttcggcgacgccgcgccggacaacctcctcaccggcttcggcttctacgagcccttctggctgctggacatcgccaacgtcgccatcgtcgtgcacctcgtcggcgcctaccaggtcttctgccagccgctcttcgccttcgtcgagaagtgggcagcggccacgtggcccgacagcgccttcatcgcccgggagttccgcgtgggccccttcgcgctcagcctgttccgcctcacctggcgcacggcgttcgtgtgcctcaccaccgtcgccgccatgctgctccccttcttcggcgacgtcgtcggcctgctcggcgccgtctccttctggccgctcaccgtctacttccccatcgagatgtacgtcgtgcagcgcgccgtgcgcaggtggagcacgcactggatctgcctccagatgctcagcgctgcgtgcctcctcgtgtccgtcgccgccgcagcgggctccatcgccgacgtcatcggcgcgctcaaggtgtaccgcccgttcagcggctagttcagataggggcccaacgaggcgtgtgccgtgcacatgagtagtgccagtggtatctctactggtcggggtgctacattgactgtggggtcccgggttgttgtaacttgtaagatatagccaaatgaaaaacaaagctac

SEQ ID NO: 1333 - DNA, 1704 bp, Sorghum bicolor
cacaagcgcggaacagcgagcgagcaacaacaccgctagaccggagcagtagcagtaatatagctactatcgccgtcgtcgtcccgggctgccggcgaggggaaaaaaatggtggccaagaagcaggccccgttcgacgagttgtcgctggtggaggcccgcggcggcggcggtggcggtggcgatgacgcggagtggcgcgacgacgacgggcggccgcggcggacgggcacggtgtggacggcgagcgcgcacatcatcacggccgtgatcggctccggcgtcctgtcgctggcgtgggccatcgcgcagctcgggtgggcggccggccccgccgtcatgatcctcttcgccgtcgtcatctactacacctccacgctgctcgccgagtgctaccgctccggcgaccccgtggcggggaagcgcaactacacctacatggacgccgtccgctccagccttggcggcgccaaggtcacgctctgcggctccatccagtacgccaacctcttcggcgtcgccatcggttacaccatcgccgcatccatcagcatgctggcgatcaagagggcggactgcttccacgtcaagggccaccggaacccgtgccggagctccagcaacccgtacatgatcctcttcggcgtcgccgaggtcgtcttctcgcagataccggacttcgaccagatatggtggctctccatcgtcgccgccgtcatgtccttcacctactccaccatcggcctcgtcctcggcgtcatgcagaccgtcgccaacggcgggttccagggcagcctcaccgggatcagcatcggcgccggcatcacgcccacgcagaaggtctggcgcagcttgcaggccttcggcaacatcgccttcgcctactcctactccatcatcctcatcgagatccaggcaagaaattaaaagctctgacacggtgaaggcgccgccgccgtcggaggcgaaggtgatgaagagggcgacgatggtgagcgtggcgacgacgacggtgttctacatgctgtgcgggtgcatgggctacgcggcgttcggcgacggcgcgccggacaacctcctcaccgggttcggcttctacgagcccttctggctgctggacatcgccaacgtcgccatcgtcgtgcacctcgtcggcgcgtaccaggtcttctgccagccgctcttcgccttcgtcgagaagtgggcggcggcgacgtggcccgacagcgccttcatcgcgcgggagctcggcgccgtcgggcccttcaagctcagcgcgttccgcctcgcctggcgcacggcgttcgtctgcctcaccaccgtcgtcgccatgatgctccctttcttcggcgacgtcgtcggcctcctcggcgccgtctccttctggccgctcaccgtctacttccccatcgagatgtacgtcgtgcagcgcggcgtgcgcagggggagcacgcactggatctgcctacagatgctcagcgtcgcgtgcctcgtcgtgtccgtcgccgccgccgccggatccatcgccgacgtgatcggcgcgctcaaggtgtaccgcccgttcagcggctagtttagatagggcaccggccggcgacgaggcgtgtgccgtgcacatgagtagtgtacctacctactggtaggggtcctacacattaactgtgggtcccgggtgtaagatataataacaaaagtgaaaacaaa

SEQ ID NO: 1334 - protein, 354 aa, Theobroma cacao
MDAYSTRLLFLVFAFASVSRGYAQQSTTVVPAIITFGDSVVDVGNNDYLPTIFKANYPPYGRDFDNHQPTGRFCNGKLATDITAKTLGFTTYPPAYLSPEASGKNLLIGANFASAGSGYDDNAAMLNHAITLTQQVEYFKEYQAKLAKVAGSSKSASIIKDALYVLSAGSGDFLQNYYVNPLINHVYTPDQYGSILIDAFTSFVKNLYGLGARKIGVTSLPPLGCIPLARTLFGYHEKGCVSRFNTDAQQFNKKLNSAAANLQKQHPGLKIVVFDIFKALYDVVNSPSNYGFVEATRGCCGTGTVETTSFLCNPKTPGTCPNATQYVFWDSVHPSEAANQVLADALITQGLALV

SEQ ID NO: 1335 - protein, 356 aa, Gossypium hirsutum
MEVYSRRLMFLVFAFALVSIGYAQESNSTTLVPAILTFGDSVVDVGNNDYLPTIFRANYPPYGRDFANQKPTGRFCNGKLATDITAETLGFTTYPPAYLSPEASGNNLLIGANFASAGSGYDDRAASLNHAITLSQQVEYFKEYQAKLAKVAGSSKSASIIKDALYVLSAGSGDFLQNYYVNPLVNHAYTPDQYGSFLIDAFTRFVQNVYGLGARKIGVTSLPPLGCIPLARTLFGYHEKGCVSRFNTDAQQFNKKLNAAATNLQKQHPDLKIVVFDIYKALLDVVNTPSNYGFVEATRGCCGTGTVETTEFLCNPHTLGTCPNASQYVFWDSVHPSQAANQVLADTLIVQGIPLL

SEQ ID NO: 1336 - protein, 221 aa, Prunus dulcis
MGRGKIEIKRIENTTNRQVTFCKRRNGLLKKAYELSILCDAEVALIVFSSRGRLYEYSNNNIRNTIEGYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 1337 - protein, 224 aa, Malus domestica
MGRGKIEIKRIENTTNRQVTFCKRRNGLLKKAYELSILCDAEVALIVFSTRGRLYEYSNNNSIRNTIERYKKACSDSTGSSSVTEINAQYYQQESAKLRQQIQMLQNSNRHLMGDALSTLTVKELKQVENRLERGITRIRSKKHELLLAEIEYFQKKEIELENENVYLRTKVSEVERLQQANMVSGSEMNAIQALASRHFFSQNMIEGGGATFPQQDKKNLHLG

SEQ ID NO: 1338 - protein, 222 aa, Phaseolus coccineus
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMMEGGSVYPQSDKKILHLG

SEQ ID NO: 1339 - protein, 222 aa, Theobroma cacao
MGRGKIEIKRIENTTNRQVTFCKRRNGLLKKAYELSVLCDAEVALIVFSSRGRLYEYSNNNIRSTIERYKKACSDSSNTNSVIEINAQYYQQESAKLRQQIQMLQNSNRHLMGDSLSSLTVKELKQLENRLERGITRIRSKKHEMLLAEIEYLQKREIELENESVCLRTKIAEIERLQQANMVTGPELNAIQALASRNFFSPNVIEGGTAYSHPDKKILHLG

SEQ ID NO: 1340 - protein, 223 aa, Citrus sinensis
MGRGKIEIKRIENTTNRQVTFCKRRNGLLKKAYELSVLCDAEVALIVFSSRGRLYEYSNSNIRSTIDRYKKACSDNSNSGTVTEINAQYYQQESAKLRQQIQMLQNSNRHLMGDSLSSLTVKELKQLENRLERGITRIRSKKHEMLLAEIEFLQKREIELENESVCLRSKIAEMERFQQANMVTGQELNAIHALASRNFFSPAIIEGGVTAYSHPDKKILHLG

SEQ ID NO: 1341 - protein, 224 aa, Gossypium hirsutum
MGRGKIEIKRIENTTNRQVTFCKRRNGLLKKAYELSVLCDAEVALIVFSTRGRLYEYSNNNIRSTIERYKKACSGTSNTNTVTEINAQYYQQESAKLRQQIQMLQNSSRHLMGDSLSSLTVKELKQLENRLERGITRIRSKKHEMLLAEIEYFQKREVELENESVCLRAKIAEIERVEEANMVTGAELNAIQALASRNFFTPNVIERGTPTPYSHHDKKILHLG

SEQ ID NO: 1342 - protein, 223 aa, Vitis vinifera
MGRGKIEIKRIENTTNRQVTFCKRRNGLLKKAYELSVLCDAEVALIVFSSRGRVYEYSNNNIKSTIDRYKKASSDSTNGGSTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLPDKKVLHLG

SEQ ID NO: 1343 - protein, 223 aa, Lotus japonicus
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKPHEMLLAEIEYFQTREIELENENLCLRTKITDVERIQQVNMVSGQELNAIQALASRNFFNPPMIEDGTSYPQQPDKKILHLG

SEQ ID NO: 1344 - protein, 223 aa, Medicago truncatula
MGRGKIEIKRIENTTNRQVTFCKRRNGLLKKAYELSVLCDAEVALIVFSSRGRLYEYSNNNIRSTIDRYKKACSDHSSTTTTTEINAQYYQQESAKLRQQIQMLQNSNRHLMGDALSTLTVKELKQLENRLERGITRIRSKKHEMLLAEIEYFQKREIELENENLCLRTKINDVERLPQVNMVSGQELNAIQALASRNFFNPNMMEDGETSYHQSDKKILHLG

SEQ ID NO: 1345 - protein, 219 aa, Carica papaya
MGRGKIEIKRIENTTNRQVTFCKRRNGLLKKAYELSVLCDAEVALIVFSSRGRLYEYSNNNIRSTIDRYKKACSDSSATTSVTEINAQYYQQESAKLRQQIQMLQNSNRHLMGDSLSALSVKELKQLENRLERGITRIRSKKHEMLLAEIEYLQKREIELENESVCLRTKIAEVERSLQVNMVTGPELNAIQALASRNFFIENETTYSHGPDKKILHLG

SEQ ID NO: 1346 - protein, 224 aa, Populus trichocarpa
MGRGKIEIKRIENTTNRQVTFCKRRNGLLKKAYELSVLCDAEVALIVFSSRGRLYEYANNNSIRSTIDRYKKASSDSSNASSITEINAQYYQQESAKLRQQIQMLQNSNRHLMGDAVSNLSVKELKQLENRLERGITRIRSKKHELLLAEIEYLQKREIELENESVCLRTKIAEVERLQQANMVTGAELNAIQALAASRNFFAPHLLEGGTAYPHNDKKILHLG

SEQ ID NO: 1347 - protein, 224 aa, Populus trichocarpa
MGRGKIEIKRIENTTNRQVTFCKRRNGLLKKAYELSVLCDAEVSLIVFSSRGRLYEYANNNIRSTIDRYKKVSSDSSNTASITEINAQYYQQESAKMRQQIQLLQNSNRHLMGEAVSNLSVKELKQLENRLERGMTRIRSKKHELLLAEIEYMQKREIELENESAYLRTKIAEVERLQQANMVTGEELNAIQALAASRNFFAPHFLEGGTAYPHTYNKKILHLG

SEQ ID NO: 1348 - protein, 221 aa, Prunus persica
  misc_feature (3)..(3): Xaa can be any naturally occurring amino acid
  misc_feature (68)..(68): Xaa can be any naturally occurring amino acid
MGXGKIEIKRIENTTNRQVTFCKRRNGLLKKAYELSILCDAEVALIVFSSRGRLYEYSNNNIRNTIEXYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 1349 - protein, 222 aa, Glycine max
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 1350 - protein, 222 aa, Glycine max
MGRGKIEIKRIENTTNRQVTFCKRRNGLLKKAYELSVLCDAEVSLIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNVIQALASRNFFNPNMLDGGTVYPQTDKKILHLG

SEQ ID NO: 1351 - protein, 143 aa, Euphorbia esula
MGRGKIEIKRIENTTNRQVTFCKRRNGLLKKAYELSVLCDAEVALIVFSSRGRLYEYSNNNIKSTIDRYKKACSDSSNTNSITEINAQYYQQESAKLRQQIQMLQNSNRHLMGDALSSLTVKELKQLENRLERGITRIRSKKH

SEQ ID NO: 1352 - protein, 645 aa, Gossypium hirsutum
MEASSSTSHDPALFHAPLLHHPRRRSSRPLKGFAVIFGSVVFLLSLVILIVNQSPEPLASNPSSVTEAGSYSMAAQPRGIAEGVSAKSNPSLFDKVGFNWTNAMFYWQRTAYHFQPQKNWMNDPDGPLYHKGWYHLFYQYNPDSAIWGNITWGHAVSKDLIHWFYLPLAMVPDQWYDINGCWTGSATLLPDGRIVMLYTGSTNESVQVQNLAYPANLSDPLLLQWLKYPGNPVVVPPTGIEDNEFRDPTTAWLGPDGSWRITVGTRFNTTIGTALVFQTTNFSDYQLLDGVLHAVPGTGMWECVDFYPVAINGSVGLDTTALGPGIKHVLKASLDDTKVDHYAIGTYDMITDKWTPDNPEEDVGIGLKVDYGRYYASKTFFDQSKQRRILYGWVNETDTEADDLEKGWASIQTIPRSVLYDNKTGTHLLQWPVEEVESLRLNATVFKDVVVEAGSVVPLDIGTATQLDILAEFEIETLVSNSTEDEVSDCGDGAVDRSTYGPFGVLVIADDSLSELTPIYFRPLNISDGSLETYFCADETRSSKAPDVTKRVYGGKVPVLDDENYKMRVLVDHSVVESFGEGGRTVITSRVYPTEAIYGAARLFLFNNASGVNVKATLKIWEMNSAFIRPFPFEETLFQEMVAST

SEQ ID NO: 1353 - protein, 312 aa, Theobroma cacao
  misc_feature (236)..(236): Xaa can be any naturally occurring amino acid
MAITSTSNRKEMDRIKGPWSPEEDDLLQKLVQKHGPRNWSLISKSIPGRSGKSCRLRWCNQLSPQVEHRAFTPEEDETIIRAHARFGNKWATIARLLNGRTDNAIKNHWNSTLKRKCLSVGEECNFITNGGYDGNLRGEEQQPLKRSVSAGLYMSPGSPSGSDVSDSSVPVLSSSHVYKPIPRSGGVNVDVNVDVNVMPAGVEAASSSNDPPTSLSLSLPGAESCEVSTHPVSESXQMRNEAKNEERVGGVMGFSSEFMAVMQEMIRVEVRNYMVQMQQQNGGVAGGGMGMCLDGGFRNVMAMNRVGVSKIE

SEQ ID NO: 1354 - protein, 314 aa, Gossypium hirsutum
MAVTSTSNRKEMDRIKGPWSPEEDDLLQKLVQKYGPRNWSLISKSIPGRSGKSCRLRWCNQLSPQVEHRAFTPEEDETIIRAHARFGNKWATIARLLNGRTDNAIKNHWNSTLKRKCLSVGEESNFITHGGYDGNLGGEGKQQPLKRSVSAGLYMSPGSPSGSDLSDSSVPVLSSSHVYKPIPRTGGVSVDVNVMPLPGVEAAASSSNDPPTSLSLSLPGAESYELSVSTLPVTESTQTRNEAKNDGKGGEVMGFSAEFMAVMQEMIRMEVRDYMVQMQQQNGGVSRGEGMGMCLDAGFRNVLSMSRVGVNKID

SEQ ID NO: 1355 - protein, 205 aa, Gossypium hirsutum
PITWFGHFDGKKEKRGRNLEKLIQTERVMELSIQKTEALIRLSTIVMLVLTACLIGLDSQTKVIFYVQKKASFKDLRALVGLLYVTSLAAAYNLLQLCCSSFYKGTSLQSYAYLAWLRYILDQAVVYAVFAGNLAAMEHSFLVLTGEENFQWLKWCNKYTRFCTQIGGSLLCGFVASLLMFSIASISAFNLFRLYSPTKFMHLKL

SEQ ID NO: 1356 - protein, 123 aa, Gossypium hirsutum
MASSGVLKLVSMILIVCMAVMGAPKAAKAAITCSDVVSHLIPCLSYVQNGGTPAAACCSGVKTLYGQAQTSTDRQDVCKCIKSAVNGMPYTGYNLNLAAGLPAKCGLHLPYNISPSTDCNKVQ

SEQ ID NO: 1357 - protein, 123 aa, Gossypium hirsutum
MASSGVLKLVCMILMVCMTMMSAPKAMKAAITCGQVVNHLIPWLSFVENGGRPAAACCSGVKSLFGEVQTSPDRQSICKCLKSAVNGIPYTSNNLNLAAGLPAKCGVQLPYKISPSTDCNKVQ

SEQ ID NO: 1358 - protein, 467 aa, Gossypium hirsutum
MASLPFIFFLSFFIISTTLTSAGAAAATIKLSLSPFPHPSSSHPYQILNNLVTSSVARAHHLKHPKAKADNTTSSLLRASLFPHSYGGYTISLKFGTPPQTLPFIMDTGSSLSWFPCTSRYLCSQCAFPNVDPAKIPTFAPKRSSSKKLVGCRNPKCSWLFGPDVASRCQDCEPTSENCTQTCPPYLIQYGLGSTAGLLLVENLVFPQKTFQDFLVGCSILSNRQPAGIAGFGRSAESLPSQLGLKKFSYCLVSRRFDDTGVSSNMLLETGSGSGDAKTPGLSYTPFYRNQVASNPNFKEFYYVTLRKILVGDKHVKVPYSYLVPGSDGNGGTIVDSGSTFTFMDRPVFEVVSKEFEKQMGNYIRAREIENISGLAPCFNISGYTSIKFPELSFQFKGGAKMALPLVNYFSFVGDDKVACLMIVSDNVVGQGSHGGPAIILGSFQQQNYYIEFDMANNRFGWAERRC

SEQ ID NO: 1359 - protein, 337 aa, Theobroma cacao
  misc_feature (110)..(110): Xaa can be any naturally occurring amino acid
MEFNLSPVLAFLALAVVVSHAALSPEQYWNYVLPNTPMPKAVKVLLHPDFMENKGTSVNVGGGGVNVNTGKGKPGGGTSVNVGGKGGGVSVNTGHKGKPVYVNPGGFIYXYAATETQVHDDPNVALFFLEKDMHPRATMTLHFTENTETATFLPRQIAQKIPFSSDKLPEILNKFSVKPGSAEAEIMKNTIKECEQPQIQGEDKYCATSLESMIDFSTSKIGKNAYAISTEVQKQTPEQKYTIAAGVQKMGGDKSVVCHKQNYAYAVFYCHKSETTRAYMVHLEGADGTKAKAVAICHTDTSAWNPKHLAFQVLKVEPGTIPICHFLPQDHIVWIPK

SEQ ID NO: 1360 - protein, 396 aa, Gossypium hirsutum
MKVLSPILACLALAVVASHAALSPEQYWSYKLPNTPMPKAVKEILHPELMEEKRTSVNVGGGGVNVNTGKGKPGGGTHVNVGRKGVGVNTGKPGGGTHVNVGRKGVGVNTGKPGGGTHVNVGGKGVGVNTGKPGGGTHVNVGGKGGGVSVHTGHKGKPVNVNVSPFVYNYAASETQIHEDPNVALFFLEKDMHPGATMSLHFTENTEKSAFLPYQTAQKIPFSSDKLPEIFNKFSVKPGSLKAEMMKNTIKECEQPAIEGEEKYCATSLESMIDYSISKLGKVDQAVSTEVEKQTPTQQYTITAGVQKMTNGKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 1361 - protein, 376 aa, Gossypium hirsutum
MKVLSPILACLALAVVASHAALSPEQYWSYKLPNTPMPKAVKEILHPELMEEKSTSVNVGGGGVNVNTGKGKPAGGTHVNVGRKGVGVNTGKPGGGTHVNVGGKGVGVNTGKPGGGTHVNVGGKGGGVSVHTGHKGKPVNVNVSPFLYQYAASETQIHDDPNVALFFLEKDLHPGATMSLHFTENTEKSAFLPYQTAQKIPFSSNELPEIFNKFSVKPGSVKAEMMKNTIKECEQPAIEGEEKYCATSLESMIDYSISKLGKVDQAVSTEVEKQTPTHKYTITAGVQKMTNDKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 1362 - protein, 325 aa, Gossypium hirsutum
MERQRSKQVRLLMWVLVAALFSHNMVIAVTSTGLGEQKNYYPVPDPHAGTPPSGSHGTPPSSGGGTPPSHGTPSHGGGYHPSPTPSTPSGGNCGTPPHDPSTPSTPSHTPSHGTPPSSGGGSPPSYGGGSPPSYGGGSPPSYGGGSPPSYGGGSPPSYGGGSPPSYGGGSPTTPIDPGTPSIPSPPFFPAPTPPIGGTCDFWRSHPTLIWGLLGWWGTVGNAFGVTNVPGLGTSMSLPQALSNTRTDGLGALYREGTASFLNSMVNNRFPFSTKQVRETFVAALGSNSAAAAQLVSSSLPMKATSSKGPKQTPFWFVSFLNHFIH

SEQ ID NO: 1363 - protein, 301 aa, Gossypium hirsutum
MERQRSKQVRLLMWALVAALFSQNMVIAVTSTGLGEQKNYYPVPDPHAGTPPSGSHGTPPSSGGGTPPSHGTPSHGGGYHPSPTPSTPSGGNCGTPPHDPSTPSTPSHTPSHGTPPSSGGGSPPSYGGGSPPSYGGGSPPSYGGGSPPSYGGGSPPSYGGGSPTTPIDPGTPSIPSPPFFPAPTPPIGGTCDFWRSHPTLIWGLLGWWGTVGNAFGVTNVPGLGTSMSLPQALSNTRTDGLGALYREGTASFLNSMVNNRFPFSTKQVRETFVAALGSNSAAAAQARLFKLANEGHLKQRT

SEQ ID NO: 1364 - protein, 196 aa, Gossypium hirsutum
MIKMGFIVLALMVVSAATVVTAADESGLANECSKDFQSVMTCLSFAQGKAASPSKECCNSVAGIKENKPKCLCYILQQTQTSGAQNLKSLGVQEDKLFQLPSACQLKNASVSDCPKLLGLSPSSPDAAIFTNSSSKATTPSTSATTATPSSAADKTDSKSSGTKLGPHFVGSTAALLVATAAVFFLVFPAGFASIV

SEQ ID NO: 1365 - protein, 514 aa, Brachypodium distachyon
MDRLLAGFLGFLLIASVGSHAARAPEQYWKSALPNTPMPSSLSQLLNTPAGGTSVNVGWGGVHVDAGHGKPGGTTVDVGKGGVGVNTKPGGTTVGVGKGGVGVNVKPGGTTVGVGKGGVGVNVNPGHGKPGGTTVGVGKGGVGVNVNPSSGKPGGTTVDVGKGGVGVNVKPAYGKPGGSGTTVGVGKGGVDVNVKPGSGKPGGTTVGVGKGGVGVNVKPAYGKPGGSGTTVGVGKGGVGVNVKPGYGKPGGTTVGVGKGGVGVHVRPRGKPVNVNVSPFIYNYAATETQVHDDPSAALFFLEKDLHAGKKLAVHFMATTGAGEKFLPRSEADAIPFSSEKVPEILSRFSVKPDSTEAAQMTQTLHDCEEAAAKGEKKSCATSLESMVDFATSSLGTSHVRAVSTVVGKEGSPKQEYAMTSVKRTAGADRLVACHAEPYPYAVFACHLTQATRAYTVSMVGSTDGTAVEAVAVCHADTAGWNPRHVAFQVLKVKPGTVPVCHFLPQDHVVWTRSG

SEQ ID NO: 1366 - protein, 495 aa, Leymus cinereus x Leymus triticoides
  misc_feature (174)..(174): Xaa can be any naturally occurring amino acid
MDRLLAAGILGFLLIASVGSHAARAPEQYWNSALPNTPMPSSLSQLLNNQAGGTSVNVGWGGVHVDAGHGKPGGTTVDVGKGGVGVNVKPGSAKPGGTTVGVGKGGVGVNVNPGYGKPGGTTVGVGKGGVDVNVKPGSGTTVGVGKGGVGVNVKPGYGKPGGTTVGVGKGGVDXNVKPGSGKPSGTTVGVGKGGVGVNVKPAYGKPGGTGTTVGVGKGGVGVNVKPGYGKPGGTTVGVGKGGVGVQVKPRGKPVHVNVSPFVYNYAATETQLHDDPSAALFFLEKDLHTGKKMKVHFMATPGAGEKFLPRSEADTIPFSSEKVPEILTRFSVAPDSVEAAEMKQTLHECEATAAKGEKKSCATSLESMVDFATSSLGTSHVRAVSTVVGKEGSPKQEYTMTGVKRAAGADQLVACHAEPYAYAVFACHLTQATRAYTVSMVGKDGTAVEAVAVCHADTAGWNPRHVAFQVLKVKPGAAPVCHFLPQDHVVWTRSG

SEQ ID NO: 1367 - protein, 504 aa, Pseudoroegneria spicata
MDRLVAAGILGFLLIASVGSHAARAPEQYWKSALPYTPMPSSLSQLLNNQAGGTSVNVGSGGVHVDAGHGMPGGTTVDVGKGGVGVNVKPGTVKPGGTTVGVGKGGVGVNVKPGYGKPGGTTVGVGKGGVDVNVKPGNGKPSGTTVGVGKGGVGVNVKPGYGKPGGTTVGVGKGGVGVNVKPGGGTTVGVGKGGVGVNVKPAYGKPGGTGTTVGVGKGGVGVNVKPGYGKPGGTTVGVGKGGVGVNVKPGYGKPGGKPRGKPVHVNVSPFVYNYAATETQLHDDPSAALFFLEKDLHAGKKMDVHFMATPGAGEKFLPRSEADTIPFSSEKVPEILSRFSVAPDSVEAAEMKQTLRECEATAAKGEKKSCATSLESMVDFATSSLGTSHVRAVSTVVGKEGSPEQEYTMTGVKRAAGADQLVACHAEPYAYAVFACHLTQATRAYTVSMVGKDGTAVEAVAVCHADTAGWNPRHVAFQVLKVKPGAAPVCHFLPQDHVVWTRSG

SEQ ID NO: 1368 - protein, 506 aa, Triticum aestivum
MDRLVAAGILGFLLIASVGSHAHAARAPEQYWKSALPNTPMPSSLSQLLNNQAGGTSVNVGWGGVHVDAGHGMPGGTTVDVGKGGVGVNVKPGSAKPGGTTVGVGKGGVGVNVKPAYGKPGGTTVGVGKGGVDVNVKPGSGKPSGTTVGVGKGGVGVNVKPGYGKPGGTTVGVGKGGVGVNVKPGDGTTVGVGKGGVGVNVKPAYGKPGGTGTTVGVGKGGVGVNVKPGYGKPGGTTVGVGKGGVGVNVKPGYGKPGGKPRGKPVHVNVSPFLYNYAATETQLHDDPSAALFFLEKDLHAGKKMNVHFMATPGAGEKFLPRSEADAIPFSSEKAPEILSRFSVAPDSAEAAEMKQTLRECEATAAKGEKKSCATSLESMVDFATSSLGTSHVRAASTVVGKEGSPEQEYTMAGVRRAAGADQLVACHAEPYAYAVFACHLTQATRAYTVSMVGKDGTAVEAVAVCHADTAGWNPRHVAFQVLKVKPGGAPVCHFLPQDHVVWTRSG

SEQ ID NO: 1369 - protein, 451 aa, Panicum virgatum
MDRLLAGLLGFLLLASVGSHAARAPDQYWKSALPNTPMPSSLSQLLNTPAGGTTVNVGRGGVHVDAGHGKPGGTTVDVGKGGVGVNVNPGSGKPGGTTVGVGKGGVGVNVKPGYGKPGGTTVGVGKGGVGVNVKPGYGKPGGTTVGVGKGGVGVNVKPGYGKPGGTTVGVGKGGVGVNVKPGSGKPGGTTVGVGKGGVGVNVKPRGKPVHVDVAPFLYNYAATETQLHDDPSVALFFQEKELHPGKKMTVQFTNTVPGTKFLPRSEADAIPFSSEKVPEILSRFSVSPDSVEAAEMAQTLRDCEAPAAKGEKKACATSLESMVDFATAGLGTSHVRAVSTVVARPDSPKQEYTITGVKRAAGADDGRLVACHAEPYAYAVFACHQTRQTRAYSVSMLGRDGTAVDAVAVCHADTSGWNPKHVAFQVLNVKPGTVPVCHFLPQDHVVWTRSG

SEQ ID NO: 1370 - protein, 479 aa, Brachypodium distachyon
MAAGKKLVSPMEVSVEAGNADQASWLDDDGRPRRSGTFWTASAHIITAVIGSGVLSLAWAIAQLGWVAGPAVMLLFAAVIYYTSTLLAECYRTGDPATGKRNYTYMDAVRANLGGGRVVFCGVIQYANLVGVAIGYTIASSISMRAIRRAGCFHANGHGVPCKSSSNPYMILFGLVQIVFSQIPDFDQIWWLSIVAAVMSFTYSGIGLSLGIAQTISNGGIKGSLTGISIGVGGITGMQKVWRSLQAFGDIAFAYSFSNILIEIQDTIRAPPPSEAKVMKSATRLSVATTTVFYMLCGCMGYAAFGDAAPDNLLTGFGFFEPFWLLDVANVAIVVHLVGAYQVFCQPIFAFVERWAAATWPDSALFASARAEFRVGPFALSVFRLVWRSAFVCLTTVFAMLLPFFGNVVGFLGAVSFWPLTVYFPVEMYIKQRAVPRGGTQWLCLKMLSVGCLIVSVAAAAGSIADVIEALKVYRPFSG

SEQ ID NO: 1371 - protein, 480 aa, Zea mays
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPETGKRNYTYMDAVRSNLGGAKVAFCGVIQYANLVGVAIGYTIAASISMKAVRRAGCFHAHGHADPCNSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSVAAAAGSIADVIDALKVYRPFSG

SEQ ID NO: 1372 - protein, 465 aa, Zea mays
MDVSVEAGNAGAAEWLDDDGRPRRSGTFWTASAHIITAVIGSGVLSLAWAIAQLGWVAGPAAMLLFAFVTYYTAALLAECYRTGHPETGKRNYTYMDAVRSNLGGVKVVFCGVIQYANLVGVAIGYTIASAISMKAVRRAGCFHAHGHADPCKSSSTPYMVLFGGVQILFSQIPDFDQIWWLSIVAAVMSFTYSSIGLSLGIAQTVSNGGFKGSLTGISIGAGVTSTQKIWHTLQAFGDIAFAYSFSNILIEIQDTIKAPPPSESKVMQKATRLSVATTTVFYMLCGCMGYAAFGDNAPDNLLTGFGFYEPFWLLDVANVAIVVHLVGAYQVFCQPIFAFVERRAAAAWPDSAFVSRELRVGPFSLSVFRLTWRSAFVCVTTVVAMLLPFFGDVVGLLGAVSFWPLTVYFPVEMYIKQLRVPRGSTKWICLQTLSVSCLLVSVAAAAGSIADVIAALKVYKPFSG

SEQ ID NO: 1373 - protein, 465 aa, Zea mays
MEVSAEAGNAGAAEWLDDDGRPRRKGTFWTASAHIITAVIGSGVLSLAWAIAQLGWVAGPTAMLLFAFVTYYTATLLAECYRTGDPDTGKRNYTYMDAVRSNLGGAKVAFCGVIQYANLVGVAIGYTIASSISMKAIRRAGCFHTHGHGDPCKSSSTPYMILFGAAQVVFSQIPDFDQIWWLSIVAAVMSFTYSSIGLSLGIVQTVSNGGFKGSLTSIGFGAGVNSTQKVWHTLQAFGDIAFAYSFSNILIEIQDTIKAPPPSESKVMQKATRLSVATTTVFYMLCGCMGYAAFGDDAPDNLLTGFGFYEPFWLLDVANVAIVVHLVGAYQVFCQPIFAFVERRAAAAWPDSAFVSRELRAGPFALSPFRLAWRSAFVCVTTVVAMLLPFFGDVAGLLGAVSFWPLTVYFPVEMYIKQRRVPRGSARWISLQTLSVTCLLVSIAAAAGSIADVVDALKVYRPFSG

SEQ ID NO: 1374 - protein, 453 aa, Zea mays
ADRLDDDGRPRRKGTFWTASAHIITAVIGSGVLSLAWAIAQLGWVAGPAALLLFAFVTYYTATLLAECYRTGDPDTGKRNYTYMDAVRSNLGGTKVLLCGVIQYANLVGVAIGYTIASSISMKAVRRAGCFHVHGHGDPCRSSSTPYMILFGLVQILFSQIPDFDEIWWLSIVAAVMSFTYSSIGLSLGIVQTISNGGFMGSLTSISFGAGVSSTQKVWHTLQAFGDIAFAYSFSNILIEIQDTIKAPPPSESKVMQKATCVSVATTTIFYMLCGCMGYAAFGDNAPDNLLTGFGFYEPFWLLDVANVAIVVHLVGAYQVFCQPIFAFVERRAAAAWPDSAFISRELRVGPFALSLFRLTWRSSFVCVTTVVAMLLPFFGDVVGLLGAVSFWPLTVYFPVEMYIKHRRVPRGSTRWICLQTLSVTCLLVSIAAAAGSIADVIDALKVYRPFSG

SEQ ID NO: 1375 - protein, 470 aa, Oryza sativa
MEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKVWRSLQAFGDIAFAYSYSIILIEIQDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVAAAAGSIADVVDALKVYRPFSG

SEQ ID NO: 1376 - protein, 475 aa, Oryza sativa
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 1377 - protein, 475 aa, Oryza sativa
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 1378 - protein, 479 aa, Sorghum bicolor
MASHNGGTTKHLPPMEVSMEAGNGDAAEYLDDDGRPRRTGTFWTASAHIITAVIGSGVLSLAWAIAQLGWVAGPAAMLLFAFVTYYTATLLAECYRTGDPDTGKRNYTYMDAVRSNLGGARVAFCGCIQYANLVGVAIGYTIASSISMQAISRAGCFHKRGHAVPCKSSSNPYMILFGAVQILFSQIPDFDQIWWLSIVAAVMSFTYSSIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDIANIAIVVHLVGAYQVFCQPIFAFVERRAAAAWPDSAFIARELRVGPFALSLFRLTWRSAFVCVTTVVAMLLPFFGNVVGFLGAVSFWPLTVYFPVEMYIKQRRVPRGSTKWICLQTLSVGCLFVSIAAAAGSIADVIDALKVYHPFSS

SEQ ID NO: 1379 - protein, 465 aa, Sorghum bicolor
MEVSVEAGNAGAAAWLDDDGRPRRTGTFWTASAHIITAVIGSGVLSLAWAIAQLGWVAGPTAMLLFAFVTYYTATLLAECYRTGDPETGKRNYTYMDAVRSNLGGAKVVFCGIIQYANLVGVAIGYTIASSISMKAIRRAGCFHSHGHEDPCKSSSTPYMILFGVVEILFSQIPDFDQIWWLSIVAAVMSFTYSSIGLSLGIAQTVSHGGFKGSLTGVSIGAGVTSTQKIWHTLQAFGDIAFAYSFSNILIEIQDTIKAPPPSESKVMQKATRLSVATTTIFYMLCGCMGYAAFGDAAPDNLLTGFGFYEPFWLLDIANIAIVVHLVGAYQVFCQPIFAFVERRAAAAWPDSAFISRELRVGPFALSVFRLTWRSAFVCVTTVVAMLLPFFGDVVGLLGAVSFWPLTVYFPVEMYIKQRRVPRGSTKWLCLQTLSVTCLLVSIAAAAGSIADVVDALKVYRPFSG

SEQ ID NO: 1380 - protein, 479 aa, Sorghum bicolor
MAVHSGVNKHAVAPMEVSVEAGNAGDAAWLDDDGRPRRTGTFWTASSHIITAVIGSGVLSLAWAIAQLGWVAGPAAMLLFAFVTYYTATLLAECYRTGDPETGKRNYTYMDAVRSNLGGANVVFCGVIQYANLVGVAIGYTIASSISMKAIRRAGCFHTHGHADPCKSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDAAPDNLLTGFGFYEPFWLLDVANVAIVVHLVGAYQVFCQPIFAFVERRAAAAWPDSAFIARELRVGPFALSVFRLTWRSAFVCVTTVVAMLLPFFGNVVGFLGAVSFWPLTVYFPVEMYIKQRRVARGSTKWICLQTLSISCLLVSIAAAAGSIADVIDALKVYRPFSG

SEQ ID NO: 1381 - protein, 465 aa, Sorghum bicolor
MEVTVEAGNAGEAAWLDDDGRPRRAGTFWTASAHIITAVIGSGVLSLAWAIAQLGWVAGPAAMLLFAFVTYYTATLLAECYRTGDPETGKRNYTYMDAVRSNLGGAKVALCGVIQYANLVGVAIGYTIASSISMKAIRRAGCFHTHGHEDPCKSSSIPYMVVFGAVQIVFSQIPDFDQISWLSIVAAVMSFTYSSIGLSLGIAQTISNGGFKGSLTGISIGAGVTSTQKVWHSLQAFGDIAFAYSFSNILIEIQDTIKAPPPSESKVMQKATRLSVATTTIFYMLCGCMGYAAFGDAAPDNLLTGFGFYEPFWLLDVANVAIVVHLVGAYQVFCQPIFAFVERRAAAAWPDSAFISRELRVGPFALSLFRLTWRSAFVCVTTVVAMLLPFFGDVVGFLGAVSFWPLTVYFPVEMYINQRRVARGSTKWICLQTLSISCLLVSIAAAAGSIADVIDALKVYRPFSG

SEQ ID NO: 1382 - protein, 465 aa, Sorghum bicolor
MEVSAEAGNAGAAEWLDDDGRPRRKGTFWTASAHIITAVIGSGVLSLAWAIAQLGWVAGPTAMLLFAFVTYYTATLLAECYRTGDPDTGKRNYTYMDAVRSNLGGKKVVFCGVIQYANLVGVAIGYTIASSISMKAIRRAGCFHTHGHGDPCKSSSTPYMILFGVVQILFSQIPDFDEIWWLSIVAAVMSFTYSSIGLSLGIAQTVSNGGFKGTLTSIGFGAGVTSTQKIWHTLQAFGDIAFAYSFSNILIEIQDTIKAPPPSESKVMQKATRLSVATTTIFYMLCGCMGYAAFGDNAPDNLLTGFGFYEPFWLLDVANVAIVVHLVGAYQVFCQPIFAFVERRAAAAWPDSAFISRELRVGPFALSLFRLTWRSAFVCVTTVVAMLLPFFGDVAGLLGAVSFWPLTVYFPVEMYIKQRRVPRGSPRWISLQTLSFTCLLVSIAAAAGSIADVVDALKVYQPFSG

SEQ ID NO: 1383 - protein, 486 aa, Triticum aestivum
MEKRQATYGKGAARMAPMEVSVEAGNGRESDWLDDDGRPRRSGTVWTASAHIITAVIGSGVLSLAWAIAQLGWVAGPAIMLLFALVIYYTSTLLAECYRSGDPETGKRNYTYMDAVRSYLPGTKVKLCGVIQYANLVGVAIGYTIAASISMRAIGRADCFHYHDVRGRSGKDECKSSSNPYMIVFGVVQILFSQIPDFDQIWWLSIVAAVMSFTYSTIGLGLGIAQTVANGIQGSLTGLSVGPGVTSMQKVWRSLQAFGNIAFAYSYSIILIEIQDTVKAPPPSEAKVMQKATGISVATTTVFYMLCGCMGYAAFGDAAPDNLLTGFGFYEPFWLLDVANAAIVLHLVGAYQVFCQPLFAFVEKWAAARWPDSAFIARELRVGPFAISVFRLTWRTAFVCLTTVVSMLLPFFGDVVGLLGAVAFWPLTVYFPVEMYIVQRGVRRGSTRWVCLQMLSAACLVVSVAAAAGSIADVIGELKEYRPFSG

SEQ ID NO: 1384 - protein, 135 aa, Brassica rapa
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGVFGSSFHTKHSKPNIIHSIFHREGHEAHSH

SEQ ID NO: 1385 - protein, 132 aa, Brassica rapa
MTKFWTLVTALHTGAGPVVMLVYPLYASVVAMETATKVDDEQWLSYWIIYSFLTLTELILQSLLEWIPIWYSVKLVFVAWLVLPQFHGAAFIYNRLVREQFKKHGVFPHQQSKPKILHSIFPHREGHEAHSH

SEQ ID NO: 1386 - protein, 135 aa, Brassica napus
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGFFGSSFHTKHSKPNIIHSIFHREGHEAHSH

SEQ ID NO: 1387 - protein, 140 aa, Raphanus sativus
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGVFGSSSSSHTKHSKHSKPNIIHSIFHREGQEAHSH

SEQ ID NO: 1388 - protein, 140 aa, Raphanus sativus
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGVFGSSSSSHTKHSKLSKPNIIHSIFHREGHEAHSH

SEQ ID NO: 1389 - protein, 140 aa, Raphanus sativus
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGVFGSSSSSHTKHSKHSKPNIIHSIFHREGHEAQSH

SEQ ID NO: 1390 - protein, 142 aa, Raphanus sativus
MSKFWTFLTALHSGAGPLVMLVYPLYASVVAMESTTKVDDEQWLAYWIIYSFLTLTELILQSLLEWIPIWYSVKLVFVAWLVLPQFHGAAFIYNRVVREQFKKHGVFGSSSSSSHTKHSKHSSKPNIIHSIFHREGHEAHSH

SEQ ID NO: 1391 - protein, 140 aa, Thellungiella halophila
MSKFWTFLTALHSGAGPLVMLLYPLYASVVAMESATKVDDEQWLAYWIIYSFLTLSELILQSLLEWIPIWYSVKLVFIAWLVLPQFQGAAFIYNRLVREQFKKHGVFRSSSHHSKHNNKPSLLQSIFPHREGHGHEAHSH

SEQ ID NO: 1392 - protein, 175 aa, Malus domestica
MANEPTRIMLGVNESTIKGYPHPSISSRKAFEWTLQKIVRSNTSGFKLQFLHVQVPDEDGFDDMDSVYASPEDFKNLKNRDRARGLHLLEFFVDRCHAIGVACEAWIKRGDAKEVICREVKHVQPDLLVVGCRGLGPFQRVFVGTVSEFCVKHAECPVITIKRSAEETPQDPVDD

SEQ ID NO: 1393 - protein, 175 aa, Malus domestica
MASEPTRIMLAVNESTIKGYPHASISSRKAFEWTLQKIVRSNTSGFKLQFLHVQVPDEDGFDDMDSVYASPEDFKNMKDRDRARGLHLLEFFVDRCNAIGVACEAWIKRGDAKEVICREVKRVRPDFLVVGCRGLGPFQRVFVGTVSEFCVKHAECPVITIKRSAEETPQDPVDD

SEQ ID NO: 1394 - protein, 175 aa, Prunus armeniaca
MEGDPTRIMLAVNESTIKGYPHASISSRKAFEWTLQKIVRSNTSGFKLLFLHAQVPDEDGFDDMDSVYASPEDFKNLRNRDRARGLHLLEFFVERCHAIGVGCEAWIKKGDPKEVICHEVKRVHPDFLVVGCRGLGPFQRVFVGTVSEFCVKHAECPVITIKRSAEESPQDPVDD

SEQ ID NO: 1395 - protein, 175 aa, Brassica oleracea
  misc_feature (169)..(169): Xaa can be any naturally occurring amino acid
MESEPTRVMVAVNESTIKGYPHASISSKKAFEWTLRKIVRSNTSGFKLLLLHAQVQDEDGFDDMDSIYASPDDFRNMRERNKANGLHLLEFFVNKCHEIGVRCEAWIRKGDPTEVICHEVRRVRPDFLVVGSRGLGPFQKVFVGTVSEFCVKHAECPVIIIKRSAEESXQDPADD

SEQ ID NO: 1396 - protein, 175 aa, Brassica rapa
MESEPTRVMVAVNESTIKGYPHASISSKKAFEWTLKKIVRSNTSGFKLLLLHAQVQDEDGFDDVDSIYASPDDFRNMRERNKANGLHLLEFFVNKCHEIGVRCEAWIRKGDPTEVICHEVRRVRPDFLVVGSRGLGPFQKVFVGTVSEFCVKHAECPVIIIKRSAEESPQDPADD

SEQ ID NO: 1397 - protein, 178 aa, Theobroma cacao
  misc_feature (94)..(94): Xaa can be any naturally occurring amino acid
  misc_feature (106)..(106): Xaa can be any naturally occurring amino acid
  misc_feature (119)..(119): Xaa can be any naturally occurring amino acid
MATSEATATRIMLAVNQSTIKGYPHASISSRGAFEWTLQKIVRSNTSGFKLLFLHVQVPDEDGFDDMDSIFASPEDFKSMRHRDRARGLHLLEXFVTKCHQIGVAXEAWIKKGDPKEVXCHEVKRVQPDLLVVGSRGLGPFQRVFVGTVSEFCVKHAECPVVTIKRNPDEAPQDPVDD

SEQ ID NO: 1398 - protein, 175 aa, Brassica napus
MESEPTRVMVAVNESSIKGYPHASISSKKAFEWTLKKIVKSNTSGFKLLLLHAQVQDEDGFDDMDSIYASPDDFRNMRERNKANGLHLLEFFVNKCHEIGVRCEAWIRKGDPTEVICHEVRRVRPDFLVVGSRGLGPFQKVFVGTVSEFCVKHAECPVIIIKRSAEESPQDPADD

SEQ ID NO: 1399 - protein, 175 aa, Brassica napus; identical to SEQ ID NO: 1396

SEQ ID NO: 1400 - protein, 175 aa, Manihot esculenta
MEGEPTRIMIGVNESTIKGYPHPSISSKGAFDWTLQKIVRSNTCGFKLLFLHVQVPDEDGFDDMDSIYASPDDFKSMKQRDRVRGLHLLEYFVNRCHQIGVACEAWLKRGDPKEEICREVRRVQPDLLVVGSRGLGPFQRVFVGTVSEFCQKHAECPVISIKRRAEETPQDPVDD

SEQ ID NO: 1401 - protein, 175 aa, Catharanthus roseus
  misc_feature (143)..(143): Xaa can be any naturally occurring amino acid
MESEPTRIMIGVNQSTIKGYPHTSISSKGAFDWTLKKIIRSNISGFKLLFLHVQVPDEDGFDDMDSIYASPEDFKRMNRRDKIRGLHLLEYFVHQCHEIGIACEAWIKKGDPKEVICHEVKRVQPDILVVGSRGLGPFQRVFXGTVSEFCAKHGECPVITIKRSAAESPQEPVDD

SEQ ID NO: 1402 - protein, 175 aa, Citrus sinensis
MEGEPTRIIVAVNESTIKGYPHASISSRGAFEWSVQKIIRSNTSGFKLLFLHVQVPDEDGFDDMDSIYASPEDFRRMQHRDKVRGLHLLEYFVNRCHEIGVACEAWIKKGDPKEVICREVQRVQPDLLVVGSRGLGPFQRVFVGTVSEFCVKHAECPVITIKRRADETPEDPVDD

SEQ ID NO: 1403 - protein, 175 aa, Coffea canephora
  misc_feature (52)..(52): Xaa can be any naturally occurring amino acid
  misc_feature (108)..(108): Xaa can be any naturally occurring amino acid
MESEPTRIMMGVNESTIKGYPHASISSRGAFDWTLKKIIRSNTSGFKILFLXVQVPDEDGFDDMDSIFASPEDFRRMNHRNKIRGLHLLEYFVNRCHEVGVACEAWIXKGDPKEVICHEVRRVQPDFLVVGSRGLGPFQRVFVGTVSEFCVKHAECPVITIKRSAAESPQDPVDD

SEQ ID NO: 1404 - protein, 178 aa, Gossypium hirsutum
MATSEASVTRIMVAVNESTIKGYPHASISSKGAFEWTLQKIVMSNTSGFKLLFLHVQVPDEDGFDDMDSIYASPEDFKSLKSRDRARGLHLLEFFVTRCHEIGVACEAWIKKGDPKEVICHEVRRIQPDLLVLGSRGLGPFQRVFVGTVSEFCVKHAECPVVTIKRRSDETPQDPVDD

SEQ ID NO: 1405 - protein, 180 aa, Cynara scolymus
MATIRVDSEVTRIMMGVNESSIKGYPHASISSKSAFEWTLNKIIRSNTSGFKLLFLHVQVPDEDGFDDIDSIYASPEDFRDLNRKDKINGSHLLEYFVNRSHEIGVACEAWIKKGDPKEVICHEVKRVQPDLLVVGNRGLGPFQRVFVGTVSEFCVKHCECPVVTIKRSADETPQDPVDD

SEQ ID NO: 1406 - protein, 175 aa, Ipomoea nil
MADEQTKIMIAVNESTMKGYPHPSISSKGAFEWTLDKIVRSNTAGFKLLFLHVQVPVEDGFDDTDSLFASPEDFKNLRHKDKIKGLHLLEYFVNQCHERGVSCEAWIKRGDPKDVICHEIKRVHPDLLVVGCRGLGPFQRVFVGTVSEFCVKHAECPVVTIKRSASETPQDPVDD

SEQ ID NO: 1407 - protein, 179 aa, Actinidia deliciosa
  misc_feature (105)..(105): Xaa can be any naturally occurring amino acid
MEGGAESVATRIMVGVNESTIKGYPHASISSKGAFEWTLKKIVRSNTSSFKLLFLHVQVTDEDGFDDMDSIYASPDDFKTMNRRNKIRGLHLLEYFVHRCHEIGXPCEAWIKKGDPKEVILHEVKRVQPDFLVVGSRGLGPFQKVFVGTVSEFCVKHADCPVITIKRKPGEAPQDPADD

SEQ ID NO: 1408 - protein, 175 aa, Prunus persica
MGGEPTRIMLAVNESTIKGYPHASISSRKAFEWTLHKIVRSNTSGFKLLFLHVQVPDEDGFDDMDSVYASPEDFKNLRNRDRAKGLHLLEFFVERCHAIGVGCEAWIKKGDPKEVICHEVKRVQPDFLVVGCRGLGPFQRVFVGTVSEFCVKHAECPVITIKRSAEETPQDPVDD

SEQ ID NO: 1409 - protein, 175 aa, Capsicum annuum
MEGESTLVMVAVSESTINGYPHASISSKGAFEWTLNKIVRSNTSGFKLLFLHVQVPDEDGFEDMDSIFASPEDFKGMKNRDKIRGLHLLECFVNRCHEIGVPCEAWTKKGDPKEIICHEVKRVQPDLLVVGCRGLGPFQRVFVGTVSEFCVKHAECPVVTIKRSAAETPQDPIDD

SEQ ID NO: 1410 - protein, 175 aa, Catharanthus roseus; identical to SEQ ID NO: 1401
  misc_feature (143)..(143): Xaa can be any naturally occurring amino acid

SEQ ID NO: 1411 - protein, 95 aa, Petunia hybrida
  misc_feature (46)..(46): Xaa can be any naturally occurring amino acid
MANEGEITKIMLGVNESTIKGYPHASISSKGAFEWTLNKLVRNNTXGFKLLFLHVKVPDEDGFDDMDSIFASPDDFKVMKHKGQDQRAPSAGILC

SEQ ID NO: 1412 - protein, 176 aa, Populus trichocarpa
MEGAEATRIMMGVNESTIKGYPHASISSRGAFDWTLQKIVRSNTSGFKLLFLHVQVPDEDGFDDMDSLYASPEDFKNMKHRDRTRGLHLLEYFVNRCHEIGVACEAWIKKGDPKEVICHEVKRVQPDLLVVGSRGLGPFQRVFVGTVSEFCQKHAECPVISIKRRADETPQDPVDD

SEQ ID NO: 1413 - protein, 175 aa, Prunus persica; identical to SEQ ID NO: 1408

SEQ ID NO: 1414 - protein, 181 aa, Carthamus tinctorius
MATTIRVDSEVTRIMMGVNESSIKGYPHASISSKSAFEWTLNKIIRSNTSGFKLLFLHVQVPDEDGFDEVDSIYASPEDFRDANRRDKINGSHLLEYFVNRSHEIGVACEAWVKKGDPKEVICHEVKRVQPDLLVVGNRGLGPFQRVFVGTVSEFCVKHCECPVVTIKRSADETPQDPVDD

SEQ ID NO: 1415 - protein, 175 aa, Glycine max
MAEEVTRVMVAVNESSMKGYPHPSISSKGAFEWTINKIVRNNVSAFNLLFLHVQVPDEDGFNDMDSIYASPDDFKNMNQRDRIRGVHLMEYFVNRCHEIGVVCQAWIMKGDPKEVICHEVKRLRPDLLVVGSRGLGPFQKVFVGTVSEFCWKHAECPVISIKRKPDETPQDPVDD

SEQ ID NO: 1416 - protein, 175 aa, Glycine max
MAEEVTRVMVAVNESSIKGYPHPSISSKGAFDWTINKIVRDNVSAFNLLFLHVQVPDEDGFDDMDSIFASPDDFKNMNQRDRIRGVHLLEYFINRCHEIGVVCQAWIMHGDPKEVICHEVKRLRPDLLVVGSRGLGPFQKVFVGTVSEFCWKHAECPVISIKRKPDETPQDPVDD

SEQ ID NO: 1417 - protein, 175 aa, Euphorbia esula
MEGEPTRIMIAVNESTIKSYPHPSISSKGAFEWTLEKIVRSNSPGFKLLFLHVQVPDEDGFDDMDSIYASPEDFKSMKKRDKIRGIHLLEYFVDKCHHMGITCESWVKHGDPKEIICHEVKRVQPDLLVVGCRGLGPFQRVFVGTVSEFCQKHAECPVLSIKRRAEETPEDPVDD

SEQ ID NO: 1418 - protein, 176 aa, Fragaria vesca
MAGAAPTRVLMGVNESTINGYPHASISSRKAFEWTLDKIVRSNTSGFKLFFLHVQVPDEDGFDDMDSIYASPEDFKSLKRRDQARGAHLLEFFVERCHAIGVACEAWIKRGDPKEVICHEVKRLQPDLLVVGCRGLGPFQRVFVGTVSEFCVKHAECPVITIKRSAEETPQDPVDD

SEQ ID NO: 1419 - protein, 180 aa, Helianthus annuus
MATTTVDSDVTRIMLGVNESSIKGYPHASISSKSAFEWTLNKIIRNNTAGFKLLFLHVQVPDEDGFDEVDSIYASPEDFKDANRRDKIRGSHLLEFFVKRCHEIGVACEAWIKKGDAKEVICHEVKRVQPDLLVVGNRGLGPFQRVFVGTVSEFCVKHCECPVVTIKRSVDETPQDPVDD

SEQ ID NO: 1420 - protein, 175 aa, Thellungiella halophila
MDSEPTRVMVAVNESTIKGYPHASISSKKAFEWTLKKIVRSNTSGFKILLLHAQVGDEDGFDDMDSIYASPDDFRQLRERNKAKGLHLLEFFVNKCHEIGVGCEAWIRKGDPTEVICHEVRRVRPDFLVVGSRGLGPFQKVFVGTVSEFCVKHAECPVITIKRSAEESPQDPADD

SEQ ID NO: 1421 - protein, 176 aa, Nicotiana tabacum
  misc_feature (45)..(45): Xaa can be any naturally occurring amino acid
MEGEAITRIMVGVNESTIKGYPHASISSKGAFEWTLKKIVRNNTXGFKLLFLHVQVPDEDGFEDMDSIFASPEDFKVLKHRDKIRGLHLLEYFVNRCHEIGVPCEAWIKQGDPKEVVCHEVKRVQPDLLVVGCRGLGPFQRVFVGTVSEFCVKHAECPVVTIKRSAAETPQDPIDD

SEQ ID NO: 1422 - protein, 275 aa, Solanum tuberosum
MEWEKQQQQQQPVSAPQQTVEELNGAVSGGMFVKVMTDEQMEVLRKQIAVYATICEQLVDLHKSMASQHDLAGARLGNLYCDPLVTSAGHKITGRQRWTPTPMQLQILERIFEQGNGTPTKQKIKDITSELSQHGQISETNVYNWFQNRRARSKRKQQVAATNTTESEVETEVESPNEKKTKPEDLQSSHMPTSMAEDLGYENPDVSSGMHSLDPRTSKPEPMFPSDGSSKPAASYGQMSFYGMSNPRMDQLMGKMEVPGSYHPYLHADDYNMTG

SEQ ID NO: 1423 - protein, 276 aa, Solanum tuberosum
MDWEKQQQQQQPPVSAPQQTAEELNGAVSSGMFVKVMTDEQMEVLRKQIAVYATICEQLVDLHKSMASQHDLAGARLGNLYCDPLVTSAGHKITGRQRWTPTPMQLQILERIFEQGNGTPTKQKIKDITSELSQHGQISETNVYNWFQNRRARSKRKQQVAATNTAESEVETEVESPNEKKTKPEDLQSSHMPTSMAEDLGYENPDVSSGMHSLDPRTSKPEPMFPSDGSSKPAASYGQMSFYGMPNPRMDQLMGKMEVPGSYHPYLHADDYNMTG

SEQ ID NO: 1424 - protein, 275 aa, Solanum tuberosum
MDWEKQQQQQPPVSAPQQTAEELNGAVSSGMFVKVMTDEQMEVLRKQIAVYATICEQLVDLHKSMASQHDLAGARLGNLYCDPLVTSAGHKITGRQRWTPTPMQLQILERIFEQGNGTPTKQKIKDITSELSQHGQISETNVYNWFQNRRARSKRKQQVAATNTTESEVETEVESPNEKKTKPEDLQSSHMPTSIVEDLGYENPDMSSGMHSLDPRTSKPEPMFPSDDSSKPAASYGQMSFYGMPNPRMDQLMGKMEVPGSYHPYLHADDYNMTG

SEQ ID NO: 1425 - protein, 460 aa, Brachypodium distachyon
SLYAPIAQSISSSKRSHKLIRFRRRRSIRIPWGSTRRRAPRPPGSTRGRRCCCRSTAGAAAAARTYRRSPRPFANVFIAVVGSGVLGLPYTFSRTGWAAGSILLFAVAALTFHCMMLLVACRRRLADEHPKIASFGDLGAAVYGAAGRHVVDAMLVLSQASFCVGYLIFIANTLAHLYPIAVGDSSSSSSPLLTAKALFIWAMLPFQLGLNSIKTLTLLAPLSIFADVVDLGAMGVVLGQDASTWLAERPPVFAFGGLAEILYGLGVAVYAFEGIGMVLPLEAEAADKRKFGGTLAMSMAFIAVMYGLFGAMGYLAFGASTRDIITTNLGAGWLSVAVQLGLCINLFFTMPVMMNPVYEVAERLLYGKRYAWWLRWLLVVFVGLMAMLVPNFADFLSLVGSSVCVLLGFVLPAAFHLKVLGAEIGWPALIGDAAVIVVGVALSLSGTWTSLAQMFGSSDA

SEQ ID NO: 1426 - protein, 425 aa, Zea mays
MGFDKEASSSSSRLDAAPLLPQHGGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQASFCVGYLIFISNTMAHLYPIAIGAQSPASPLLTAKALFIWAMLPFQLGLNSIRTLTLLAPLSIFADVVDLGAMGVVLGQDASVWLADRPPVFAFAGPAQLLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVLVGLLAMLVPNFADFLSLVGSSVCVVLGFVLPAVFHLKVFGTEIGWAGLVADVAIIVTGIALAVSGTWTSLVQIFSSSDL

SEQ ID NO: 1427 - protein, 422 aa, Oryza sativa
MGLGNEASSSSSRLLDPAPLLPHHGGDGAGKLSSQPKTFANVFIAVVGAGVLGLPYTFSRTGWAAGSILLLSVAALTFYCMMLLVACRRRLADEHPKIASFGDLGDAVFRGPGRLAVDTMLVLSQASFCVGYLIFISNTMAHLYPVFAPSSNALLSPKALFIWAMLPFQLGLNSIKTLTLLAPLSIFADVVDLGAMGVVLGEDVSVWLAKPPPVFAFGGLSAILYGIGVSVYAFEGIGMVLPLEAEAANKKKFGTTLGLSMGFIAVMYGLFGAMGYIAFGDATRDIITTNLGTGWLSAAVQLGLCINLFFTMPVMMHPVYEVAERLLHGKRYCWWLRWLLVLAVGLSAMYVPNFTDFLALVGSSVCVLLGFVLPASFHLKVFGAEMSWSGVLSDVLLVLLGLSLAVFGTYTSLLQIFHSSSA

SEQ ID NO: 1428 - protein, 426 aa, Sorghum bicolor
MGFDKEASSSSSRLDAAPLLPQHGLHGGGGGGGHLSSQPKTFANVFIAVVGSGVLGLPYTFSRTGWAAGTLLLLAVAALTFHCMMLLVATRRRIADEHPKIASFGDLGHAVYGAPGRHAVDAMLVLSQASFCVGYLIFISNTMAHLYPIGAESPASPLLTAKALFIWAMLPFQLGLNSIKTLTLLAPLSIFADVVDLGAMGVVLGQDASIWLANKPPVFAFAGPAELLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVVVGLLAMLVPNFADFLSLVGSSVCVVLGFVLPATFHLKVFGAEIGWTGLVADVAVIVIGTVLAVSGTWTSLVQIFSSSNL

SEQ ID NO: 1429 - protein, 465 aa, Oryza sativa
METVATEPGTCLRRLPDDLVADEILTRLPARSLARFASVCGAWRAAISGDPSSFLRRRRKKEHSSSFLLLLYALVEDAERRLAFSNHVPFYRLRWPDDGGDGAPQLVHVSVFGDGGEEPTLSLPRTCDGLVLLPNGDDVHVINPATGDVLTLPQSSRVAAAADHSTGLGLDTRTNTYKVARYIHLSTAAAAAAAEDDGAAVMEVFTIGHGDAAAWRETTTPPPPSYPVCHVRTAIHSRGNLFWKLQLRRSPAAAAAGSFLLLRFNLAHETFTVVHHPRPPSHLPSADQNGEPPPPPPPLLSELDGELCLGLLVSGRQELWLYSNNGGGGGGDDRWQWEQRFSIAVSGPDAMYLPLGVLRRHDRLLLQKGVHLYHHDSGGGEESVREVARMDEFEFEWSFPGEPYAFMVIPYTESLVRVTAARPINKTAAATAMAGETAATMMATPERPKRARRANSRYIGDMWDV

SEQ ID NO: 1430 - protein, 78 aa, Oryza sativa
MSCCGGSCNCGSSCKCGSGCGNMYPDLAEKTTNTSATMVLGVAPAKEQFEGVGKAAESGEAAHGCSCGSSCKCNPCNC

SEQ ID NO: 1431 - protein, 106 aa, Oryza sativa
MAGESRRRRRAAAEAVAWCLALGVVALLLVGSVEKEEEVVVVRGARLAAARPCEEIYVVEEGETLHSISDRCGDPYILEQNPHVHDPDDVFPGLVIKITPRPGRRN

SEQ ID NO: 1432 - protein, 604 aa, Zea mays
MAPTTATAAAVGTKATALGVAACERDVEKLEFIEDKTRNFDAEQVRVLAEILARNNGAEYLRRHGMEGRTDRLAFKACVPVVTYEDLRPEIERIANGDRSNIISSHPITEFLTSSGTSAGERKLMPTIEDELNRRQMLYSLLMPVMNLYVPGLDKGKGLYFLFIKSETKTPGGLPARPVLTSYYKSDHFKHRPYDPYNVYTSPTAAILCTDSFQSMYSQMLCGLVARAEVLRVGAVFASGLLRAIRFLQLHWQELAHDLRTGTLSAKVTEPSIREAVAEVLRPDAGLADLVEAECGKESWEGIITRVWPNTKYLDVIVTGAMAQYIPTLKYYSGGLPMACTMYASSECYFGLNLRPMCDPSEVSYTIMPNMGYFELLPHDPDAVPPSRDDPPPRLLDLADAEVGRDYELVITTYAGLCRYRVGDILHVTGFHNAAPQFRFVRRKNVLLSVDSDKTDEAELQAAVERAARLLAPYDAAIAEYTSQADATTIPGHYVVYWELMVREGGASPDAAVFERCCLEMEEALNAVYRQGRNGDAIGPLEIRVVRGGTFEEVMDYAISRGASINQYKAPRCVSFGPIIELLNSRVVSSHFSPACPTYSPHKK

SEQ ID NO: 1433 - protein, 613 aa, Sorghum bicolor
MAPMATAAAAAAVGRVTALGVAACERDVEKLEFIEDKTKNFDAEQVRVLAEILARNNGAEYLRRHGMEGRTDRQAFKARVPVVTYEDLRPEIDRIANGDRSNIISSHPITEFLTSSGTSAGERKLMPTIEDELNRRQMLYSLLMPVMNLYVPGLDKGKGLYFLFIKSETKTPGGLPARPVLTSYYKSDHFKHRPYDPYNVYTSPTAAILCTDSFQSMYSQMLCGLVARTEVLRVGAVFASGLLRAIRFLQLHWKELAHDLRTGTLSARVVEPSIRDAVAEVLTKPDAGLADLVEAECGKDNWEGIITRVWPNTKYLDVIVTGAMAQYIPTLKYYSGGLPMACTMYASSECYFGLNLRPMCDPSEVSYTIMPNMGYFELLPHDPEDKPAVSSSSAASAMDHDRLLVDLADAEVGKEYELVITTYAGLCRYRVGDILHVTGFHNAAPQFRFVRRKNVLLSIDSDKTDEAELQSAVERASRLLAPYDARIVEYTSQADATTIPGHYVVYWELMVRDGGASPEPDVFERCCLEMEEALNAVYRQGRNGDAIGPLEIRVVRGGTFEEVMDYAISRGASINQYKAPRCVSFGPIIELLNSRVVSRHFSPACPTYSPHKK

SEQ ID NO: 1434 - protein, 603 aa, Panicum virgatum
MAPTEAAAANGRVTALGVAACERDAEKLEFIEDKTKNFDAEQVRVLAEILERNGGAEYLRRHGMEGRTDRAAFKAHVPVVTYEDLRPEIERIANGDRSNIISSHPITEFLTSSGTSAGERKLMPTIEDELDRRQMLYSLLMPVMNLYVPGLDKGKGLYFLFIKSETQTPGGLPARPVLTSYYKSDHFRHRPYDPYNVYTSPTAAILCTDSFQSMYSQMLCGLLARTEVLRVGAVFASGLLRAIRFLQLHWKELAHDIRTGTLSARVTEPSIQAAVAEVLAPDGDLADFVEAECAKDSWEGIITRVWPNTKYLDVIVTGAMAQYIPTLRYYSGGLPMACTMYASSECYFGLNLRPMCDPSEVSYTIMPNMGYFELLPHDPEAGEPAAGPPPRLVDLADAEVGKEYELVITTYAGLCRYRVGDILQVTGFHNAAPQFRFVRRKNVLLSIDSDKTDEAELQAAVERAAALLAPYGAGIVEYTSQADAAAIPGHYVVYWELMVREGAGGRMPEAAVFERCCLEMEEALNSVYRQLRNGDAIGPLEIRVVRGGTFEEVMDYAISRGASINQYKAPRCVSFGPIIELLNSRVMSKHFSPACPKFSPHRN

SEQ ID NO: 1435 - protein, 401 aa, Sorghum bicolor
RPGILLSVAALAVAAVAALAPAPVAATKYNITKILAPYKEYSKFNEMLSKTRLAYDINRRQTITVLAVDNSAMSALDHYSLQTIRHILSLHVLVDYYGDKKLKKLAHGATASSSMFQATGSASGMSGYVNITRKDGKVSFMTEDADDTAKPSRYVKSVKEYPYDIAVLQVSSIISSAEAEAPVPAPAPVDLVELLSKRYCKSFASLLSADAEAFRAANESKDNGLTLFCPVDSAVASFAATYKNLTAKAKTAILLYHAVPDYFSLQLLKSNNGMVTTLATASEKKMDYSYDVKNKDETVTLQTRVVTSSVTATVGDMEPLAVYAVDKFLQPKELFKVVEAPAPAPEPSSKKKKAGRGGGDDDDDSSDDSTADAEKGDAAPALLARWVVTAAAAAVAAYALI

SEQ ID NO: 1436 - protein, 389 aa, Saccharum officinarum
MARSRPGILLALAFAMAAVAALAPAPVAATKYNITKILAPYKEYSKFNEMLSKTRLAYDINRRQTITVLAVDNAAMSALDHYSLQTIRHILSLHVLVDYYGDKKLKKLAHGSTASSSMFQATGSASGMSGYVNITRKDGKVSFMTEDADDTAKPSRYVKSVKEYPYDIAVLQVSSIISSAEAEAPVPPPAPVDLVELLSKRYCKSFASLLSANAEAFRAVNETKDNGLTLFCPVDSAVASFAATYKNLTAKAKTAILLYHGVPDYFSLQLLKSNNGMVTTLATASEKKMDYSYDVKNKDETVTLQTRVVTSSVTATVGDMEPLAVYAVDKFLQPKELFKVVEAPAPAPEPSKKKKAGHGGGDDDSSDDSTADAEKGDAAPALLARWVVT

SEQ ID NO: 1437 - protein, 402 aa, Panicum virgatum
MARSRPAVLLSLAVVALAATALAPAPAAATKYNITKLLAPYKQYSRFNEMLSRTRLAYDINRRQTITVLAVDNAAMSALDHYSLQTIRHILSLHVLVDYYGDKKLKKLAHGSTASSSMYQATGAASGMSGYVNITRKDGKVSFTTDDADATAKPTRYIRSIKEYPYDIAVLEVSSIISSADAEAPVPPPAPVDLVELLSKKYCKSFASLLSANADVLRTLNETKDNGLTLFCPVDSAVAAFAATYKNLTAKAKTAILLYHGVPDYFSLQLLKSNNGMVTTLATASENKKDYSYDVQNKGETVTLQTRVVTSSITATVGDMEPLAVYAVNKFLKPKEIFKVVEAPAPAPEPSKKKSKAADGGDDSSDDSGDVTADKGDAAPAAMLARWVAAATTAVAAFALMG

SEQ ID NO: 1438 - protein, 429 aa, Brachypodium distachyon
MAGTVSKLAAPRPAALPAPSSSLRSTALAFAPSARRFRVSLSGRARSPVIAMASGKEGNGAATKRTTLHDLYELQGQSPWYDNLCRPVTDLLPYIANGVRGVTSNPTIFQKAISSSNAYDDQFKQLISAGKDAESAYWELVIKDIQDACKLFEPIYDQTDGADGYVSVEVSPRLANDTQGTVEAAKWLHKVVNRPNVYIKIPATAECVPSIREVIANGISVNVTLIFSIARYEAVIDAYLDGLEASGLSDLSRVTSVASFFVSRVDSLIDKMLEKTGTPEALALRGKAAVAQAKLANQLYLKKFSGPRWEALVKKGAKKQRLLWASTSVKNPAYADTLYVDPLIGPDTVSTMPDQALEAFIDHGTVSRTIDANVSEAEGIYSALGKLGINWDEVGTQLELEGVDSFKGSFDSLLTSLQEKGNALKPATL

SEQ ID NO: 1439 - protein, 430 aa, Cenchrus ciliaris
  misc_feature (105)..(108): Xaa can be any naturally occurring amino acid
  misc_feature (110)..(112): Xaa can be any naturally occurring amino acid
  misc_feature (120)..(121): Xaa can be any naturally occurring amino acid
  misc_feature (285)..(285): Xaa can be any naturally occurring amino acid
  misc_feature (353)..(353): Xaa can be any naturally occurring amino acid
  misc_feature (355)..(355): Xaa can be any naturally occurring amino acid
  misc_feature (357)..(357): Xaa can be any naturally occurring amino acid
  misc_feature (363)..(364): Xaa can be any naturally occurring amino acid
  misc_feature (366)..(368): Xaa can be any naturally occurring amino acid
MTGTVSKLAAPGPAAAAMLPPASLRSAALGFAPSARRFSVSIAGRARNPIIAMASAKEGNGAPSKRTSLHDLYELQGLSPWYDNLCRPVTDLLPLIASGVRGVTXXXXIXXXAISSSSAXXDQFKQLISAGKDAESAYWELVIKDIQDACKLFEPIYNETDGADGYVSVEVSPRLANDTQGTVEAAKWLHKVVNRPNVYIKIPATAECVPSIREVISNGISVNVTLIFSIARYEAVIDAYLDGLEASGLSDLSRVTSVASFFVSRVDSLIDKMLEKIGTPEALAXRGKAAVAQAKLANQLYQKKFSGPRWEALAKKGAKKQRLLWASTGVKNPAYPDTLYVDSLIGPDTVNTXPXQXLQAFIXXGXXXRTVDANVSDAEGVYSALEKLGINWDEVGKQLELEGVDSFKKSFDSLLVSLQEKGNSLKTASV

SEQ ID NO: 1440 - protein, 408 aa, Leymus cinereus x Leymus triticoides
  misc_feature (388)..(388): Xaa can be any naturally occurring amino acid
  misc_feature (405)..(405): Xaa can be any naturally occurring amino acid
LRSTALAFAPFARRFRVSLADRARSPVIAMASAKEGNGAVTKRTTLHDLYELQGQSPWYDNLCRPVTDLLPYIANGVRGVTSNPTIFQKAISSSNAYDGQFKELISAGKDAENAYWELVIKDIQDACKLFEPIYDETNGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALREKAAVAQAKIANQLYLKKFSGPRWEALVKKGAKKQRLLWASTSVKNPAYSDTLYVDPLIGPDTVSTMPDQALDAFIDHGTVARTIDANVSEAEGIYSALEKLGIDWEEVGKQLEHEGVSSFKGSXDSLLTSLEEKGNALKTXANL

SEQ ID NO: 1441 - protein, 429 aa, Zea mays
MTGTVSKLAAPRPAAPPLRPASLRTAALAFAPSARRVRVSVAGRARSPIIAMASAKEGNGAPTKRTALHDLYELQGLSPWYDNLCRPVTDLLPIIASGVRGVTSNPTIFQKAISSSSAYDDQFKQLISAGKDAESAYWELVIKDIQDACKLFEPIYDETDGADGYVSVEVSPRLANDTQGTVEAAKWLHKVVNRPNVYIKIPATAECVPSIQEVIANGISVNVTLIFSIARYEAVIDAYLDGLEASGLSDLSRVTSVASFFVSRVDTLIDKMLDKIGTPEALALRGKAAVAQAKLANRLYQKKFSGPRWEALAKKGAKKQRLLWASTGVKNPAYPDTLYVDSLIGPDTVNTMPDQALQAFIDHGTVSRTVDANVSEAEGVYSALEKLGIDWEEVGKQLELEGVDSFKKSFDSLLVSLQEKGNSLKMASV

SEQ ID NO: 1442 - protein, 430 aa, Zea mays
MTGTVSKLAAPRPAAPPLRPASLRAAAIAFAPSPRRVRVSVAGRARIPSVIAMASAKEGNGAPTKKTSLHDLYELQGLSPWYDNLCRPVTDLLPLIASGVRGVTSNPAIFQKAISSSSAYDDQFKQLISGGKDAESAYWELVIKDIQDACSLFEPIYDETDGADGYVSVEVSPRLANDTQGTVEAAKWLHKVVNRPNVYIKIPATAECVPSIREVIANGISVNVTLIFSIARYEAVIDAYLDGLEASGLSDLSRVTSVASFFVSRVDTLIDKMLEKIGTPEALALRGKAAVAQAKLANRLYQKKFSGPRWEALAKKGAKKQRLLWASTGVKNPAYPDTLYIDSLIGPDTVNTMPDQALHAFIDHGTVSRTVDANVSEAEGVYSALEKLGIDWGEVGKQLELEGVDSFKKSFDSLLVSLQEKGNSLKTATV

SEQ ID NO: 1443 - protein, 429 aa, Sorghum bicolor
MTGTVSKLAAPRPAAAPLRPASLRTAALAFAPSPRRVTVSVAGRARSPIIAMASAKEGNGAPTKKTALHDLYELQGLSPWYDNLCRPVTDLLPLIASGVRGVTSNPTIFQKAISSSSAYDDQFKQLISGGKDAESAYWELVIKDIQDACKLFEPIYNETDGADGYVSVEVSPRLANDTQGTVEAAKWLHKVVNRPNVYIKIPATAECVPSIQEVIANGISVNVTLIFSIARYEAVIDAYLDGLEASGLSDLSRVTSVASFFVSRVDSLIDKMLEKIGTPEALALRGKAAVAQAKLANQLYQKKFSGPRWEALAKKGAKKQRLLWASTGVKNPAYPDTLYVDSLIGPDTVNTMPDQALQAFIDHGTVSRTVDANVSEAEGVYSALEKLGIDWDAVGKQLELEGVDSFKKSFDSLLVSLQEKGNSLKTASV

SEQ ID NO: 1444 - protein, 429 aa, Saccharum officinarum
MTGTVSKLAAPRPAAAPLRPASLRTAALAFAPSPRRVSVSIAGRARSPIIAMASAKEGNGAPTKKTALHDLYELQGLSPWYDNLCRPVTDLLPLIASGVRGVTSNPTIFQKAISSSSAYDDQFKQLISSGKDAESAYWELVIKDIQDACKLFEPIYNETDGADGYVSVEVSPRLANDTQGTVEAAKWLHKVVNRPNVYIKIPATAECVPSIQEVIANGISVNVTLIFSIARYEAVIDAYLDGLEASGLSDLSRVTSVASFFVSRVDTLIDKMLEKIGTPEALALRGKAAVAQAKLANQLYQKKFSGPRWEALAKKGAKKQRLLWASTGVKNPAYPDTLYVDSLIGPDTVNTMPDQALQAFIDHGTVSRTVDANVSEAEGVYSALEKLGIDWGEVGKQLELEGVDSFKKSFDSLLVSLQEKGNSLKTASV

SEQ ID NO: 1445 - protein, 429 aa, Panicum virgatum
MTGTVSKLAAPRPAAALLPPASLRSAALAFAPSPRRFRVSIAGRARSPVIAMASAKEGNGAPTKKTALHDLYELQGLSPWYDNLCRPVTDLLPLIASGVRGVTSNPTIFQKAISSSSAYDDQFKQLITAGKDAESAYWELVIKDIQDACKLFEPIYNETDGADGYVSVEVSPRLANDTQGTVEAAKWLHKVVNRPNVYIKIPATAECVPSIREVISNGISVNVTLIFSIVRYEAVIDAYLDGLEASGLSDLSRVTSVASFFVSRVDTLVDKMLEKIGTPEALALRGKAAVAQAKLANQLYQKKFSGPRWEALAKKGAKKQRLLWASTGVKNPAYPDTLYVDSLIGPDTVNTMPDQALHAFIDHGTVSRTVDANVSEAEGVYSALEKLGIDWDEVGKQLELEGVDSFKKSFDSLLVSLQEKGNSLKTASV

SEQ ID NO: 1446 - protein, 429 aa, Panicum virgatum
MTGTVSKLAAPRPAAALLPPASLRSAALAFAPSPRRLRVSIAGRARSPVVAMASAKEGNGAPTKKTALHDLYELQGLSPWYDNLCRPVTDLLPLIASGVRGVTSNPTIFQKAISSSSAYDDQFKQLISAGKDAESAYWELVIKDIQDACKLFEPIYNETDGADGYVSVEVSPRLANDTQGTVEAAKWLHKVVNRPNVYIKIPATAECVPSIREVISNGISVNVTLIFSIVRYEAVIDAYLDGLEASGLSDLSRVTSVASFFVSRVDTLIDKMLEKIGTPEALALRGKAAVAQAKLANQLYQKKFSGPRWEALAKKGAKKQRLLWASTGVKNPAYPDTLYVDSLIGPDTVNTMPDQALHAFIDHGTVSRTVDANVSEAEGVYSALEKLGIDWDEVGKQLELEGVDSFKKSFDSLLVSLQEKGNSLKTASV

SEQ ID NO: 1447 - protein, 471 aa, Triticum aestivum
RSVRVRQPRSAKPRNNPRGRPTQPSRPPLLTNPRAGSRAAMAGTVPKLAAPRPAAAGPLPSQPLRAAALAFAPSARRFRVSLAGRARSPVIAMASAKEGNGAVTKRTTLHDLYEQQGQSPWYDNLCRPVTDLLPYIANGVRGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 1448 - protein, 469 aa, Triticum aestivum
EIRRACEAAPLNLATAPVGDQPSPAAPLTNPGVGSRAAMAGTVPKLAAPRPAAAGPLPSQSLRSAALAFAPSARRFRVSLAARARSPFIAMASAKEGNGAVTKRTTLHDLYEQQGQSPWYDNLCRPVTDLLPYIANGVRGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 1449 - protein, 465 aa, Triticum aestivum
PAPLNLATTPVGDQPAVPLTIHQPRRESEAEPRSMAGTVPKLAAPRPAAAGPLPSQPLRSAALASAPSARRFRVSLAARARSPVIAMASAKEGNGAVTKRTTLHDLYEQQGQSPRYDNLCRPVTDLLPYIANGVRGVTSNPTIFQKAISSSNAYDGQFKELISAGKDAESAYWELVIKDIQDACKLFEPIYDETDGADGYISVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 1450 - protein, 319 aa, Zea mays
MASRQTFACYTMALLFAAAAVSAQLSTDFYDDTCPDALDIIESAVRAAVSKESRMGASLLRLHFHDCFGCDGSVLLDDALGFTGEKTAQPNKNSLRGFDVVDDIKAQLEDACNQTVSCADILAVAARDSVVALGGPTWDVELGRRDGTTANLDDANNDLPAPTLDLGDLIKAFSKKGLSASDMIALSGGHTIGQARCVNFRGRLYNETASLDASLASSLKPRCPGAAGSGDDNTSPLDPATSYVFDNFYYRNLLRNKGLLHSDQQLFSGGGSADAQTTAYASDMAGFFDDFRDAMVKMGAIGVVTGSGGHVRVNCRKTN

SEQ ID NO: 1451 - protein, 337 aa, Oryza sativa
MAYSRQIFVCSAMAALLFSAVVSAQLSTDFYDETCPDALDIIESAVRDAVSKESRMGASLLRLHFHDCFVNANIIQKFRVDADGSVKQVGCDGSVLLDDTAAITGEKNAKPNKNSLRGFEVVDDIKSQLEDACEQVVSCADILAVAARDSVVALGGPTWDVELGRRDGTTASLDAANNDLPPPTSDLADLIKSFSDKGLTASDMIALSGAHTIGQARCTNFRGRLYNETNLDATLATSLKPSCPNPTGGDDNTAPLDPATSYVFDNFYYRNLLRNKGLLHSDQQLFSGGSADAQTTAYATDMAGFFDDFRGAMVKMGGIGVVTGSGGQVRVNCRKVN

SEQ ID NO: 1452 - protein, 319 aa, Sorghum bicolor
MAPCRQTFARYTMALLFAAAAVSAQLSTDFYGETCPDALDIIESAVRAAISKESRMGASLLRLHFHDCFGCDGSVLLDDTTGFTGEKTAKPNKNSLRGFDVVDDIKAQLEDSCQQTVSCADILAVAARDSVVALGGPTWDVELGRRDGTTASLDDANNDLPAPTLDLGDLIKAFAKKGLSANEMIALSGGHTIGQARCVNFRGRLYNETTSLDASLASSLKPRCPSADGTGDDNTSPLDPATSYVFDNFYYRNLLRNKGLLHSDQQLFNGGSADTQTTSYASDKAGFFDDFRDAMVKMGAIGVVTGSGGQVRLNCRKTN

SEQ ID NO: 1453 - protein, 524 aa, Brachypodium distachyon
MAGAETAVDSGEKRLNELGYKQELRREMTLFKTLAISFSTMTLFTGITPLYGSSLQYAGPAPLVWGWVVVSFFTWFVGIAMAEICSSFPTTGSLYFWAAHLAGPVWGPLASWCCAWLEAIGLIAGIGTQAYAGSQVLQSIILLCTGTNKGGGYLAPRWLFLVMYLGLTFIWAVLNTFALEVIAVLDMISMWWQVIGGTVIVILLPLVAKTTQPASYVFTHFETAPSVTGISSVSYAVVMSFLVSQYSLYGYDAAAHLTEETKGADKNGPIAILSSIGIISVFGWVYILALTFSIQDFAYLYDPTNETAGTFVPAQILYDAFHGRYNSSAGAIVLLFVIWGSFFFGGLSITTSAARVVYALSRDRGVPFSSVWRRIHPKHKVPGNAVWLCAAVCALLGLPILKINVVFTAITSVATIGWVGGYAVPIFARMVMKEENFRPGPFYLRGASRPVCLVAFLWICYTCAVFLLPTVYPIKMDTFNYAPIALGVVLGLIMIWWVVDAREWFKGPVRNIDEHNNGDDNGKV

SEQ ID NO: 1454 - protein, 525 aa, Zea mays
MAGGGEREGAQAMDSGEKRLNELGYKQELRREMTLFKTLAISFSTMTLFTGITPLYGSSLQYAGPAPLVWGWVVVSFFTCFVGVAMAEICSSFPTTGSLYFWAAHLAGPVWGPLASWCCAWLEAIGLIAGIGTQAYAGSQVLQSIILLCTGTNMGGGYLAPRWLFLVMYIGLTLIWAVLNTFALEVIAFLDVISMWWQVIGGTVIVVMLPLVAKTTQPASYVFTHFQTAPDVTGIGSSAYAVVLSFLVSQYSLYGYDAAAHLTEETKGADKNGPIAILSSIGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCAAVCTLLGLPILRINVVFTAITSIATIGWVGGYAVPIFARMVMREDDFRPGPFYLGRASRPVCLVAFLWICYTCSVFLLPTVYPIKMDTFNYAPIALGVCLGLIMLWWLLDARKWFKGPVRNIDDHNNGKV

SEQ ID NO: 1455 - protein, 514 aa, Sorghum bicolor
MDSGEKRLNELGYKQELRREMTLFKTLAISFSTMTLFTGITPLYGSSLQYAGPAPLVWGWVVVSFFTWFVGIAMAEICSSFPTTGSLYFWAAHLAGPVWGPLASWCCAWLEAIGLIAGIGTQAYAGSQVLQSIILLCTGTNTGGGYLAPRWLFLVMYIGLTLIWAVLNTFALEVIAFLDVISMWWQVIGGTVIVIMLPLVAKTTQPASYVFTHFQTSPDVTGISSSSYAVVLSFLVSQYSLYGYDAAAHLTEETKGADKNGPIAILSSIGIISVFGWAYILALTFSIQDFSYLYDASNETAGAFVPAQILYDAFHGRYGSSAGAIVLLLVIWGSFFFGGLSITTSAARVVYALSRDRGVPLSSVWRRIHPRHKVPANAVWLCAAVCALLGLPILRINVVFTAITSIATIGWVGGYAVPIFARMVMREDDFRPGPFYLGRASRPVCLVAFLWICYTCSVFLLPTVYPIKMDTFNYAPIALGVVLGLIMLWWLLDARKWFKGPVRNIDEHNNGSKV

SEQ ID NO: 1456 - protein, 512 aa, Glycine max
MDSAEKRLNELGYKQELRREMTLFKTLAISFSTMTLFTGITPLYGSSLQYAGPATLVWGWIVVSFFTWFVGIAMAEICSSFPTTGSLYFWAAHLAGPKWGPFSSWCCAWLETIGLIAGIGTQAYAGSQTLQSIILLSTGTNKGGGYFAPKWLFLCMYIGLTVIWAALNTFALEVIALIDIVSIWWQVIGGIVIVIMLPLVALTTKSASFVFTHLELAPESTGVSSKPYAVILSFLVSQYSLYGYDAAAHLTEETKGADKNGPIAILGSIGIITVFGWAYILALTFSIQDFGYLYDPNNETAGAFVPAQILYDAFHGRYHNSAGAIILLFVIWGSFFFGGLSITTSAARVVYALSRDKGVPFSHLWRQLHPKYKVPSNAVWLCAAICILLGLPILKVNVVFTAITSICTIGWVGGYAVPIFARLVMSEKNFKPGPFYLGKARRPVCLVAFLWICYTCSVFLLPTLYPITWDTFNYAPVALGVGLGLIMLWWLLDARKWFTGPVRNIDIQNGKV

SEQ ID NO: 1457 - protein, 119 aa, Populus trichocarpa
MATPMKNICFVMFLATLSIALFNQVDGAGECGKTTTPDKEAFKLAPCASAAQDENASVSSQCCAQVKKIEQNPACLCAVMLSNTAKSSGIDPKIAMTIPKRCNIADRPVGYKCGAYTLP

SEQ ID NO: 1458 - protein, 247 aa, Ricinus communis
MAKIALGTRREATQSDCIKALIVEFITTFLFVFAGVGSAMAANKLLGDSLVGLFFVAMAHTLVVAVMISAGHISGGHLNPAVTLGLLAGGHITVVRSILYWIDQLLASSAACFLLNYLTGGMATPVHTLASGVGYVQGIVWEIVLTFSLLFTVYATIVDPKKGSIDGLGPTLTGFVVGANILAGGPFSGASMNPARSFGPALVSWDWTDHWVYWVGPLIGGGLAGFIYENFFIIRSHRPLPNDEENY

SEQ ID NO: 1459 - protein, 246 aa, Castanea mollissima
MAKIALGTRREATQPDCIKALVVEFITTFLFVFAGVASAMTADKLAGGSLVGLFAVAIAHALVVAVMISAGHISGGHLNPAVTLGLLAGGHITVFRSILYWIDQLLASAAACFLLQYLTGGLSTPIHTLASGVGYLQGVIWEVVLTFSLLFTVYATIVDPKKGPNGLGPIITGFVVGANILAGGAFSGASMNPARSFGPALVSWDWTDHWVYWVGPLIGGGLAGFIYENFFIIRSHVPIPTEEEGY

SEQ ID NO: 1460 - protein, 247 aa, Citrus sinensis
  misc_feature (10)..(10): Xaa can be any naturally occurring amino acid
MAKIALGSHXEATQPDCIKALVVEFITTFLFVFVGVGSAMAADKLVGNALVGLFFVAVAHAFVVAVMISAGHISGGHLNPAVTLGLLFGGHITFFRSVLYWIDQLLASSAACFLLSYLTGGLSTPVHTLASGVGYFQGIIWEIILTFSLLFTVYATIVDPKKGSIDGLGPLLTGFVVGANILAGGPFSGASMNPARSFGPALVSGDWTDHWVYWVGPLIGGGLAGFIYEHFFIVRSHVPIPYEEARF

SEQ ID NO: 1461 - protein, 246 aa, Vigna unguiculata
MAKIALGSSREATQPDCIQALVVEFIATFLFVFVGVASSMLTEKLGGDALVGLFVVAVAHALVVAVMISAAHISGGHLNPAVTIGLLAGGHITVFRSILYWIDQLVASAAASYLLYFLSGGQKTPVHTLAAGVGYGQGVIWEIVLTFSLLFTVYATMVDPKKGPLAGLGPTLVGFVVGANILAGGAYSAASMNPARSFGPALVTGDWTDHWVYWVGPLVGGGLAGFIYETFFIDRSHAPLPRDEEF

SEQ ID NO: 1462 - protein, 247 aa, Medicago truncatula
MAKIALGTTREATQPDCIQALIVEFIATFLFVFAGVGSAMTADKLSGDALVGLFFVAIAHALVVAVMISAAHISGGHLNPAVTLGLLVGGHITIVRSILYWIDQLIASAAACYLLHYLSGGLTTPAHTLASGVGYTQGVVWEIVLTFSLLFTVYATMVDPKKGALAGLGPTLVGFVVGANILAGGAFSAASMNPARSFGPALVSGNWTDHWVYWVGPLIGGGLAGFIYENFFINRDHVPLAVDEESY

SEQ ID NO: 1463 - protein, 230 aa, Arachis hypogaea
  misc_feature (212)..(212): Xaa can be any naturally occurring amino acid
MANKIALGTTREATQPDCIQALVVEFITTFLFVFVGVGSAMAADKLSGDALVGLFAVAVAHALVVAVMISAGHISGGHLNPAVTLGLLVGGHITVVRSVLYWIDQLVASAAASYLLYYLSGGLATPVHTLASGVGYTQGVIWEIVLTFSLLFAVYATMVDPKKGALAGHGPTLVGFVVGANILAGGAFSAASMNPARSFGPALVAGNWTDHXVLLGWGLSIGGGPCRFHL

SEQ ID NO: 1464 - protein, 246 aa, Glycine max
MARIALGSTREATQPDCIQALIVEFIATFLFVFVGVASSMVVDKLGGDALVGLFAVAVAHALVVAVMISAAHISGGHLNPAVTLGLLAGGHITIFRSLLYWIDQLVAAAAASYLLYYLSGGQATPVHTLASGVGYGQGVVWEIVLTFSLLFTVYATMVDPKKGALAGLGPTLVGFVVGANILAGGAYSAASMNPARSFGPALVTGNWTDHWVYWVGPLIGGGLAGFIYETFFIDRSHVPLPRDEES

SEQ ID NO: 1465 - protein, 330 aa, Hordeum vulgare
MGGSNYDDDWVLPSADITLVLVGKLGYGKSATGNSILGREAFVSEYSHASVTNTCQMGSTMLTDGRTINVIDTPGLFDMTVTPEDAGKEIVKCMNMAKDGIHAVLMVFSATSRFSREDSSTIETIKVFFGEKIVDHLVLVFTYGDLVGENLLKNMLSNAPEYLQKVVQLCKNRVVLFDNKTKDPRIQAKQLETLLDVVDSVSANNGGNPFTDQMLTRLKEVHDREMEVHDAMGYSEDQITELKKEIHRTRDEQLANITAMVEEKLNITVEKLQVQLMEEQNARLEAERVAAEARVKSDEEIRKLKERLERAQEENEEFRRLAATNKCAIL

SEQ ID NO: 1466 - protein, 330 aa, Brachypodium distachyon
MGGSNYDDDWVLPSADITVVLVGKLGYGKSATGNSILGREAFVSEYSHASVTNTCQMGSTMLKDGRTINVIDTPGLFDMSVTPEDAGKEIVKCMNMAKDGIHAVLMVFSATSRFSREDSSTIETIKVFFGEKIVDHLILVFTYGDLVGENLLKNMLSNAPEYLQKVVELCKNRVVLFDNKTKDQRIQAKQLEMLLDVVDSVSANNGGKPFSDQMLTRIKEVHEREKEVHDVMGYTEEQISELKKEIHRTRDEQLASITAMVEDKLNCTVEKLQNQLMEEQNARLEAERVALEARVRSDEEIRKLKESLKEAQRENEEFRRLAHNNKCTIL

SEQ ID NO: 1467 - protein, 330 aa, Leymus cinereus x Leymus triticoides
MGGSNYDDDWVLPSADITLVLVGKLGYGKSATGNSILGREAFVSEYSHTSVTNTCQMGSTMLGDGRTINVIDTPGLFDMTVTPEDAGKEIVKCMNMAKDGIHAVLMVFSATSRFSREDSSTIETIKVFFGEKIVDHLVLVFTYGDLVGENLLKNMLSNAPEYLQKVVQLCKNRVVLFDNKTKDPRIQAKQLETLLDVVDSVSANNGGNPFTDQMLTRLKEVHDREKEVHDAMGYSEDQISELKKEIHRTRDEQLANITAMVEEKLNITVEKLQVQLMEEQNARLEAERVAAEARLKSDEEIRKLKERLERAQEENEEFRRLAATNKCAIL

SEQ ID NO: 1468 - protein, 330 aa, Pseudoroegneria spicata
MGGSNYDDDWVLPSADITLVLVGKLGYGKSATGNSILGREAFVSEYSHASVTNTCQMGSTMLTDGRTINVIDTPGLFDMTVTPEDAGKEIVKCMNMAKDGIHAVLMVFSATSRFSREDSSTIETIKVFFGEKIVDHLVLVFTYGDLVGENLLKNMLSNAPEYLQKVVQLCKNRVVLFDNKTKDPRIRTKQLETLLDVVDSVSANNGGNPFTDQMLTRLKEVHDREKEVHDALGYSEDQISELKKEIHRTRDEQLANITAMVEEKLNITVEKLQVQLMEEQNARLEAERVAAEARLKSDEEIRKLKERLEKAQEENEEFRRLAATNKCAIL

SEQ ID NO: 1469 - protein, 331 aa, Saccharum officinarum
MGGSQYDDEWVLPSADITLVLVGKLGYGKSATGNSILGREAFVSEYSHASVTNTCQLGSTTLKDGRTINVIDTPGLFDMSITSDDAGKEIVKCMNMAKDGIHAVLMVFSATSRFSREDASTIETIKVFFGEKIVDHMILVFTYGDLVGESKLKNMLNNAPEYLQNVVELCQNRVVVFDNMTNDRRLQAQQLDKLLDVVDSVCANNGGKPFSDQMFTRIKEVHDREKEVHTLGYSEEQISELKKEIHRTRDEQLAHITSMVEEKLNCTVEKLQQQLMEEQNARLEAEKVAYEARLNSEAEIQKLKESLKKAQMENEEFRRMAQSQGSKCAIL

SEQ ID NO: 1470 - protein, 134 aa, Triticum aestivum
MGGSNYDDDWVLPSADITLVLVGKLGYGKSATGNSILGREAFVSEYSHASVTNTCQMGSTMLTDGRTINVIDTPGLFDMTVTPEDAGKEIVKCMNMAKDGIHAVLMVFSATSRFSREDSSTIETIKVFFWRENR

SEQ ID NO: 1471 - protein, 329 aa, Triticum aestivum
MGGSNYDDDWVLPSADITLVLVGKLGYGKSATGNSILGREAFVSEYSHASVTNTCQMGSTMLTDGRTINVIDTPGLFDMTVTPEDAGKEIVKCMNMAKDGIHAVLMVFSATSRFSREDSSTIETIKVFFGEKIVDHLVLVFTYGDLVGENLLKNMLSNAPEYLQKVVQLCKNRVVLFDNKTKDPRIRTKQLETLLDVVDSVSANNGGNPFTDQMLTRLKEVHDREKEVHDALGYSEDQISELKKEIHRTRDEQLANITAMVEEKLNITVEKLQVQLMEEQNARLEAERVAAEARLKSDEEIRKLKERLEKAQEENEEFRRLAANKCAIL

SEQ ID NO: 1472 - protein, 219 aa, Antirrhinum majus
MGQQSLIYSFVARGTVILAEYTEFTGNFNGIAAQCLQKLPATNNKFTYNCDGHTFNYLVEDGFTYCVVAVESVGRQIPIAFLERTKDDFTKKYGGGKAATAVANSLNKEFGPKLKEQMQYCVDHPEEVSKIAKVKAQVTEVKGVMMENIEKVLDRGEKIELLVDKTENLRSQAQDFRTQGTKMRRRMWLQNMKVKLIVLAIIIALILIIVLSVCGGFNC

SEQ ID NO: 1473 - protein, 220 aa, Antirrhinum majus
MGQQSLIYAFVARGTVILAEYTEFTGNFTGIAAQCLQKLPATNNKFTYNCDGHTFNYLVEDGFTYCVVAVESVGRQLPIAFLERVKEDFSKKYGGGKAATAVASSLNKEFGPKLKEQMQYCVDHPEEISKLAKVKAQVTEVKGVMMENIEKVLDRGEKIELLVDKTENLRSQAQDFRTQGTQMRRKMWLQNMKIKLIVLAIIIALILIIVLSVCGGFKCH

SEQ ID NO: 1474 - protein, 221 aa, Malus domestica
MGQKALIYAFVARGTVVLAEYTEFSGNFNSIAFQCLQKLPATNNKFTYNCDGHTFNYLVDNGYTYCVVADESSGRQVPIAFLERVKDDFVAKYGAGKAATAAANSLNKEFGSKLKEHMQYCVDHPEEISKLAKVKAQVSEVKGVMMENIEKVLDRGEKIELLVDKTENLHQQAQDFRTVGTKMRRKMWLQNMKVKLIVLGILIALILIIILSICHGFNCGK

SEQ ID NO: 1475 - protein, 219 aa, Malus domestica
MGQQSLIYSFVARGTVVLAEYTEFTGNFTSIASQCLQKLPATNNKFTYNCDGHTFNYLVDNGFTYCVVAVEAVGRQVPIAFLERIKEDFTGRYGGGKAATAVANSLNKEFGSKLKEHMQYCVDHPEEISKLAKVKAQVSEVKGVMMENIEKVLDRGEKIELLVDKTENLRSQAQDFRQQGTQMRRKMWLQNMKVKLIVLGILIALILIIVLSVCNGFKC

SEQ ID NO: 1476 - protein, 219 aa, Malus domestica
MGQQSLIYSFVARGTVILAEYTEFTGNFTSIASQCLQKLPATNNKFTYNCDGHTFNYLVDNGFTYCVVAVEAVGRQVPIAFLERIKEDFIGRYGGGKAATAVANSLNKEFGSKLKEHMQYCVDHPEEISKLSKVKAQVSEVKGVMMENIEKVLDRGEKIELLVDKTENLRSQAQDFRQQGTQMRRKMWFQNMKIKLIVLGILIALILIIVLSVCNGFKC

SEQ ID NO: 1477 - protein, 221 aa, Malus domestica
MGQKALIYAFVARGTVVLAEYTEFSGNFNSIAFQCLQKLPATNNKFTYNCDGHTFNYLVDNGYTYCVVADESSGRQVPIAFLERVKDDFVAKYGSGKAATAAANSLNKEFGSKLKEHMQYCVDHPEEISKLAKVKAQVSEVKGVMMENIEKVLDRGEKIELLVDKTENLHQQAQDFRTVGTKMRRKMWLQNMKVKLIVLGILIALILIIIMSVCHGFNCGK

SEQ ID NO: 1478 - protein, 220 aa, Aquilegia formosa
MGQQTLIYSFVARGTVILAEYTEFKGNFTSIASQCLQKLPASNNRFTYNCDSHTFNYLVDDGFTYCVVAVESAGRQVPIAFLERIKDEFAKRYKGGKAATAVANSLNKEFGSKLKEQMQYCVDHPEEISKLAKVKAQVSEVKGVMMENIEKVLDRGEKIELLVDKTENLRSQAQDFRSQGTKLRRKMWWQNMKIKLVVLGIIIALILIIILSVCHGFKCT

SEQ ID NO: 1479 - protein, 219 aa, Arabidopsis thaliana
MAQQSLIYSFVARGTVILVEFTDFKGNFTSIAAQCLQKLPSSNNKFTYNCDGHTFNYLVEDGFTYCVVAVDSAGRQIPMSFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 1480 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 1481 - protein, 221 aa, Artemisia annua
MGQQSLIYSFVSRGTVILAEYTEFTGNFTSIASQCLQKLPATNNKFTYNCDGHTFNYLVEDGFTYCVVAAESAGRQVPMAFLERTKDDFSKKYGGGKANTAAANSLNKEFGPKLKEQMQYCVDHPEEISKLSKVKAQVSEVKGVMMENIEKVLDRGEKIELLVDKTENLRSQAQDFRTQGTQMRRKMWLQNMKIKLIVLGIIIALILIIVLSVCGGFNCGK

SEQ ID NO: 1482 - protein, 221 aa, Artemisia annua
MGQQQLIYSFVARGTVILTEYTEFTGNFTSIAAQCLQKLPATNNKFTYNCDGHTFNYLVEDGFTYCVVAVESVGRQVPMAFLERVKEDFTKKYGGGKAATAVANSLSKEFGPKLKEQMQYCVDHPEEISKLAKVKAQVSEVKGVMMENIEKVLDRGEKIELLVDKTENLRSQAQDFRTQGTQIRRKMWLQNMKIKLIVLGIIIALILIIVLSACGGFNCGK

SEQ ID NO: 1483 - protein, 221 aa, Persea americana
  misc_feature (199)..(199): Xaa can be any naturally occurring amino acid
MGQKSLIYSSVARGTVILAEYTEFTGNFTSIAAQCLEKLPSSNNKFTYNCDGHTFNYLVDSGFTYCVVADESVGRQVPMAFLERVKDDFVSRYGGGKATTAVANSLNKEFRNKLKEHMQYCVDHPEEISKLAKVKAQVSEVKGVMMENIEKVLDRGEKIELLVDKTENLRSQAQDFRTQGTQMRRKMWFQNMKIKLIVXGIVIALILIIVLSVCHGFKCGN

SEQ ID NO: 1484 - protein, 219 aa, Persea americana
  misc_feature (182)..(182): Xaa can be any naturally occurring amino acid
  misc_feature (190)..(190): Xaa can be any naturally occurring amino acid
MGQQFLIYSFVARGTVILAEFTEFTGNFTSIAAQCLQKLPATNNKFTYNCDSHTFNYLVEEGFTYCVVAVESVGRQLPIAFLERVKDDFNKRYGGGKAATAVANSLNREFGPKLKEHMQYCVDNPEEVSKLAKVKAQVSEVKGVMMENIEKVLDRGEKIELLVDKTENLRSQAQDFRQQGTXMRRTMWFXNMKIKLIVLGIIIALILIIILSVCHGFKC

SEQ ID NO: 1485 - protein, 218 aa, Brassica oleracea
  misc_feature (70)..(70): Xaa can be any naturally occurring amino acid
QQQSLIYSFVARGTVILVEFTDFKGNFTSVAAQCLQKLPSSNNKFTYNCDGHTFNYLVEDGFTYCVVAVXSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1486 - protein, 223 aa, Brassica oleracea
  misc_feature (220)..(220): Xaa can be any naturally occurring amino acid
MAQQQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIVIALILIIVLSVCGGFXCGK

SEQ ID NO: 1487 - protein, 219 aa, Brassica rapa
MAQQSLIYSFVARGTVILVEFTDFKGNFTTVAAQCLQKLPSSNNKFTYNCDGHTFNYLVEDGFTYCVVAVDSAGRQIPMAFLERVKEDFNKRYGGGKAATAQASSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1488 - protein, 220 aa, Brassica rapa
MAQQQSLIYSFVARGTVILVEFTDFKGNFTSIAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 1489 - protein, 223 aa, Brassica rapa
MAQQQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 1490 - protein, 222 aa, Brassica rapa
MAQQSSLIYSFVARGTVILVEFTDFKGNFTSVAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 1491 - protein, 220 aa, Brassica rapa
MAQQQSLIYSFVARGTVILAEFTDFKGNFTSVAAQCLQKLPSSNNKFTYTCDGHTFNYLVEDGFTYCVVAVDSAGRQIPMAFLERVKEDFSKRYGGGKAATAQANSFNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1492 - protein, 223 aa, Musa acuminata
MGQQSLIYSFVARGTVVLAEFTEFSGNFNSIAAQCLQKLPASNNKFTYNCDGHTFNYLVEDGYTYCVVAVESVGRQIPIAFLERVKEDFNKRYGGGKAATAAANSLTREFGSKLKEHMQYCVDHPEEISKLAKVKAQVSEVKGVMMENIEKVLDRGEKIELLVDKTENLRSQAQDFRQHGTQMRRKMWLQNMKVKLIVLGIIIALVLIIILSVCMASMLILMD

SEQ ID NO: 1493 - protein, 219 aa, Musa acuminata
MGQQSLIYSFVARGTVILAEYTEFSGNFNSIAAQCLQKLPASNNKFTYNCDGHTFNYLVEDGYTYCVVAVESVGRQIPIAFLDRVKEDFNKRYGGGKAATASANSLSREFGSKLKEQMQYCVDHSEEISKLAKVKAQVSEVKGVMMENIEKVLDRGEKIELLVDKTENLRSQAQDFRQQGTKMRRKMWLQNMKVKLIVLGIIIALILIIVLSICHGFKC

SEQ ID NO: 1494 - protein, 223 aa, Hordeum vulgare
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIILSVCHGFNCGKSK

SEQ ID NO: 1495 - protein, 224 aa, Ocimum basilicum
MGQNGRKTLIYTLVARGTPPVVLAEYTEFSGNFNSIAYQCLQKLPASNNKFTYNCDNHTFNYLVQDGFTYCVVAEESAGRQLPMAFLDRIKDDFLSKYGGGKAATVPANGLNKEFGPKLKEHMRYCIEHPEEISKFSKVQAQVSEVKGVMMENIEKVLDRGEKIELLVDKTENLHHQAQDFRTTGTQIRRKMWLQNMKIKLIVLAIVVALILIIVLSICKGFNC

SEQ ID NO: 1496 - protein, 221 aa, Phaseolus coccineus
MGQQSLIYSFVARGTVILAEFTEFTGNFTGVAAQCLQKLPSSNNKFTYNCDGHTFNYLVDNGFTYCVVAVESAGRQIPIAFLERIKEDFTKKYAGGKAATAAAQSLNREFGPKLKEQMQYCVDHPEEVSKLAKVKAQVSEVKGVMMENIEKVLDRGEKIELLVDKTENLRSQAQDFRQQGTKIRRKMWFQNMKIKLIVLGIIIALILIIVLSVCGGFNCGK

SEQ ID NO: 1497 - protein, 226 aa, Phaseolus coccineus
MGHDQNQRSLIYAFVSRGTVILAEYTEFSGNFNTIAFQCLQKLPASNNKFTYNCDGHTFNYLVDNGFTYCVVADESIGRQVPVAFLERVKDDFLAKYGGGKAATAAANSLNKEFGSKLKEHMQYCVEHPEEISKLAKVKAQVSEVKGVMMENIEKVLDRGEKIELLVDKTENLHHQAQDFRNSGTKIRRKMWLQNMKVKLIVLAILIALILIIVLSVCRGFNCGKN

SEQ ID NO: 1498 - protein, 221 aa, Phaseolus coccineus
MGQRSLIYAFVSRGTVILAEYTEFSGNFNSIAFQCLQKLPASNNKFTYNCDAHTFNYLVDNGYTYCIVADESIGRQVPMAFLERVKDDFVSKYGGGKAATAPANSLNKEFGPKLKEHMQFCVDHPEEVSKLAKVKAQVSEVKGVMMENIEKVLDRGEKIELLVDKTENLHNQAQDFRTSGTRIRRKMWLQNMKTKLIVLGILIALILIIVLSVCRGFNCGK

SEQ ID NO: 1499 - protein, 220 aa, Brachypodium distachyon
MGQQSLIYAFVARGTVVLAEYTEFTGNFTTIASQCLAKLPSSNNKFTYNCDGHTFNYLVEDGFTYCVVAVESVGQQMPIAFLVRIKDDFSKRYGGGKAATAAASSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIILSVCHGFKCK

SEQ ID NO: 1500 - protein, 219 aa, Theobroma cacao
MGQQSLIYSFVARGTMILAEYTEFTGNFTSIAAQCLQKLPASNNKFTYNCDGHTFNYLVENGFTYCVVAVESAGRQVPIAFLERVKEDFNKRYGGGKAATATANSLNREFGSKLKEHMQYCVDHPEEISKLAKVKAQVSEVKGVMMENIEKVLDRGEKIELLVDKTENLRSQAQDFRQQGTKMRRKMWFQNMKIKLIVLGILIALILIIVLSVCHGFKC

SEQ ID NO: 1501 - protein, 221 aa, Theobroma cacao
MVQKSLIYAFVSRGEVILAEYTEFSGNFNSIAFQCLQKLPSSNNKFTYNCDGHTFNYLVDNGYTYCVVADESAGRQVPIAFLERIKDDFVSKYGSGKAATAPANGLNKEFGPKLKEHMQYCVEHPEEISKLAKVKAQVSEVKGVMMENIEKVLDRGEKIELLVDKTENLHQQAQDFRSTGTKIRRKMWLQNMKIKLIVLGILIALILIIVLSVCHGFNCGK

SEQ ID NO: 1502 - protein, 219 aa, Theobroma cacao
  misc_feature (171)..(171): Xaa can be any naturally occurring amino acid
MGQQSLIYAFVARGTVVLADYTEFTGNFTSIASQCLQKLPASNNKFTYNCDGHTFNYLVDNGFSYCVVAIESVGRQVPIAFLERIKEDFTKIYGGGKAATAPANSLSREFGPKLKEHMQYCIDHPEEISKIAKVKAQVSEVKGVMMENIEKVLDRGEKIELLVDKTENLRXQAQDFRQQGTQMRRKMWLQNMKIKLIVLGILIALILIIVLSVCGGFKC

SEQ ID NO: 1503 - protein, 222 aa, Brassica napus; identical to SEQ ID NO: 1490

SEQ ID NO: 1504 - protein, 219 aa, Brassica napus; identical to SEQ ID NO: 1487

SEQ ID NO: 1505 - protein, 222 aa, Brassica napus
MSQQSSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIVIALILIIVLSVCGGFNCGK

SEQ ID NO: 1506 - protein, 220 aa, Brassica napus; identical to SEQ ID NO: 1488

SEQ ID NO: 1507 - protein, 219 aa, Brassica napus
MAQQSLIYSFVARGTVILVEFTDFKGNFTSVAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1508 - protein, 223 aa, Brassica napus; identical to SEQ ID NO: 1489

SEQ ID NO: 1509 - protein, 223 aa, Brassica napus
MAQQQQSLIYSFVARGTVILVEFTDFKGNFTSIAAQCLQKLPSSNNKFTYNCDGHTFNYLVENGFTYCVVAVDSAGRQIPMAFLERVKDDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 1510 - protein, 220 aa, Brassica napus
MAQQQSLIYSFVARGTVILAEFTDFKGNFTSVAAQCLQKLPSSNNKFTYTCDGHTFSYLVEDGFTYCVVAVDSAGRQIPMAFLERVKEDFSKRYGGGKAATAQANSFNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1511 - protein, 220 aa, Manihot esculenta
MGQQSLIYSFVARGTVILADFTEFTGNFTSIAAQCLQKLPATNNKFTYNCDGHTFNYLVDNGFTYCVVAVESVGRQVPIAFLERIKEEFTKKYGGGKAATAVANSLNKEFGPKLKEQMQYCVDHPEEVSKLAKVKAQVSEVKGVMMENIEKVLDRGEKIELLVDKTENLRSQAQDFRQQGTKMRRKMWLQNMKIKLIVLGILIALILIIVLSVCGGFKCH

SEQ ID NO: 1512 - protein, 220 aa, Manihot esculenta
MGQQSLIYSFVARGTVILAEYTEFTGNFTSIAAQCLQKLPATNNKFTYNCDGHTFNYLVDNGFTYCVVAVESVGRQVPIAFLERVKEDFSNRYGGGKAATAVANSLNKEFGPKLKEQMQYCVDHPEEVSKLAKVKAQVSEVKGVMMENIEKVLDRGEKIELLVDKTENLRSQAQDFRQQGTKMRRKMWFQNMKIKLIVLGILIALILIIVLSVCKGFKCN

SEQ ID NO: 1513 - protein, 219 aa, Manihot esculenta
  misc_feature (63)..(63): Xaa can be any naturally occurring amino acid
MGQQSLIYSFVARGTVILAEYTEFTGNFTSIASQCLQKLPASNNKFTYNCDGHTFNYLVENGXTYCVVAVESAGRQIPIAFLERVKEDFNKRYSGGKAATAQANSLNREFGSKLKEHMQYCVDHPEEVSKLAKVKAQVSEVKGVMMENIEKVLDRGEKIELLVDKTENLRSQAQDFRQQGTKMRRKMWLQNMKIKLIVLGIIIALILIIVLSICHGFKC

SEQ ID NO: 1514 - protein, 219 aa, Ricinus communis
MGQQSLIYSFVARGTVILAEYTEFTGNFTSIASQCLQKLPASNNKFTYNCDGHTFNYLVENGFTYCVVAVESAGRQIPIAFLERVKEDFNKRYGGGKAATAQAHGLNREFGSKLKEHMQYCVDHPEEISKLAKVKAQVSEVKGVMMENIEKVLDRGEKIELLVDKTENLRSQAQDFRQQGTKMRRKMWIQNMKIKLIVLGIIIALILIIVLSVCHGFKC

SEQ ID NO: 1515 - protein, 220 aa, Ricinus communis
MGQQSLIYSFVARGTVILADYTEFTGNFTGIAAQCLQKLPASNNKFTYNCDGHTFNYLVDNGFTYCVVAVESVGRQVPIAFLERIKEEFTKKYGGGKAATATANSLNKEFGPKLKEQMQYCVDHPEEVSKLAKVKAQVSEVKGVMMENIEKVLDRGEKIELLVDKTENLRSQAQDFRQQGTQMRRKMWLQNMKIKLIVLGILIALILIIVLSVCGGFKCH

SEQ ID NO: 1516 - protein, 221 aa, Ricinus communis
MGEKSLIYAFVSRGTVVLAEYTEFSGNFNSIAFQCLQKLPSTNNKFTYNCDAHTFNFLVDNGFTYCVVADESAGRQVPMAFLERIKEDFMARYGNGKAATAPANSLDKEFGPKLKEHMQYCVDHPEEISKFAKVKAQVSEVKGVMMENIEKVLDRGEKIELLVDKTENLHQQAQDFRSSGTKIRRKMWLQNMKIKLIVLAILIALILIIVLSVCRGFNCGK

SEQ ID NO: 1517 - protein, 222 aa, Centaurea maculosa
  misc_feature (95)..(95): Xaa can be any naturally occurring amino acid
MGQQSLIYSFVSRGSVILAEYTEFTGNFTSIASQCLQKLPATNNKFTYNCDGHTFNYLVEDGFTYCVVAAESAGRQVPMAFLERTKDDFTKKYAXGGKAATATANSLNKEFGPKLKEQMQYCVDHPEEISKLSKVKAQVSEVKGVMMENIEKVLDRGEKIELLVDKTENLRSQAQDFRTQGTQMRRKMWLQNMKIKLIVLGIIIALILIIVLSVCGGFNCGK

SEQ ID NO: 1518 - protein, 182 aa, Centaurea maculosa
  misc_feature (135)..(135): Xaa can be any naturally occurring amino acid
MGQQSLIYSFVSRGAVILSEYTEFTGNFTSIASQCLQKLPATNNKFTYNCDGHTFNYLVEDGFTYCVVAAESAGRQVPMAFLERIKEDFTKKYGAGKAATAAANSLNKEFGPKLKEQMQYCVDHPEEISKLSKVXAQVTEVKGVMMENIEKVLDRGEKIELLVDKQRTSDLRHKILGHKVPK

SEQ ID NO: 1519 - protein, 221 aa, Centaurea maculosa
MGQQSLIYSFVARGTVILSEYTEFTGNFTSIAAQCLQKLPATNNKFTYNCDGHTFNYLVEDGFTYCVVAVESVGRQVPIAFLERVKEDFTKKYGGGKAATAVANSLSKEFGPKLKEQMQYCVDHPEEISKLAKVKAQVSEVKGVMMENIEKVLDRGEKIELLVDKTENLRSQAQDFRTQGTQIRRKMWLQNMKVKLIVLGIIIALILIIVLSACGGFNCGK

SEQ ID NO: 1520 - protein, 221 aa, Centaurea maculosa
MGQQSLIYGFVARGTVILAEFTEFTGNFTNIAAQCLQKLPATNNKFTYSCDGHTFNYLVEDGFTYCVVAVEAVGRQIPIACLERIKDEFTKKYGGGKAATAVANSLNKEFGSKLKEQMQYCVDHPEEISKLSKVKAQVSEVKGVMMENIEKVLDRGEKIELLVDKSENLHSQAQGFRTAGTQLRRKMWFQNMKVKLIVLGILIALILIIVLSACHGFKCGK

SEQ ID NO: 1521 - protein, 219 aa, Castanea mollissima
MGQQSLIYSFVARGTVILAEYTEFTGNFTSIASQCLQKLPASNNKFTYNCDGHTFNYLVENGFTYCVVAVESAGRQIPIAFLERVKEDFNKRYGGGKAATAVANSLNKEFGSKLKEHMQYCVDHPEEISKLAKVKAQVSEVKGVMMENIEKVLDRGEKIELLVDKTENLRSQAQDFRQQGTKMRRKMWLQNMKIKLIVLGIIIALILIIVLSVCHGFKC

SEQ ID NO: 1522 - protein, 222 aa, Castanea mollissima
MSQKPLIYAFVARGTVILSEYTEFSGNFNSIAFQCLQKLPSTNNKFTYNCDAHTFNYLVDNGFTYCVVADESVGRQVPMAFLERIKDDFVSRYSAGKADTAQANSLNKEFGPKLKEHMQYCVDHPEEISKLAKVKAQVSEVKGVMMENIEKVLDRGEKIELLVDKTENLHQQAQDFRTSGTKIRRKMWLQNMKIKLIVLGILIALILIIVLSICHGFNCAKK

SEQ ID NO: 1523 - protein, 244 aa, Cichorium intybus
  misc_feature (29)..(29): Xaa can be any naturally occurring amino acid
  misc_feature (53)..(53): Xaa can be any naturally occurring amino acid
SVIYWRRCSLTVFVIVGDTERGYYGTTVXDLSFVARGTVILSEYTEFTGNFTXIAAQCLQKLPATNNKFTYNCDGHTFNYLVEDGYTYCVVAVESIGRQVPIAFLERIKEDFTKKYGGGKAATAIANSLNKEFGPKLKEQMQYCVDHPEEISKLSKVKAQVSEVKGVMMENIEKVLDRGEKIEILVDKTENLRSQAQDFRTGGTQLRRKMWLQNMKIKLIVLGIIIALILIIVLSVCGGFNCGK

SEQ ID NO: 1524 - protein, 221 aa, Cichorium intybus
MGQQSLIYSFVARGTVILSEYTEFTGNFTSIAAQCLQKLPATNNKFTYNCDGHTFNYLVADGFTYCVVAVESVGRQVPMAFLERVKEDFTKKYGGGKAATAAANSLNKEFGPKLKEQMQYCVDNPEEISKLAKVKAQVSEVKGVMMENIEKVLDRGEKIELLVDKTENLRSQAQDFRTQGTQIRRKMWLQNMKIKLIVLGIIIALILIIVLSACGGFNCGK

SEQ ID NO: 1525 - protein, 208 aa, Cichorium intybus
  misc_feature (177)..(177): Xaa can be any naturally occurring amino acid
MGQQSLIYSFVSRGTVILAEYTEFTGNFTSIASQCLQKLPATNNKFTHNCDGHTFNYLVEDGFTYCVVAAESTGRQVPMAFLERTKDEFNKKYSGGKAATAAANSLNKEFGPKLKEQMQYCVDHPEEISKLSKVKAQVSEVKGVMMENIEKVLDRGEKIELLVDKTENLRSQAQDFXTQGTQIRRKMWLQNMKIKLIVLGIIIALILI

SEQ ID NO: 1526 - protein, 221 aa, Citrus sinensis
MSQKSLIYAFVARGNVVLAEYTEFSGNFNSIAYQCLQKLPASNNKFTYNCDAHTFNYLVDNGYTYCVVADESSGRQIPMAFLERVKDEFVSKYGGGKAATAPANGLNKEFGPKLKELMQYCVDHPEEISKLAKVKAQVSEVKGVMMENIEKVLDRGEKIELLVDKTENLHQQAQDFRSTGTKMRRKMWLQNMKIKLIVLGILIALILIIVLSVCHGFNCGK

SEQ ID NO: 1527 - protein, 219 aa, Citrus sinensis
MGQQSLIYSFVARGTVILAEYTEFTGNFTGIAAQCLQKLPSSNNKFTYNCDGHTFNYLVDDGFTYCVVAVESVGRQVPIAFLERVKEDFTKRYGGGKAATAVANGLNKEFGPKLKEHMQYCIDHPEEISKLAKVKAQVSEVKGVMMDNIEKVLDRGEKIELLVDRTENLRSQAQDFRQQGTQMRRKMWFQNMKIKLIVLGIIIALILIIVLSVCGGFNC

SEQ ID NO: 1528 - protein, 219 aa, Citrus sinensis
MGQQSLIYSFVARGTVILAEYTEFTGNFTSIASQCLQKLPATNNKFTYNCDGHTFNYLVENGFTYCVVAVESAGRQIPIAFLERVKEDFNKRYGGGKAATAVANSLNKEFGSKLKEHMQYCVDHPEEISKLAKVKAQVSEVKGVMMENIEKVLDRGEKIELLVDKTENLRSQAQDFRQQGTKMRRKMWIQNMKIKLIVLGIIIALILIIVLSVCHGFKC

SEQ ID NO: 1529 - protein, 220 aa, Coffea canephora
  misc_feature (140)..(140): Xaa can be any naturally occurring amino acid
MGQQSLIYSFVARGTVILAEYTEFTGNFTSIASQCLQKLPATNNKFTYNCDGHTFNYLVEDGFTYCVVAVESVGRQLPIAFLERIKEDFTKKYGGGKAATAVANSLNREFGPKLKEQMQYCVDHPEEISKLSKVKAQVSXVKGVMMENIEKVLDRGEKIELLVDKTENLRSQAQDFRTQGTKMRRKMWLQNMKIKLIVLGIIIALILIIVLSVCGGVKCH

SEQ ID NO: 1530 - protein, 226 aa, Coffea canephora
  misc_feature (194)..(194): Xaa can be any naturally occurring amino acid
  misc_feature (196)..(198): Xaa can be any naturally occurring amino acid
  misc_feature (202)..(203): Xaa can be any naturally occurring amino acid
  misc_feature (205)..(205): Xaa can be any naturally occurring amino acid
  misc_feature (210)..(210): Xaa can be any naturally occurring amino acid
  misc_feature (226)..(226): Xaa can be any naturally occurring amino acid
MAAKQKSSLIYAFVARGPVVLAEHTDFSGNFNSIAYQCLQKLPANSNNNKFTFNCDAHTFNYLVDNGFTYCVVAEESAGRQIPIAFLERVKDDFVSKYGGGKATTAPANGLNKEFGPKLKDHMKYCMDHPEEISKLAKVKAQVSEVKGVMMENIEKVLDRGEKIELLVDKTENLHQQAQDFRTTGTKMRRKMWXQXXXVKLXXLXIVIAXILIIILSACKGFNCGX

SEQ ID NO: 1531 - protein, 220 aa, Gossypium hirsutum
MGQQSLIYAFVARGTVVLADYTEFTGNFTGIASQCLQKLPSSNNKFTYNCDGHTFNYLVDNGFTYCVVAIESVGRQVPMAFLERIKEDFTKRYGGGKAAAAPANSLSKEFGPKLKEHMQYCIDHPEEISKIAKVKAQVSEVKGVMMENIEKVLDRGERIELLVDRTENLRSQAQDFRQQGTQMRRKMWLQNMKVKLIVLGILVALILIIVLSVCHGFKCS

SEQ ID NO: 1532 - protein, 259 aa, Gossypium hirsutum
  misc_feature (218)..(218): Xaa can be any naturally occurring amino acid
  misc_feature (220)..(220): Xaa can be any naturally occurring amino acid
  misc_feature (228)..(228): Xaa can be any naturally occurring amino acid
  misc_feature (244)..(244): Xaa can be any naturally occurring amino acid
MGQQSLIYSFVARGTVILAEYTEFTGNFTGIAAQCLQKLPASNNKFTYTCDGHTFNYLVEDGFTYCVVAVESAGRQVPIAFLERVKEDFNKRYGGGKAATATAKSLNREFGSKLKEHMQYCVDHPEEISKLAKVKAQVSEVKGVMMENIEKVLDRGEKIELLVDKTENLRSQAQDFRQQGTKMRRKMWLQNMKIKLIVLGILIALILIIVLSVCHGFXCXNLSWISLXLLFAALLTGVSIDWFXLLCVLGRIFLPSLAI

SEQ ID NO: 1533 - protein, 222 aa, Gossypium hirsutum
MVHKSLIYAFVSRGEVILAEYTEFSGNFNSIAFQCLQKLPSSNNKFTYNCDGHTFNYLVDNGYTYCVVADESAGRQVPIAFLERVKEDFVSKYGSGKAATAPANSLNKEFGPKLKEHMQYCVEHPEEISKLAKIKSQVSEVKGVMMENIEKVLDRGEKIELLVDKTENLHQQAQDFRNTGTKIRRKMWLQNMKIKLIVLGILIALILIIVLSVCHGFNCGGK

SEQ ID NO: 1534 - protein, 219 aa, Gossypium hirsutum
MGQQSLIYAFVARGTVVLADYTEFSGNFTSIASQCLQKLPASNNKFTYNCDGHTFNYLVDNGFTYCVVAVESAGRQVPIAFLERIKEDFTKRYGGGKAAAAPANSLSKEFGPKLKEHMQYCIDHPEEVSKIAKVKAQVSEVKGVMMENIEKVLDRGEKIELLVDKSENLRSQAQDFRQQGTQMRRKMWLQNMKIKLIVLGILIALILIIVLSVCHGFNC

SEQ ID NO: 1535 - protein, 222 aa, Gossypium hirsutum
MVPKSLIYAFVSRGGVILAEYTEYSGNFNSIALQCLQKLPSSNNKFTYNCDGHTFNYLVDNGYTYCVVADESAGRQVPIAFLERIKDDFVSKYDNGKAATAPANSLNKEFGPKLKEHMQYCMEHPEEISKLAKVKAQVSEVKGVMMENIEKVLDRGEKIELLVDKTENLHNQAQDFRSTGTKIRRKMWLQNMKIKLIVLGILIALILIIVLSVCHGFNCGKK

SEQ ID NO: 1536 - protein, 221 aa, Vigna unguiculata
MGQQSLIYSFVARGTVILAEYTEFTGNFTGVAAQCLQKLPSSNNKFTYNCDGHTFNYLVDNGFTYCVVAVESAGRQIPIAFLEQIKEDFTKKYAGGKAATAAAQSLNREFGPKLKEQMQYCVDHPEEISKLAKVKAQVSEVKGVMMENIEKVLDRGEKIELLVDKTENLRSQAQDFRQQGTKIRRKMWFQNMKIKLIVLGILIALILIIVLSVCGGFHCGK

SEQ ID NO: 1537 - protein, 221 aa, Vigna unguiculata
MGQKSLIYAFVSRGTVILAEYTEFSGNFNSIAFQCLQKLPATNNKFTYNCDAHTFNYLVDNGYTYCIVADESIGRQVPMAFLERVKDDFVSKYGGGRAATAPANSLNKEFGPKLKEHMQYCVDHPEEVNKLAKVKAQVSEVKGVMMENIEKVLDRGEKIELLVDKTENLHNQAQDFRTSGTRIRRKMWLQNMKIKLIVLGILIALILIIVLSVCHGFNCGK

SEQ ID NO: 1538 - protein, 225 aa, Vigna unguiculata
MGHNQNQRSLIYAFVSRGTVILAEYTEFSGNFNTIAFQCLQKLPASNNKFTYNCDGHTFNYLVDNGFTYCVVADESIGRQVPVAFLERVKDDFIAKYGGGKAATAAANSLNKEFGSKLKEHMQYCVEHPEEISKLAKVKAQVSEVKGVMMENIEKVLDRGEKIELLVDKTENLHHQAQDFRNSGTKIRRKMWLQNMKIKLIVLAILIALILIIVLSVCRGFNCGK

SEQ ID NO: 1539 - protein, 219 aa, Cycas rumphii
MGQQSLIYSFVARGTVVLAEYTEFTGNFTSIAAQCLQKLPASNNKFTYNCDNHTFNYLVEDGFTYCVVAAESVGRQVPIAFLERVKEDFKRRYGGGKADTAAAHGLNKDFGSKLKEHMQYCVDHPEEISKLAKVKAQVSEVKGVMMENIEKVLDRGEKIELLVDKTENLRFQAQDFQKQGTQLRRKMWFQNMKVKLIVLGILVALILIIVLSVCHGFKC

SEQ ID NO: 1540 - protein, 208 aa, Cynara scolymus
  misc_feature (86)..(87): Xaa can be any naturally occurring amino acid
  misc_feature (146)..(146): Xaa can be any naturally occurring amino acid
  misc_feature (185)..(185): Xaa can be any naturally occurring amino acid
MGQQSLIYSFVSRGTVILAEYTEFTGNFTSIASQCLQKLPATNNKFTYNCDGHTFNYLVEDGFTYCVVAAESAGRQVPMAFLERTXXDFTKKYGGGKAATAVANSLNKEFGPKLKEQMQYCVDHPEEISKLSKVKAQVSEVKGVMXENIEKVLDRGEKIELLVDKTENLRSQAQDFRTQGTQMRXKMWLQNMKIKLIVLGIIIALISS

SEQ ID NO: 1541 - protein, 104 aa, Cynara scolymus
  misc_feature (50)..(50): Xaa can be any naturally occurring amino acid
MGQQSLIYSFVSRGTVILSEYTEFTGNFTSIASQCLQKLPATNNKFTYNXEEHFHYLVEMVLHTVLLLPNLLADRFQWLFSSELRKTLPRNMVQGKLLQLLPIA

SEQ ID NO: 1542 - protein, 113 aa, Taraxacum officinale
MGQQSLIYSFVARGTVILSEYTEFTGNFTSIAAQCLQKLPATNNKFTYNCDGHTFNYLVADGFTYCVVAVESVGRQVPMAFLERAKEDFIKKYGGGKAATAVANSLNKEFGPS

SEQ ID NO: 1543 - protein, 221 aa, Taraxacum officinale
MGQQSLIYSFVSRGTVILAEYTEFTGNFTSIASQCLQKLPATNNKFTYNCDGHTFNYLVEDGFTYCVVAAESAGRQVPMAFLERTKDDFNKKYSGGKAATAVANSLNKEFGPKLKEQMQYCVDHPEEISKLSKVKAQVSEVKGVMMENIEKVLDRGEKIELLVDKTENLRSQAQDFRTQGTQIRRKMWLQNMKIKLIVLGIIIALILIIVLSVCGGFNCGK

SEQ ID NO: 1544 - protein, 221 aa, Festuca arundinacea
MGQQSLIYAFVARGAVVLAEYTEFTGNFTTIAAQCLQKLPSSNNKFTYNCDGHTFNYLVEDGFTYCVVAVESVGRQTPIAFLDRVKDDFTKKYGGGKAATAGASSLNREFGSKLKEHMQYCADNPEEINKLAKVKAQVSEVKGVMMENIEKVLDRGEKIELLVDKTENLRSQAQDFRQQGTQVRRKMWLQNMKIKLIVLGIIIALILIIILSVCHGFKCNK

SEQ ID NO: 1545 - protein, 219 aa, Zingiber officinale
MGQQSLIYSFVARGTVILAEYTEFTGNFNSIAAQCLQKLPASNNKFTYNCDGHTFNYLVEDGYTYCVVATESVGRQVPIAFLERVKEDFSKRYGGGKAATATANSLSREFGSKLKEHMQYCMDHPEEISKLAKVKAQVSEVKGVMMENIEKVLDRGEKIELLVDKTENLRSQAQDFRQQGTQMRRKMWLNNMKIKLIVLGIIIALILIIILSVCHGFKC

SEQ ID NO: 1546 - protein, 133 aa, Zingiber officinale
  misc_feature (120)..(120): Xaa can be any naturally occurring amino acid
MGQQSLIYSFVSRGTVILAEYTEFTGNFNSIAAQCLQKLPATNNKFTYNCDDHTFNYLVEDGYTYCVVAVESLGRQVPIAFLERVKEDFSKRYGGGKAATAPAIASAASLGPSLKSTCNXVSTTQKRSASSPR

SEQ ID NO: 1547 - protein, 221 aa, Vitis vinifera
MGQKSLIYAFVARGTVILAEYTEFSGNFNSIAFQCLQKLPATSNKFTYNCDAHTFTYLLDNGYTYCVVADESVGRQVPMAFLERIRDDFVARYGGEKAATAPANSLNKDFSSKLKEHMQYCVDHPEEISKLAKVKDQVSEVKGVMMENIEKVLDRGEKIELLVDKTHNLHEQAQDFRSAGTKIRRKMWLQNMKIKLIVLGILVALILIIVLSVCHGFNCGK

SEQ ID NO: 1548 - protein, 220 aa, Vitis vinifera
MVGQQSLIYSFVARGTVILAEYTEFTGNFTSIAAQCLQKLPASNNKFTYNCDGHTFNYLVENGFTYCVVAVESAGRQIPIAFLERVKDDFNKRYGGGKAATAVANGLNKEFGPKLKEHMQYCVDHPEEISKLAKVKAQVSEVKGVMMENIEKVLDRGEKIELLVDKTENLRSQAQDFRQQGTKMRRKMWMQNMKIKLIVLGIIIALILIIVLSICHGFKC

SEQ ID NO: 1549 - protein, 219 aa, Vitis vinifera
MGQQSLIYSFVARGTVILAEFTEFSGNFTSIAAQCLQKLPATNNKFTYNCDGHTFNYLVEDGYTYCVVAVEAVGRQIPIAFLERVKEDFTKRYGGGKAATAVANSLNKEFGPKLKEQMQYCVDHPEEISKLAKVKAQVSEVKGVMMENIEKVLDRGEKIELLVDKTENLRSQAQDFRQQGTKMRRKMWLQNMKIKLIVLGILIALILIIVLSICGGFNC

SEQ ID NO: 1550 - protein, 222 aa, Ipomoea nil
MGQQKALIYAFVARGNAVLAEHTDFNGNFNSIAFQCLQKLPSSNNKFTYNCDGHTFNYLVDNGFTYCVVAEESTGRQVPMAFLERIKDDFVSKYGGGKAATAPANSLSKEFGPKLRDHMQYCADHPEEISKLAKVKAQVSEVKGVMMENIEKVLDRGEKIELLVDKTENLHQQAQDFRSTGTKIRRKMWLQNMKIKLIVLGIIIALILIIVLSVCHGFNCGK

SEQ ID NO: 1551 - protein, 222 aa, Ipomoea nil
MGQQKALIYAFVARGNVILAEHTDFSGNFNSIAFQCLQKLPASNNKFTYNCDGHTFNYLVDNGFTYCVVAEESAGRQVPMAFLERIKDDFVAKYGGGKAATAPANSFNKEFGAKLREHMQYCVDHPEEISKIAKVKAQVSEVKGVMMDNIEKVLDRGEKIELLVDKTENLHQQAQDFRSTGTKIRRKMWLQNMKVKLIVLGIIIALILIIVLSVCHGFNCGK

SEQ ID NO: 1552 - protein, 222 aa, Ipomoea nil
MVQQKALIYAFVARGSVILAEHTDFSGNFNSIAYQCLQKLPASNSKFTYNCDGHTFNYLVDNGFTYCVVAEESAGRQIPIGYLERIKDDFVSKYGGGKAAAAAANSLNREFGPKLRDHMQYCVDHPEEVSKLSKVKAQVSEVKGVMMENIEKVLDRGEKIELLVDKTENLHNQAQDFRNTGTQIRRKMWLQNMKIKLIVLGIIIALILIIVLSVCHGFNCGK

SEQ ID NO: 1553 - protein, 220 aa, Ipomoea nil
MGQQSLIYSFVARGTVVLAEYTGFTGNFTTIASQCLQKLPASNNKFTYNCDGHTFNYLVEDGFTYCVVAVETVGRQIPIAFLERIKDDFTNKYGGGKAATAVANSLNKEFGPKLKEQMQYCVDHPEEVSKLAKVKAQVSEVKGVMMENIEKVLDRGEKIELLVDKTENLRSQAQDFRTQGTKMRRKMWLQNMKVKLIVLAIIIALILIIVLSICGSSKCH

SEQ ID NO: 1554 - protein, 220 aa, Actinidia deliciosa
MGQQSLIYSFVARGTVILAEYTEFTGNFTNIASQCLQKLPASNNKFTYNCDGHTFNYLVENGFTYCVVAVEAAGRQIPIAFLERVKDDFNKRYGGGKAATAVAKSLNREFGSKLKEHMQYCVDHPDEISKLAKVKAQVSEVKGVMMENIEKVLDRGEKIEVLVDKTENLRSQAQDFRQQGTKIRRKMWFQNMKIKLIVFGILILLILIIILSVCNGFKCT

SEQ ID NO: 1555 - protein, 221 aa, Lactuca sativa
MGQQSLIYSFVARGTVILSEYTEFTGNFTSIAAQCLQKLPATNNKFTYNCDGHTFNYLVADGFTYCVVAVESVGRQVPMAFLERAKEDFTKKYGGGKAATAVANSLNKEFGPKLKEQMQYCVDHPEEISKLAKVKAQVSEVKGVMMENIEKVLDRGEKIELLVDKTENLRSQAQDFRTQGTQIRRKMWLQNMKIKLIVLGIIIALILIIVLSACGGFNCGK

SEQ ID NO: 1556 - protein, 214 aa, Lactuca sativa
MGQQSLIYSFVARGTVILSEYTEFTGNFTSIAAQCLQKLPATNNKFTYNCDGHTFNYLVEDGYTYCVVAVEAIGRQVPIAFLERIKEDFTKKYGGGKAATAIATSLNKEFGPKLKEQMQYCVDHPEEISKLSKVKAQVSEVKGVMMENIEKVLDRGEKIEILVDKTENLRSQAQDFRTGGTQLRRKMWLQNMKIKLIVLGIIIALILIIVLSVC

SEQ ID NO: 1557 - protein, 221 aa, Lactuca sativa
MGQQSLIYSFVSRGTVILAEYTEFTGNFTSIASQCLQKLPATNNKFTYNCDGHTFNYLVEDGFTYCVVAAESAGRQVPMAFLERTKDDFNKKYGGGKAATAVANSLNKEFGPKLKEQMQYCVDHPDEISKLSKVKAQVSEVKGVMMENIEKVLDRGEKIELLVDKTENLRSQAQDFRTQGTQIRRKMWLQNMKIKLIVLGIIVALILIIVLSVCGGFNCGK

SEQ ID NO: 1558 - protein, 221 aa, Lactuca sativa
MGQQSLIYSFVARGTVILSEYTEFTGNFTSIAAQCLQKLPATNNKFTYNCDGHTFNYLVEDGYTYCVVAVEAIGRQVPIAFLERIKEDFTKKYGGGKAATAIANSLNKEFGPKLKEQMQYCVDHPEEISKLSKVKAQVSEVKGVMMENIEKVLDRGEKIEILVDKTENLRSQAQDFRTGGTQLRRKMWLQNMKIKLIVLGIIIALILIIVLSVCGGFNCGK

SEQ ID NO: 1559 - protein, 221 aa, Lactuca sativa
MGQQSLIYSFVSRGTVILAEYTEFTGNFTSIASQCLQKLPATNNKFTYNCDGHTFNYLVEDGFTYCVVAAESAGRQVPMAFLERTKDDFNKKYGGGKAATAVANSLNKEFGPKLKEQMQYCVDHPDEISKLSKVKAQVSEVKGVMMENIEKVLDRGEKIELLVDKTENLRSQAQDFRTQGTQIRRKMWLQNMKIKLIVLGIIIALILIIVLSVCGGFSCGK

SEQ ID NO: 1560 - protein, 219 aa, Liriodendron tulipifera
MGQQSLIYTFVARGTVILAEYTEFTGNFTSIAAQCLQKLPATNNKFTYNCDAHTFNYLVEDGFTYCVVAVESAGRQIPIAFLERVKDDFNKKYGGGRAATAVANSLNKEFGSKLKEHMQYCVDHPEEISKLAKVKAQVSEVKGVMMENIEKVLDRGEKIELLVDKTETLRNEADGFRKQGTQMRRKMWLANMKIKLIVLGIIVALILIIILSVCHGFKC

SEQ ID NO: 1561 - protein, 221 aa, Eragrostis curvula
MGQQSLIYAFVARGTVILAEFTEFTGNFTTIASQCLMKLPASNNKFTYNCDGHTFNYLVEDGFTYCVVAVESVGRQVPIAFLDRVKEDFAKRYGGGKAATAAANSLNREFGSKLKEHMQYCVDHSEEVSKLSKVKAQVSEVKGVMMENIEKVLDRGEKIELLVDKTENLRSQAQDFRQQGTQVRRKMWLQNMKIKLIVLGIIIALILIIILSVCHGFKCNK

SEQ ID NO: 1562 - protein, 222 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGSK

SEQ ID NO: 1563 - protein, 220 aa, Zea mays
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 1564 - protein, 220 aa, Medicago truncatula
MANNQNQKQLIYAFVSRGTVILAEFTEFSGNFNSIAFQCLQKLPSTNNKFTYNCDNHTFNYLIDNGYTYCVVADETTGRQVPMAFLERVKDDFVSKYGGEKASTAPPNSLNKEFGPKLKEHMQYCVDHPDEISKLAKVKAQVSEVKGVMMENIEKVLDRGEKIELLVDKTDNLHHQAQDFRSSGTSIRRKMWLQNMKVKLIVLGILIALILIIVLSVTRG

SEQ ID NO: 1565 - protein, 220 aa, Medicago truncatula
MGQNQKSLIYAFVSRGSVILSEYTEFSGNFNSIAFQCLQKLPASNNKFTYNCDGHTFNYLVDNGYTYCVVADETVGRQVPVAFLERVKDDFVAKYGGGKASTAAPNSLNKEFGPKLKEHMQYCVDHPEEVSKLAKVKAQVSEVKGVMMENIEKVLDRGEKIELLVDKTENLHHQAQDFRNSGTKIRRKMWLQNMKIKLIVLAILIALILIIVLPIVLKNK

SEQ ID NO: 1566 - protein, 219 aa, Medicago truncatula
MGQQSLIYSFVARGTVILAEYSDFTGNFTTIALQCLQKLPASNNRFTYNCDGHTFSFLVDNGFTYCVVAVESVGRQIPIAFLERIKDDFNKRYGGGRATTATAKSLNKEFGPKLKEQMQYCVEHPEEVSKLAKVKAQVSEVKGVMMENIDKVIDRGEKIEVLVDKTENLRSQAQDFRQQGTQLRRKMWYQNMKIKLIVLAIIIALILIIVLSVCHGFSC

SEQ ID NO: 1567 - protein, 219 aa, Cucumis melo
MGQQTLIYSFVARGTVILAEYTEFTGNFASIASQCLQKLPASNNKFTYNCDGHTFNYLVENGFTYCVVAVEAAGRQIPIAFLERVKEDFNKRYGGGKAATAVAHSLNKEFGSKLKEHMQYCLDHPEEISKLAKVKAQVSEVKGVMMENIEKVLDRGEKIELLVDKTENLRSQAQDFRTQGTKMRRKMWFQNMKIKLIVLGIIIALILIIILSVCPGFKC

SEQ ID NO: 1568 - protein, 219 aa, Cucumis melo
  misc_feature (62)..(62): Xaa can be any naturally occurring amino acid
MGQQSLIYSFVARGTVILAEYTEFTGNFTTIASQCLHKLPATNNKFTYNCDGHTFNYLVDNXFTYCVVAVEAAGRQIPIAFLERVNEDFVKRYGGGKAMTATANSLNKEFGSKLKEHMKYCVEHPEEISKLAKVKAQVSEVKGVMMENIEKVLDRGEKIELLVDKTENLRSQAQDFRQQGTKMRRKMWYQNMKIKLIVLAIVLALILIIILSVCGGFNC

SEQ ID NO: 1569 - protein, 222 aa, Nuphar advena
  misc_feature (91)..(91): Xaa can be any naturally occurring amino acid
  misc_feature (130)..(130): Xaa can be any naturally occurring amino acid
  misc_feature (171)..(171): Xaa can be any naturally occurring amino acid
  misc_feature (189)..(189): Xaa can be any naturally occurring amino acid
MGQQSLIYSFVARGTVILAEYTEFTGNFTLIASQCLQKLPATSNKFTYNCDGHTFNYLVDNGFTFCVVAVESVGRQLPIAFLERVKEDFNXRYGGGKAATAVANSLNKEFGSKLKEHMQYCVDHPEEVSXLAKVKAQVSEVKGVMMENIEKVLDRGEKIELLVDKTENLRXQAQDFRTQGTTMRRKMWXQNMKIKLIVLGIIVTLILIIILTVCHGFNCGKK

SEQ ID NO: 1570 - protein, 222 aa, Quercus rubra
MSQKPLIYAFVARGTVILSEYTEFSGNFNSIAFQCLQKLPSTNNKFTYNCDAHTFNYLVDNGYTYCVVADESVGRQVPMAFLERIKDDFVSRYSAGKADTAQANSLNKEFGPKLKEHMQYCVDHPEEISKLAKVKAQVSEVKGVMMENIEKVLDRGEKIELLVDKTENLHQQAQDFRTSGTKIRRKMWLQNMKIKLIVLGILIALILIIVLSICHGFNCGKK

SEQ ID NO: 1571 - protein, 219 aa, Quercus rubra; identical to SEQ ID NO: 1521

SEQ ID NO: 1572 - protein, 220 aa, Elaeis guineensis
MGQQTLIYSFVARGTVILAEYTEFTGNFTSIASQCLQKLPSSNNKFTYNCDSHTFNYLVEDGFTYCVVAVESAGRQIPIAFLERVKEDFKKRYGGGKAATASANSLNREFGPKLKEHMQYCVDHPEEISKLSKVKAQVSEVKGVMMENIEKVLERGEKIELLVDKTENLRSQAQDFRQQGTKMRRKMWLQNMKIKLIVLGIIIALILIIILSVCHGFKCT

SEQ ID NO: 1573 - protein, 230 aa, Allium cepa
  misc_feature (20)..(20): Xaa can be any naturally occurring amino acid
MGQQTLIYSFVARGTVILAXYTEFTGNFTSIASQCLQKLPATNNKFTYNCDGHTFNYLVEDGFTYCVVAVESAGRQIPIAFIERIKDDFVKRYGGGKAATAAANSLNREFGPKMKEHMQYCVDHPEEISKLAKVKAQVSEVKGVMMENIEKVLDRGEKIELLVDKTENLRSQAQDFRQQGTKMRRKMWFQNMKIKLIVLGIIIALILIIMLVCVPWIQMLDPNHQGSFIV

SEQ ID NO: 1574 - protein, 219 aa, Carica papaya
MGQQSLIYSFVARGTVVLAEYTEFTGNFTSIAAQCLQKLPASNNKFTYNCDGHTFNYLVDNGFTYCVVAVESVGRQVPIAFLERIKEDFTKRYGGGKAATAAANSLNKEFGSKLKEHMQYCVDHPEEISRLAKVKAQVSEVKGVMMENIEKVLDRGEKIELLVDKTENLRSQAQDFRQQGTKMRRKMWFQNMKIKLIVLAILIALILIIVLSVCGGFKC

SEQ ID NO: 1575 - protein, 219 aa, Carica papaya
MGQQSLIYSFVARGTVVLAEYTEFTGNFTSIASQCLQKLPASNNKFTYNCDGHTFNYLVENGFTYCVVAVESAGRQIPIAFLERVKEDFNKRYGGGKAATAVANGLNKEFGPKLKEHMQYCVDHPEEISKLAKVKAQVSEVKGVMMENIEKVLDRGEKIELLVDKTENLRSQAQDFRTQGTKMRRKMWIQNMKIKLIVLGIIIALILIIVLSVCHGFKC

SEQ ID NO: 1576 - protein, 221 aa, Prunus persica
MGQKSLIYAFVARGTVILAEYTEFSGNFNSIAFQCLQKLPATNNKFTYNCDGHTFNYLVDNGYTYCVVADESSGRQVPIAFLERIKDDFVSKYGGGKAATAPANSLNKEFGSKLKEHMQYCVDHPEEISKLAKVKAQVSEVKGVMMENIEKVLDRGEKIELLVDKTENLHQQAQDFRNVGTKMRRKMWLQNMKVKLIVLGILIALILVIILSVCHGFNCGK

SEQ ID NO: 1577 - protein, 101 aa, Prunus persica
  misc_feature (4)..(4): Xaa can be any naturally occurring amino acid
  misc_feature (24)..(24): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (42)..(43): Xaa can be any naturally occurring amino acid
  misc_feature (60)..(60): Xaa can be any naturally occurring amino acid
  misc_feature (63)..(63): Xaa can be any naturally occurring amino acid
  misc_feature (66)..(67): Xaa can be any naturally occurring amino acid
  misc_feature (69)..(70): Xaa can be any naturally occurring amino acid
  misc_feature (73)..(73): Xaa can be any naturally occurring amino acid
MGQXSLIYSFVARGTVILAEYTEXTGNFTXIXSXCLQKLPAXXTSSRTTATATPSTTSSXMAXHTXXLXXRLXVDKFLLLSLSESRRILPVDMVEEKLQQQ

SEQ ID NO: 1578 - protein, 224 aa, Arachis hypogaea
MGQNQRSLIYAFVSRGTVILAEYTEFSGNFNSIAFQCLQKLPATNNKFTYNCDNHTFNYLVDNGYTYCVVADESVGRQVPIAFLERIKDDFVSRFGGGKAATAPANGLSKEFGPKLKEHMQYCVDHPEEISKLAKVKAQVSEVKGVMMENIEKVLDRGEKIELLVDKTENLHHQAQDFRNSGTKIRRKMWLQNMKIKLIVLGILIALILIIVLSVCRGFSHCGK

SEQ ID NO: 1579 - protein, 222 aa, Arachis hypogaea
MGQKSLIYAFVSRGTVVLAEYTEFSGNFNTIAFQCLQKLPSSNNKFTYNCDSHTFNFLVDNGFTYCVVADDSAGRQVPIAFLERVKDDFVSKYGASDKAGASAANSLNKEFGPKLKEHMQYCIDHPEEISKLAKVQNQVSEVKGVMMENIEKVLDRGEKIELLVDKTENLHNQAQDFRTSGTKIRRKMWLQNMKMKLIVLAILIVLILVIVLSVCHGFKCGK

SEQ ID NO: 1580 - protein, 220 aa, Capsicum annuum
MGQQSLIYSFVARGTVILAEYTEFTGNFTSIASQCLQKLPASNNKFTYNCDGHTFNYLVDDGFTYCVVAVESVGRQVPIAFLERVKDDFTKKYGGGKAATAVANSLNKEFGPKMKEQMQYCVDHPEEINKLAKVKAQVSEVKGVMMENIEKVLDRGEKIELLVDKTENLRSQAQDFKTQGTKVRRKMWLKNMKIKLIVLRIIIALILVIVLSICHGFKCH

SEQ ID NO: 1581 - protein, 220 aa, Petunia hybrida
MGQQTLIYSFVARGTVILAEYTEFTGNFNTIASQCLQKLPASNNRFTYNCDGHTFNFLAENGFTYCVVATESAGRQIPIAFLERIKDDFTKRYGGGKAATATAKSLNKEFGPKLKEHMKYCVEHPEEISKLAKVKAQVSEVKGVMMQNIEKVLDRGEKIELLVDKTENLRSQAQDFRQQGTKIRRKLWYENMKIKLIVLGIIIALILIIILSVCPGFNCF

SEQ ID NO: 1582 - protein, 219 aa, Ananas comosus
MGQQSLIYSFVARGTVVLAEYTEFSGNFNTIAAQCLQKLPASNNKFTYNCDGHTFNYLVEDGFTYCVVAVESVGRQIPIAFLERVKEDFTKRYGGGKAATAAASSLNRDFGSKLKEHMQYCVDHPEEISKLAKVKAQVSEVKGVMMENIEKVLDRGEKIELLVDKTENLRSQAQDFRQQGTKIRRKMWLQNMKIKLIVLGIIIALILIIILSVCHGFKC

SEQ ID NO: 1583 - protein, 219 aa, Populus trichocarpa
MSQKSLIYAFVSRGTVILADYTEFSGNFNSIAFQCLQKLPATNNKFTYNCDGHTFNYLVDNGFTYCVVAAESAGRQVPIAFLERVKDDFVTKYGGGKAATAQANGLNKEFGPKLKEHMQYCADHPEEISKLAKVKAQVSEVKGVMMENIEKVLDRGEKIELLVDKTENLHQQAQDFRSQGTQIRRKMWLQNMKVKLIVLGILIVLILIIVLSICKGFNC

SEQ ID NO: 1584 - protein, 219 aa, Populus trichocarpa
MGQQSLIYSFVARGTVILAEYTEFKGNFTGIAAQCLQKLPASNNKFTYNCDGHTFNYLVEDGFTYCVVAVESAGRQIPIAFLERVKEDFNKRYGGGKAATAVANSLNREFGSKLKEHMQYCVDHPEEISKLAKVKAQVSEVKGVMMENIEKVLDRGEKIELLVDKTENLRSQAQDFRQQGTKMRRKMWIQNMKMKLIVLGIIIALILIIVLSVCHGFNC

SEQ ID NO: 1585 - protein, 219 aa, Populus trichocarpa
MGQQTLIYSFVARGTVILAEYTEFKGNFTGIAAQCLEKLPASNNKFTYNCDGHTFNYLVENGFTYCVVAVESAGRQIPIAFLERVKEDFNKRYSGGKAATAVAKSLNGEFGSKLKGHMQYCVDHPEEISKLAKVKAQVSEVKGVMMENIEKVLDRGDKIELLVDKTENLRSQAQDFRQQGTKMRRKMWIQNMKIKLIVLGIIIALILIIVLSICHGFNC

SEQ ID NO: 1586 - protein, 221 aa, Populus trichocarpa
MNQKSLIYAFVSRGTVILAEFTEFSGNFNSIAFQCLQKLPATNNKFTYNCDGHTFNYLADNGFTYCVVADESAGRQVPMAFLERVKDDFVSKYGGGKAATAQANGLNKEFGPKLKEHMKYCADHPEEISKLAKVKAQVSEVKGVMMENIEKVLDRGEKIELLVDKTENLHSQAQDFRSQGTQIRRKMWLQNMKVKLIVLGILIALILIIVLSVCKGFNCGK

SEQ ID NO: 1587 - protein, 219 aa, Populus trichocarpa
MGQQSLIYSFVARGTVILADYTDFSGNFAGIAAQCLQKLPATNNKFTYSCDGHTFNYLVDNGFTYCVVAVESVGRQIPIAYLERIKEDFTNRYGGGKAAIAVANGLKKEFGPKLKEQMQYCMDHPEEVSKLAKVKAQVSEVKGVMMENIEKVLDRGEKIELLVDKTENLRSQAQVFRQQGGQIKRKMWWQNMKIKLIVLAILIVLILIIVLSICGGFKC

SEQ ID NO: 1588 - protein, 193 aa, Solanum tuberosum
MGQQKALIYAFVGRGNVILAEYTDFSGNFNSIAYQCLQKLPASNNKFTYNCDGHTFNYLVDNGFTYCVVAEESVGRQIPIAFLERIKDDFMSKYGSGKAATAPPNSLNKEFGPKLKEHMQYCAEHPEEISKLAKVKAQVSEVKGVMMENIEKVLDRGEKIELLVDKTENLHHQAQDFREHGEPKYGGRCGCKT

SEQ ID NO: 1589 - protein, 220 aa, Solanum tuberosum
MGQQSLIYSFVARGTVILAEYTEFTGNFTSIASQCLQKLPASNNKFTYNCDGHTFNYLVDDGFTYCVVAVESVGRQVPIAFLERVKDDFTKKYGGGKAATAVANSLNKEFGPKIKDQMQYCVDHPEEINKLAKVKAQVSEVKGVMMENIEKVLDRGEKIELLVDKTENLRSQAQDFKTQGTKVRRKMWLQNMKIKLIVLGIILALILVIVLSICHGFNCH

SEQ ID NO: 1590 - protein, 222 aa, Solanum tuberosum; identical to SEQ ID NO: 180

SEQ ID NO: 1591 - protein, 221 aa, Prunus persica; identical to SEQ ID NO: 1576

SEQ ID NO: 1592 - protein, 219 aa, Prunus persica
MGQQSLIYSFVARGTVILAEYTEFTGNFTSIASQCLQKLPATNNKFTYNCDGHTFNYLVDNGFTYCVVAVEAIGRQIPIAFLERIKEDFTGRYGGGKAATAVANSLNKEFGSKLKEHMQYCVDHPEEISKLAKVKAQVSEVKGVMMENIEKVLDRGEKIELLVDKTENLRSQAQDFRQQGTQMRRKMWLQNMKIKLIVLGILIALILIIVLSVCNGFKC

SEQ ID NO: 1593 - protein, 222 aa, Pseudoroegneria spicata
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIILSVCHGFNCGKK

SEQ ID NO: 1594 - protein, 223 aa, Raphanus sativus
MAQQQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQPNSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 1595 - protein, 219 aa, Raphanus sativus
MSQQSLIYSFVARGTVILVEFTDFKGNFTTIAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 1596 - protein, 219 aa, Raphanus sativus; identical to SEQ ID NO: 1595

SEQ ID NO: 1597 - protein, 223 aa, Raphanus sativus
MAQQQSSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 1598 - protein, 220 aa, Raphanus sativus
MAQQQSLIYSFVARGTVILVEFTDFKGNFTSIAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1599 - protein, 253 aa, Raphanus sativus
MSQQSLIYSFVARGTVILVEFTDFKGNFTTIAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRKKMWLQNMKIKLIVLAIIIALILIIVLSVCMASSAKSPGKKIQNSLEIFLTRYIVYLPLFPLFPLSSSF

SEQ ID NO: 1600 - protein, 219 aa, Raphanus sativus
MAQQSLIYSFVARGTVILVEFTDFKGNFTSIAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1601 - protein, 219 aa, Raphanus sativus; identical to SEQ ID NO: 1595

SEQ ID NO: 1602 - protein, 221 aa, Raphanus sativus
MAQQQQSLIYSFVARGTVILVEFTDFKGNFTSVAAQCLQKLPSSNNKFTYNCDGHTFNYLVEDGFTYCVVAVDSAGRQIPMAFLERVKEDFNKRYGGGKAATAQPNSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1603 - protein, 220 aa, Oryza sativa
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQVRRKMWLQNMKIKLIVLGIIIALILIIILSVCHGFKCK

SEQ ID NO: 1604 - protein, 220 aa, Oryza sativa
MGQQSLIYAFVARGTVVLAEYTEFTGNFTTIAAQCLQKLPASNNKFTYNCDGHTFNYLVEDGFTYCVVAVESVGRQIPIAFLDRVKEDFTKRYGGGKAATAAANSLNREFGSKLKEHMQYCVDHPEEISKLAKVKAQVSEVKGVMMENIEKVLDRGEKIELLVDKTENLRSQAQDFRQQGTKVRRKMWLQNMKIKLIVLGIIIALILIIILSVCHGFKCK

SEQ ID NO: 1605 - protein, 221 aa, Carthamus tinctorius; identical to SEQ ID NO: 1519

SEQ ID NO: 1606 - protein, 221 aa, Carthamus tinctorius
MGQQSLIYSFVSRGAVILSEYTEFTGNFTSIASQCLQKLPATNNKFTYNCDGHTFNYLVEDGFTYCVVAAESAGRQVPMAFLERIKEDFTKKYAAGKAATAVANSLNKEFGPKLKEQMQYCVDHPEEISKLSKVKAQVTEVKGVMMENIEKVLDRGEKIELLVDKTENLRSQAQDFRTQGTQMRRKMWLQNMKIKLIVLGIIIALILIIVLSVCGGFNCGK

SEQ ID NO: 1607 - protein, 221 aa, Carthamus tinctorius
MGQQSLIYSFVARGTVILAEFTEFTGNFTNIAAQCLQKLPATNNKFTYSCDGHTFNYLVEDGFTYCVVAVEAVGRQIPIACLERIKDEFTKKYGGGKAATAVANGLNKEFGSKLKEQMQYCVDHPEEISKLSKVKAQVSEVKGVMMENIEKVLDRGEKIELLVDKSENLHSQAQGFRTAGTQLRRKMWFQNMKVKLIVLGILIALILIIVLSACHGFKCGK

SEQ ID NO: 1608 - protein, 221 aa, Carthamus tinctorius
MGQQSLIYSFVSRGTVILAEYTEFTGNFTSIASQCLQKLPATNNKFTYNCDGHTFNYLVEDGFTYCVVAAESAGRQVPMAFLERTKDDFTKKYGGGKAATATANSLNKEFGPKLKEQMQYCVDHPEEISKLSKVKAQVSEVKGVMMENIEKVLDRGEKIELLVDKTENLRSQAQDFRTQGTQMRRRMWLQNMKIKLIVLGIIIALILIIVLSVCGGFNCGK

SEQ ID NO: 1609 - protein, 109 aa, Senecio madagascariensis
MQYCVDHPEEISKLSKVKAQVSEVKGVMMENIEKVLDRGEKIEVLVDKTENLRSQAQDFRTQGTQIRRKMWLQNMKIKLIVLGIIIALILIIVLSICGRLQLWQVKHIY

SEQ ID NO: 1610 - protein, 220 aa, Sorghum bicolor; identical to SEQ ID NO: 1563

SEQ ID NO: 1611 - protein, 222 aa, Sorghum bicolor; identical to SEQ ID NO: 1562

SEQ ID NO: 1612 - protein, 221 aa, Glycine max
MGQKSLIYAFVSRGTVILAEYTEFSGNFNSIAFQCLQKLPATNNKFTYNCDAHTFNYLVDNGYTYCVVADESIGRQLPMAFLERVKDEFVSKYGGGKAATAPANSLNKEFGPKLREHMQYCVDHPEEISKLAKVKAQVSEVKGVMMENIEKVLDRGDKIELLVDKTENLHNQAQDFRTSGTRIRRKMWLQNMKIKLIVLGILIALILIIVLSVCRGFNCGK

SEQ ID NO: 1613 - protein, 225 aa, Glycine max
MGQDQNQRSLIYAFVSRGTVILAEYTEFSGNFNTIAFQCLQKLPASNNKFTYNCDGHTFNYLVDNGFTYCVVADESIGRQVPVAFLERVKDDFVAKYGGGKAATVAANSLNKEFGSKLKEHMQYCVEHPEEISKLAKVKAQVSEVKDVMMENIEKVLDRGEKIELLVDKTENLHHQAQDFRNSGTKIRRKMWLQNMKIKLIVLAILIALILIIVLSVCRGFNCGK

SEQ ID NO: 1614 - protein, 221 aa, Glycine max
MGQKSLIYAFVSRGTVILAEYTEFSGNFNSIAFQCLQKLPATNNKFTYNCDAHTFNYLVDNGYTYCVVADESIGRQLPMAFLERVKDEFVAKYGGGKAATAPVNSLNKEFGPKLREHMQYCVDHPEEISKLAKVKAQVSEVKGVMMENIEKVLDRGDKIELLVDKTENLHNQAQDFRTSGTRIRRKMWLQNMKIKLIVLGILIALILIIVLSVCRGFNCGK

SEQ ID NO: 1615 - protein, 225 aa, Glycine max
MGHDQNQRSLIYAFVSRGTVILAEYTEFSGNFNTIAFQCLQKLPASNNKFTYNCDGHTFNYLVDNEFTYCVVADESIGRQVPVAFLERAKDDFVAKYGGGKATTAAANSLNKEFGSKLKEHMQYCVEHPEEISKLAKVKAQVSEVKDVMMENIEKVLDRGEKIELLVDKTENLHHQAQDFRNSGTKIRRKMWLQNMKIKLIVLAILIALILIIVLSVCRGFNCGK

SEQ ID NO: 1616 - protein, 221 aa, Glycine max
MGQQSLIYSFVARGTVILAEYTEFTGNFTGVAAQCLQKLPSSNNKFTYNCDGHTFNYLVDNGFTYCVVAVESAGRQIPIAFLERIKEDFTKKYAGGKAATAAAQSLNREFGPKLKEQMQYCVDHPEEISKLAKVKAQVSEVKGVMMENIEKVLDRGEKIELLVDKTENLRSQAQDFRQQGTKIRRKMWFQNMKIKLIVLGIIIALILIIVLSVCGGFNCGK

SEQ ID NO: 1617 - protein, 221 aa, Glycine max
MGQQSLIYSFVARGTVILAEYTEFTGNFTSVAAQCLQKLPSSNNKFTYNCDGHTFNYLVDNGFTYCVVAVESAGRQIPIAFLERIKEDFTKKYAGGKAATAAAHSLNREFGPKLKEEMQYCVDHPEEISKLAKVKAQVSEVKGVMMENIEKVLDRGEKIELLVDKTENLRSQAQDFRQQGTKIRRKMWFQNMKIKLIVLGIIIALILIIVLSVCGGFNCGK

SEQ ID NO: 1618 - protein, 221 aa, Euphorbia esula
MGQQSLIYSFVASGTVILADYTEFTGNFTSIAAQCLQKLPATNNKFTYNCDGHTFNYLVDNGFTYCVVAVESVGRQVPIAFLERIKEEFSKKYGGGKAATAVANSLSKEFGSKLKEQMQYCVDHPEEVSKLAKVKAQVSEVKGVMMENIEKVLDRGEKIELLVDKTENLRSQAQDFRQQGTKMRRKMWLANMKIKLIVLGILIALILIIVLSVCHGFNCNK

SEQ ID NO: 1619 - protein, 221 aa, Euphorbia esula
  misc_feature (220)..(220): Xaa can be any naturally occurring amino acid
MSQKSLIYAFVSRGTVILAEYTEFSGNFNSIAFQCLQKLPSTNNKFTYNCDAHTFNYLVDNGFTYCVVADESAGRQIPMAFLERVKQDFVTKYGSGKAATAPANSLDKEFGPKLKEHMQYCVDHPEEVSKLAKVKAQVSEVKGVMMENIEKVLDRGEKIELLVDKSETLHNQAQDFRSSGTKIRRKMWLQNMKIKLIVLGILIALILIIVLSVCKGFNCXK

SEQ ID NO: 1620 - protein, 219 aa, Euphorbia esula
MGQQSLIYCFVARGTVILAEYTEFTGNFTSIASQCLQKLPASNNKFTYNCDGHTFNYLVENGFTYCVVAVESAGRQIPIAFLERVKEDFNKRYGGGKAATAQANGLKREFGPKLKEHMQYCLDHPEEVNKLAKVKAQVSEVKGVMMENIEKVLDRGEKIELLVDKTENLRSQAQDFRQQGTKMRRKMWIQNMKMKLIVLGIIIALILIIVLSVCHGFNC

SEQ ID NO: 1621 - protein, 221 aa, Fragaria vesca
MGQKSLIYAFVARGTVILAEYTEFSGNFNSIAFQCLQKLPATNNKFTYNCDAHTFNYLVDNGFTYCVVADESAGRQVPIAFLERVKDDFVAKYGGGKAATAAANSLNKEFGSKLKEHMQYCVDHPEEISKLAKVKAQVTEVKGVMMENIEKVLDRGEKIELLVDKTETLHHQAQDFRNVGTKMRRKMWLQNMKVKLIVLGILIALILIIILSVCHGFNCGK

SEQ ID NO: 1622 - protein, 219 aa, Fragaria vesca
MGQQSLIYSFVARGTVILAEFTEFTGNFTGIAAQCLQKLPATNNKFTYNCDGHTFNYLVDNGFTYCVVAVEALGRQVPIAFLERIKEDFTNRYGGGKAATAVANSLNKEFGSKLKEHMQYCVDHPEEISKLAKVKAQVSEVKGVMMENIEKVLDRGEKIELLVDKTENLRSQAQDFRQQGTQMRRKMWFQNMKIKLIVLGILIALILIIVLSVCNGFKC

SEQ ID NO: 1623 - protein, 175 aa, Saccharum officinarum
  misc_feature (171)..(171): Xaa can be any naturally occurring amino acid
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMGNIEKVLDRGEKIELLVDKTENCVXRHRF

SEQ ID NO: 1624 - protein, 222 aa, Saccharum officinarum; identical to SEQ ID NO: 1562

SEQ ID NO: 1625 - protein, 222 aa, Saccharum officinarum
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIVALILIIILSVCHGFKCGSK

SEQ ID NO: 1626 - protein, 220 aa, Saccharum officinarum
MGQQSLIYAFVARGTVVLAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 1627 - protein, 222 aa, Saccharum officinarum; identical to SEQ ID NO: 1562

SEQ ID NO: 1628 - protein, 222 aa, Saccharum officinarum; identical to SEQ ID NO: 1562

SEQ ID NO: 1629 - protein, 221 aa, Helianthus annuus
MGQQSLIYSFVARGTVILSEYTEFTGNFTTIAAQCLQKLPATNNKFTYNCDGHTFNYLVEDGFTYCVVAVESIGRQVPIACLERIKDDFTKKYGGGKAATATANSLNKEFGPKLKEQMQYCVDHPEEISKLSKVKAQVSEVKGVMMENIEKVLDRGEKIEILVDKTENLRSQAQDFRTQGTQMRRKMWLQNMKIKLIVLGIIIALILIIVLSACGGFNCGK

SEQ ID NO: 1630 - protein, 221 aa, Helianthus annuus
MGQQSLIYSFVARGTVILSEYTEFTGNFTSIAAQCLQKLPASNNKFTYNCDGHTFNYLVEGGFTYCVVAVESVGRQVPMAFLERVKEDFTKKYGGGKAATAVANSLSKEFGPKLKEQMQYCVDHPEEISKLAKVKAQVSEVKGVMMENIEKVLDRGEKIELLVDKTENLRSQAQDFRTQGTQMRRKMWLQNMKIKLIVLGIIIALILIIVLSACGGFNCGK

SEQ ID NO: 1631 - protein, 221 aa, Helianthus annuus
MGQQSLIYSFVSRGTVILAEYTEFTGNFTSIASQCLQKLPTTNNKFTYNCDGHTFNYLVEDGFTYCVVAAESVGRQVPMAFLERIKDDFNKKYGGGKAATAIANSLNKEFASKLKEQMQYCVDHPEEISKLSKVKAQVSEVKGVMMENIEKVLDRGEKIELLVDKTENLRSQAQDFRTQGTQMRRKMWLQNMKIKLIVLGIIIALILIIVLSVCGGFNCGK

SEQ ID NO: 1632 - protein, 221 aa, Helianthus annuus
MGQQSLIYSFVARGTVILSEYTEFTGNFTTIAAQCLQKLPATNNKFTYNCDGHTFNYLVEEGFTYCVVAVESIGRQVPIAFLERIKDDFTKKYGGGKAATATANSLNKEFGPKLKEQMQYCVDHPEEISKLSKVKAQVSEVKGVMMENIEKVLDRGEKIEVLVDKTENLRSQAQDFRTQGTQMRRKMWLQNMKIKLIVLGIILALILIIVVSACGGFNCGK

SEQ ID NO: 1633 - protein, 221 aa, Helianthus annuus
MGQQSLIYSFVSRGTVILAEYTDFTGNFTSIASQCLQKLPATNNKFTYNCDGHTFNYLVEDGFTYCVVAAESAGRQVPMAFLERIKDDFNKKYSGGKADTAVANSLNKEFGPKLKEQMQYCVDHPEEISKLSKVKAQVSEVKGVMMENIEKVLDRGEKIELLVDKTENLRSQAQDFRTQGTQMRRKMWLQNMKIKLIVLGIIIALILIIVLSVCGGFNCGK

SEQ ID NO: 1634 - protein, 219 aa, Panicum virgatum
MGQQQLIYAFVARGTVVLAEYTEFTGNFTTIAAQCLQKLPASNNKFTYNCDGHTFNYLVEDGFTYCVVAVDSVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKC

SEQ ID NO: 1635 - protein, 219 aa, Panicum virgatum
MGQQQLIYAFVARGTVVLAEYTEFTGNFTTIAAQCLQKLPASNNKFTYNCDGHTFNYLVEDGFTYCVVAVESVGRQIPIGFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTQVRRKMWLQNMKIKLIVLGIIIALILIIILSVCHGFKC

SEQ ID NO: 1636 - protein, 222 aa, Panicum virgatum
MGQQQLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGSK

SEQ ID NO: 1637 - protein, 221 aa, Panicum virgatum
MGQQQLIYAFVARGTVVLAEYTEFTGNFTTIAAQCLQKLPASNNKFTYNCDGHTFNYLVEDGFTYCVVAVESVGRQIPIAFLDRIKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGK

SEQ ID NO: 1638 - protein, 219 aa, Thellungiella halophila
MAQQSLIYSFVARGTVILVEFTDFKGNFTSIAAQCLQKLPSSNNKFTYNCDGHTFNYLVEDGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 1639 - protein, 220 aa, Nicotiana tabacum
MGQQSLIYSFVARGTVILAEYTEFTGNFTSIASQCLQKLPASNNKFTYNCDGHTFNYLVDNGFTYCVVAVESVGRQVPIAFLERVKDDFTKKYGGGKAATAVANSLNREFGPKMKEQMQYCIDHPEEISKLAKVKAQVSEVKGVMMENIEKVLDRGEKIELLVDKTENLRSQAQDFKTQGTKVRRKMWLQNMKVKLIVLAIIVALILVIVLSICHGFKCH

SEQ ID NO: 1640 - protein, 104 aa, Nicotiana tabacum
MQYCADHPDEISKIAKVKAQVSEVKGVMMENIEKVLDRGEKIELLVDKTENLHHQAQDFRNTGTQIRRKMWLQNMKIKLIVLGILIALILIIVLSVCKGFNCGE

SEQ ID NO: 1641 - protein, 220 aa, Nicotiana tabacum
MGQQSLIYSFVARGTVILAEYTEFTGNFTSIASQCLQKLPASNNKFTYNCDGHTFNYLVEDGFTYCVVAVESVGRQIPIAFLERTKEEFTKKYGGGKAATAVANSLNREFGPKLKEQMQYCVDHPEEISKLAKVKAQVSEVKGVMMENIEKVLDRGEKIELLVDKTENLRSQAQDFRTQGTTMRRKMWLQNMKIKLIVLGIIIALILIIVLSVCGGFNCH

SEQ ID NO: 1642 - protein, 222 aa, Nicotiana tabacum
MGQQKALIYAFVARGNVLLSEYTDFSGNFNSIAFQCLQKLPASNNKFTYNCDGHTFNYLVDNGFTYCVVAEESVGRQVPIAFLERVKDDFVSKYGGGKAATATPNSLNKEFGPKLKEHMHYCADHPEEISKLAKVKAQVSEVKGVMMENIEKVLDRGEKIELLVDKTENLHHQAQDFRNTGTQIRRKMWLQNMKVKLIVLGILIALILIIVLSVCHGFNCGK

SEQ ID NO: 1643 - protein, 220 aa, Solanum lycopersicum
MGQQSLIYSFVARGTVILAEYTEFTGNFTSIASQCLQKLPASNNKFTYNCDGHTFNYLVEEGFTYCVVAVESVGRQIPIAFLERTKEEFTKKYGGGKAATAVANSLNREFGPKLKEQMQYCVDHPEEISKLAKVKAQVSEVKGVMMENIEKVLDRGEKIELLVDKTENLRSQAQDFRTQGTTMRRKMWLQNMKIKLIVLGIIIALILIIVLSVCGGFKCH

SEQ ID NO: 1644 - protein, 220 aa, Solanum lycopersicum
MGQQSLIYSFVARGTVILAEYTEFTGNFTSIASQCLQKLPASNNKFTYNCDGHTFNYLVDDGFTYCVVAVESVGRQVPIAFLERVKDDFTKKYGGGKAATAVANSLNKEFGPKIKEQMQYCVDHPEEINKLAKVKAQVSEVKGVMMENIEKVLDRGEKIELLVDKTENLRSQAQDFKTQGTKVRRKMWLQNMKIKLIVLGIIFALIMVIVLSICHGFNCH

SEQ ID NO: 1645 - protein, 226 aa, Triphysaria pusilla
MAQNSRKTLIYALVARGTPPVVLSEYTEFSGNFNSIAYQCLQKLPATNNKFTYNCDNHTFNYLVHDGFTYCVVAEESAGRQLPIAFLERVRDEFVAKYAAGKAATAPANGLNKEFGPKLKEHMQYCVEHPEEISKLSKVKAQVSEVKGVMMENIEKVLDRGEKIEILVDKTENLHNQAQDFRSTGTKIRRKMWLQNMKIKLIVLAIVIALILIIVLSICKGFNCGN

SEQ ID NO: 1646 - protein, 220 aa, Triphysaria pusilla
  misc_feature (7)..(7): Xaa can be any naturally occurring amino acid
  misc_feature (77)..(77): Xaa can be any naturally occurring amino acid
MGQQSLXYSFVARGTVILSEYTEFSGNFTGIASQCLQKLPATNNKFTYNCDGHTFNYLVDDGFTYCVVAIESVGRQXPIAYLERVKDDFTKKYGGGKAATAVANSLNKEFGPKLKEQMQYCVDHPEEISKLSKVKAQVSEVKGVMMENIEKVLDRGEKIELLVDKTENLHSQAQDFRTQGTKMRRKMWLQNMKIKLIVLGIIIALILIIVLSVCGGFKCH

SEQ ID NO: 1647 - protein, 219 aa, Triphysaria pusilla
MGQQSLIYGFVARGTVILAEYTEFTGNFTGIAAQCLQKLPATNNKFTYNCDGHTFNYLVDNGFTYCIVAVESVGRQIPIAFLERVKEDFTKKYGGGKAATAVANSLNKEFGPKLKEQMQYCVDHPEEVSKLAQVKAQVSEVKGVMMENIEKVLDRGEKIELLVDKTENLRSQAQDFRTQGTKMRRKMWLQNMKIKLIVLGIIIALILIIVLSVCGGFKC

SEQ ID NO: 1648 - protein, 222 aa, Juglans hindsii x Juglans regia
MGQQSLIYSFVARGTVILAEYTEFSGNFTGIASQCLQKLPASNNRFTYNCDGHTFNYLVDNGFTYCVVAVEAVGRQMPIAFLERIKEDFTQRYGGGKAATAVANSFNKEFGPKLKEQMQYCVDHPEEISKLAKVKAQVSEVKGVMMENIEKVLDRGEKIELLVDKTENLRSQAQDFRQQGTQIRRKMWFQNMKIKLIVLGILVALILIIVLSVCGGFNCGKK

SEQ ID NO: 1649 - protein, 223 aa, Triticum aestivum; identical to SEQ ID NO: 1494

SEQ ID NO: 1650 - protein, 222 aa, Triticum aestivum; identical to SEQ ID NO: 1593

SEQ ID NO: 1651 - protein, 222 aa, Triticum aestivum; identical to SEQ ID NO: 1593

SEQ ID NO: 1652 - protein, 219 aa, Zamia vazquezii
  misc_feature (187)..(187): Xaa can be any naturally occurring amino acid
  misc_feature (196)..(196): Xaa can be any naturally occurring amino acid
  misc_feature (207)..(207): Xaa can be any naturally occurring amino acid
MGHQSLIYSFVARGTVVLAKYTEFTGNFTSIASQCLQKLPASNNKFTYNCDNHTFNYLVEDGFTYCVVAVESVGRQIPIAFLERIKEDFKRRYGGGKADTAVAHGLNKEFGPKLKEHMQYCVDHPEEISKLAKVKAQVSEVKGVMMENIEKVLDRGEKIELLVDKTENLRFQAQDFQKQGTQLRRKXWFQNMKVKXIVLGILVALIXIIVLSVCHGFKC

SEQ ID NO: 1653 - protein, 175 aa, Hordeum vulgare
MLRAGGSRLVAPGLRRFLGPGAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 1654 - protein, 175 aa, Brachypodium distachyon
MLRTGGSRLVAPGLRRLLGPSGREGAAPGLSAAGVRAYHERVVDHYNNPRNVGSFDKDDPNVGTGLVGAPACGDVMKLQIRVDEGTGKIVDACFKTFGCGSAIASSSVATEWVKGKQMEEVVTIKNTEIAKHLSLPPVKLHCSMLAEDAIKAAVKDYEAKKAKVGDSPAEKVAEA

SEQ ID NO: 1655 - protein, 171 aa, Festuca arundinacea
MLRTGGSRLVAPALRRLLGERAQPGLAAAGARAYHERVVDHYNNPRNVGSFDKDDPNVGTGLVGAPACGDVMKLQIRVDEGTGKIVDACFKTFGCGSAIASSSVATEWVKGKQMEEVVTIKNTEIAKHLSLPPVKLHCSMLAEDAIKAAVKDYEAKKAKLGDGPAEKAAEA

SEQ ID NO: 1656 - protein, 175 aa, Leymus cinereus x Leymus triticoides
  misc_feature (19)..(19): Xaa can be any naturally occurring amino acid
MLRAGGSRLVAPGLRRLLXPGAGERAAPGLTAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 1657 - protein, 180 aa, Zea mays
MLRAGGRRLLAPGLRRLGLGTGASGEAGPAAAAAGVRAYHERVVDHYNNPRNVGSFDKDDPNVGTGLVGAPACGDVMKLQIRVDENSGKIVDACFKTFGCGSAIASSSVATEWVKGKPMDEVLTIKNTEIAKHLSLPPVKLHCSMLAEDAIKAAVKDYEAKKSKMGQKGEDSPSEKAAEA

SEQ ID NO: 1658 - protein, 180 aa, Zea mays
MLRAGARQLLAPGLRRLGLGTGAAGQVGPAAAAAGMRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKAKMGQKSEDSPSEKAAEA

SEQ ID NO: 1659 - protein, 175 aa, Zea mays
MLRAGGSRLVAPGLRRLLGPGAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 1660 - protein, 175 aa, Pseudoroegneria spicata; identical to SEQ ID NO: 1659

SEQ ID NO: 1661 - protein, 175 aa, Secale cereale; identical to SEQ ID NO: 1659

SEQ ID NO: 1662 - protein, 181 aa, Sorghum bicolor
MLRAGGRLLLAPGLRRFGLGTGAAAGEAGPAAAAAGVRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKVKMGQKGVDSPSEKAAEA

SEQ ID NO: 1663 - protein, 183 aa, Saccharum officinarum
  misc_feature (176)..(176): Xaa can be any naturally occurring amino acid
MLRAGGRRLLAPGLRRLGLGTGAAAAAGEAGPAAAAAGVRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLSPVKLHCSMLAEDAIKAAVKDYEAKKAKMGQKGEDSXSEKAAEA

SEQ ID NO: 1664 - protein, 176 aa, Panicum virgatum
MLRAGGRRLLAPGLRRLGFGAAGEAGPAAAGARAYHERVVDHYNNPRNVGSFDKDDPNVGTGLVGAPACGDVMKMQIRVDEDSGKIVDACFKTFGCGSAIASSSVATEWVKGKPMDEVLTIKNTEIAKHLSLPPVKLHCSMLAEDAIKAAVKDYEAKKAKMGQKGEDSPSEKAAEA

SEQ ID NO: 1665 - protein, 179 aa, Panicum virgatum
MLRAGGRRLLAPGLRRLGFGAAGEAGPAAAAAAGARAYHERVVDHYNNPRNVGSFDKDDPNVGTGLVGAPACGDVMKMQIRVDEDSGKIVDACFKTFGCGSAIASSSVATEWVKGKPMDEVLTIKNTEIAKHLSLPPVKLHCSMLAEDAIKAAVKDYEAKKAKMGQKGEDSPSEKAAEA

SEQ ID NO: 1666 - protein, 175 aa, Triticum aestivum; identical to SEQ ID NO: 1659

SEQ ID NO: 1667 - protein, 177 aa, Triticum aestivum
MLRAGGSRLVAPGLRRLLGPGAGERAAPGLAAAGAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 1668 - protein, 175 aa, Triticum aestivum
MLRAGGSRLVAPGLRRLLGPDAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 1669 - protein, 138 aa, Triticum aestivum
  misc_feature (80)..(80): Xaa can be any naturally occurring amino acid
  misc_feature (137)..(137): Xaa can be any naturally occurring amino acid
MLRAGGRRLLAPGLRRLGLGTGASGEAGPAAAAAGVRAYHERVVDHYNNPRNVGSFDKDDPNVGTGLVGAPACGDVMKLXIRVDENSGKIVDACFKTFGCGSAIASSSVATEWVKGKPMDEVLTIKNTEIAKHLSLXQ

SEQ ID NO: 1670 - protein, 343 aa, Brachypodium distachyon
MWESVALTLAGAAGNSIGKVLQKKGTQILPPLSFKLKVIRGYALNRLWISGFLLDMCGAALMLTALSQAPVSVVQPIAGCGLAILCVFSHFYLKEVMNGLDWIAITLAGLGTIGVGVGGEEQKVEEIPLFNIPWLVLSVVILFVLLNTWLHIYKRQRREQELTGPEVIEEVIYGLESGILFGISSVISKMGFVMSEMGFPKIVVPAAISCSVACSAVGFVYQTRGLKHGRAIVVSTCTSVASIVSGVVAGMVALDEHLPTAPTSRFFLLLGWFFIITGVILLVTSTRLIARLPKPVQKFLKSNMERSHSIRRPGSARGKDPIQSTTIHASSLHILTSPGKEKA

SEQ ID NO: 1671 - protein, 343 aa, Leymus cinereus x Leymus triticoides
  misc_feature (90)..(90): Xaa can be any naturally occurring amino acid
  misc_feature (104)..(104): Xaa can be any naturally occurring amino acid
MWESVALTLAGAADNSIGKVLQKKGTLILPPLSFKLKVIRGYALNRLWISGFLLDMCGAALMLTALSQAPVSVVQPIAGCGLAILCVFSXFYLKEVMNGLDWIXITMAGLGTIGVGVGGEEQKVEEIPLFSIPWLVLTVVILFVLLNTWLHIYKKQRREQELTGPEVIEEVIYGLESGILFGISSVISKMGFVMSEMGFPKIVVPAAISCSVACSAVGFVYQTRGLKHGRAIVVSTCTSVASIVSGVVAGMVALDEHLPTAPAGRFFLLLGWFFIITGVILLVTSTRLIARLPKPVRKFLKSNMERSHSIRRPGSARGKDPNQSTTIHASSLQILTSTGKEKA

SEQ ID NO: 1672 - protein, 343 aa, Pseudoroegneria spicata
MWESVALTLAGAAGNSIGKVLQKKGTLILPPLSFKLKVIRGYALNRLWISGFLLDMCGAALMLTALSQAPVSVVQPIAGCGLAILCVFSHFYLKEVMNGLDWIAITMAGIGTIGVGVGGEEQKVEEIPLFSIPWLVLTVVILFVLLNTWLHIYKKQRREQELTGPEVIEEVIYGLESGILFGISSVISKMGFVMSEMGFPKIVVPAAISCSVACSAVGFIYQTRGLKHGRAIVVSTCTSVASIVSGVVAGMVALDEHLPTAPAGRFFLLLGWFFIITGVILLVTSTRLIARLPKPVQKFLKSNMERSHSIRRPGSARGKDPNQSTTIHASTLHILTSTGKEKA

SEQ ID NO: 1673 - protein, 159 aa, Oryza sativa
MWESVALTLAGAAGNNVGKVLQKKGTHILPPLSFKLKVIRAYALNRLWISGFLMDMCGAALMLTALSQAPVSVVQPIAGCGLAILCVFSHFYLKESMNGLDWVAITLAGLGTIGVGVGGEEQKVDKIPLFNIPWLVLSIVILFVGSSQHLASYLQKAKA

SEQ ID NO: 1674 - protein, 343 aa, Sorghum bicolor
MWESVALTLAGTAGNNIGKVLQKKGTLILPPLSLKLKVVKAYASNQLWISGFLMDMCGAALMLTALSQAPVSVVQPIAGCGLAILCVFSHFYLKEVMNGLDWIAITLAGLGTIGVGVGGEEQKVDQIPLLNIPWLVLSIVILFVLLNTWLHMYKKQRREQELTGPEVIEEIIYGLESGILFGISSVISKMGFVMSEMGFPKIVVPAAISCSVCCSAVGFVYQTRGLKHGRAIVVSTCTSVASIVSGVVAGMIALDEHLPKAPTARFLLLLGWFFIISGVILLVSSTRLIARLPRPVQKFLKSNIERTHSIRRPGSARGKDAIPTTTIHTSSLHLLTSPTKEKA

SEQ ID NO: 1675 - protein, 343 aa, Triticum aestivum
  misc_feature (27)..(27): Xaa can be any naturally occurring amino acid
  misc_feature (140)..(140): Xaa can be any naturally occurring amino acid
MWESVALTLAGAAGNSIGKVLQKKGTXILPPLSFKLKVIRGYALNRLWISGFLLDMCGAALMLTALSQAPVSVVQPIAGCGLAILCVFSHFYLKEVMNGLDWIAITMAGLGTIGVGVGGEEQKVEEIPLFSIPWLVLTVXILFVLLNTWLHIYKKQRREQELTGPEVIEEVIYGLESGILFGISSVISKMGFVMSEMGFPKIVVPAAISCSVACSAVGFVYQTRGLKHGRAIVVSTCTSVASIVSGVVAGMVALDEHLPTAPAGRFFLLLGWFFIITGVILLVTSTRVIARLPKPVQKFLKSNMERSHSIRRPGSARGKDSNQSTTIHASTLHILTSTGKEKA

SEQ ID NO: 1676 - protein, 472 aa, Zea mays
MKLERYASGGALLLRRATSAKLVSASSHLLFRATVLATLALVFLFTLHYPSLLSRSFHLSAGGGGGADDGARSSASHRSLLMSSASYGGAAWEKEVRRSARPSRDGGISVLVTGAAGFVGTHCSLALRARGDGVLGLDNFNSYYDPSLKRARQALLASRGVLVLDADINDAPLLERLFDVAAFTHVLHLAAQAGVRYAMEAPQTYVASNVAGLVSVLEVAAKHADPQPAVVWASSSSVYGLNTDAPFSEDHRTDRPASLYAATKKAGEAIAHAYNHIYGLSITGLRFFTVYGPWGRPDMAYFFFARSIVAGEPVTLFRAADGSDARRDFTYIDDVVKGCLGALDTAGKSTGSRSGRKSGPAPLRVYNLGNTSPVPVTRMVAILEKLLGRKANKRVVTMPSNGDVPFTHANVSHAAHDFGYRPTTSLEAGLRHFVDWFVSYYKLDAKIAKPAAADDDKPAKKKKKNKAMSASS

SEQ ID NO: 1677 - protein, 466 aa, Sorghum bicolor
MKLERYASGGALLLRRATSAKLVSASSHLLFRATVLATLALVFLFTLHYPSLLSRSFHLSAGAGDDSAGGGAHSTSASHRSLLMSSSASASYGGAAWEKEVRRSARPSRDGGISVLVTGAAGFVGTHCSLALKARGDGVLGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSRSGKKSGPAPLRVYNLGNTSPVPVTRMVAILEKLLGKKANKRIVTMPSNGDVPFTHANVSHAAHDFGYRPTTSLEAGLRHFVDWFVNYYKLDTKIAKGARSSAAADKPA

SEQ ID NO: 1678 - protein, 541 aa, Oryza sativa
MESGGILPPSETCAGSGSPDGRGGWRAARFLIAVGFLERIGFNGVQGNLVMYLSGPMGMSTAAAAAGANAWGGTVLVLTLVGALAADSRLGRYRAIVAAGVLHLLSLGMLTISSVMQPTHQHPVSCHDAAAACSPPPPPSPSLGRLVFFHAALYLLALAQGFHNPCSEAFGADQFTPPSDPGARASRSSYFNWYNFSSSCGYAISNTAMSYVEDNVSWTVGFAACLATTAVYLPVFLLGTAAYRAEQPIDGALLALLAKKSLSATRVWTARVFPRKDAICTERLLLAKEEEVEHGKGFVVKLLPIWVTSIVFAAVISQQVTLFTKQGSTMDRRVAVGGGVFVLPPAALQDVISATMLTVLPAYDRALVPLARRFTGHPAGITTLQRVGAGMATCCLHMVVAALVEAKRLRAASDAGLPADATVPMSVWWLVPQYALVGLSKVFGVIGLQEFFYDQVPDDLRSVGLAMSLSAQGVGSYASSALVSAIDWATTRRGGESWFSDDINRAHLDYFYWLLAALAALDVAVFVYIAKRYVYRNKDEQ

SEQ ID NO: 1679 - protein, 571 aa, Brachypodium distachyon
MFTVPLSFVLNLLFGHEISQCRLLSDLIRVLINLVVLCDNSALASEDDEFNTEHREEVRGLLRLFPIWATCIIYAVIFSQSSTFFTKQAATLDRRIGQSFKVPPAALQTFISVTIITFIPVYDRLFVPVARRFTRLSSGITMLQRIGTGLVLAMVAMAVAALVEMKRLGVARDAGLVDEPKAALPMSLWWMVPQYVLFGLSDVFAMIGLQEFFYDQVPDALRSLGLAFFLSIFGVGHFLSSFLISAIDGATKKSGASWFSNNLNRAHLDYFYWLLAGLCAVELLAFLIVSRVYVYKKRVAHHDDVFDFRHGCVPISLCSRRRRAFLLLIACLHAAMEIAERFAYKGVASNLIQYLTGPLGQPMARAAASIDAWKGVSQMLPLPLACIADAWLGRYRAIVLASILFILVSHKLDHNSIRGEVSRSLIFLSPWKLSRAWARCLCRRRSASSGPAGTSPSSTWRCTWWRWARARTSRARRRSPPTSSTTRTPRSPWRGAPSSTGGTWACAPAPPSPSWSPATSRTTSAGASASASPASSSPSPSPSSSWAPAPTATTPPRSPAPSPASARRSSH

SEQ ID NO: 1680 - protein, 542 aa, Zea mays
MDANTLLLPCSDGAVAGAVDFRGRPASRSGTGRWSAAMFVLGVEIAERFAYHGVSANLISYLTGPLGESTAGAAAAINAWSGVATMLPLLMACVADAWLGRYRTIVLASLLFVVSMGMLTVSALPAFHHDGCSSYASASRPLACSPPPVQVGVFYVSLYLVALAEAGHKPCAQAFGADQFDQNDPKESASRSSFFNWWYFGMCSGTAVTTMVSSYIQDNVGWGLGFGVPCLVMLFALLMFLLGTRNYRYYTYTESSPFARLATAFVALIKGSKSRQHDGTLASDDAGHREEVKGVLRLFPIWATCIIYAVIFSQSSTFFTKQAATLDRRVGSTLRVPPAALQTFISVTIMAFIPVYDRAFVPLARRLTRLSSGITMLQRIGTGLVLALVAMVVAALVEMRRLAVARDAGLVDQPKAALPMSLWWMVPQYVLFGLSDVFAMIGLQEFFYDQVPDALRSLGLAFFLSIFGVGHLFSSFIISAIDGATKKSGASWFSNNLNRAHLDYFYWLLAGLCAVELAAFIIVSRVYVYKKRMSHDNNAAAM

SEQ ID NO: 1681 - protein, 545 aa, Oryza sativa
MASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDDALAVVDDDDGGDHREELRGVLRLFPIWATCIIYAVIFSQSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 1682 - protein, 526 aa, Panicum virgatum
MDASTLLLPCSDGVVAGAVDFRGRPASRAGTGRWPAAMFVLGVEIAERFAYHGISANLISYLTGPLGESTAGAAAAINAWSGVATMLPLLMACVADAWLGRFRTIVLASLLFVVSMGMLTVSTLPVFNHDGCSSYHSKSLACSPSPVQVTVFYVSLYLVALAEAGHKPCAQAFAADQFDQHDPKESESRSSFFNWWYFGMCSGTAATTLVSSYIQDNVGWGLGFGIPCLVMVFALLALLLGTRSYRYYTSTESSPFARLARAFVALIRGTKSSQCESLLTDDDEHREEVKGVLRLFPIWATCIIYTVIFSQSSTFFTKQAATLDRRIGSTLRVPAAALQTFISLTIMAFIPIYDRAFVPAARRFTRLSSRHHHAAADRHRACPGHGRHGRGGAGGDEAARRGEGRRPRGPAQGGAADDAVVDAATVRVVRAVGRVRHDRAPGVLLRPGPRRAAQPRAGLLPQHLRRGPLPEQRPHLRHRRRHQEERRELVLQQPQPRAPRLLLLAARRALRRGAGRVRRRFPRICV

SEQ ID NO: 1683 - protein, 633 aa, Brassica napus
MGFLVDTQKEGGGHSWGCVRSLVRRKQVDSAANGHSHHQQLAKALTVSHLVAIGVGATIGAGVYILVGTVAREHSGPSLALSFLIAGIAAALSAFCYAELSSRCPSAGSAYHYSYICVGEGVAWLIGWALILEYTIGGSAVARGISPNLALIFGGEDGLPSFLARQQIPGLDVIVDPCAAILVFIVTGFLCLGIKESTFAQGIVTAVNVCVLLFVIVAGSYLGFKTGWAGYELPTGLFPFGVDGMFAGSATVFFAFIGFDSLASTAEEVKNPQRDLPIGIGLALFLCCSLYMMVSIVIVGLVPYYAMDPDTPISSAFASHDMQWAVYLITLGAVMALCSALMGSLLPQPRILMAMARDGLLPSVFSDVNRRTQVPVKATVATGLCAATLSFFLDVSQLAGMVSVGTLLAFTMVAISVLILRYVPPDELPLPASLQDRIDPVSVIPGETKSSHHVGTSSNSTKQPLIGENDASVMEKQEALGFWVLSEENRRKVGGWSIMFTCIGAFLLSYSASSINFPGFIRYPLCGIGGSLLLAGLIALSSIDQDDARHTFGHSGGFICPLVPLLPIICILINMYLLVNLGSATWARVSVWLVIGVLVYVFYGRKHSSLANAVYVTTAHAEEIYREHEASLA

SEQ ID NO: 1684 - protein, 389 aa, Raphanus sativus
MFAGSATVFFAFIGFDSLASTAEEVKNPQRDLPIGIGLALFLCCSLYMMVSIVIVGLVPYYAMDPDTPISSAFASHDMQWAVYLITLGAVMALCSALMGSLLPQPRILMAMARDGLLPSLFSDVNRRTQVPVKATLATGFCAATLSFFLDVSQLAGMVSVGTLLAFTMVAISVLILRFVPPDELPLPSSLQQRIDSVSFISGETKSSDHVGTSSNSSKQPLIGENDASVMEKQEALGFWVLSEENRRKVAGWSIMFTCIGAFLLSYSASSLNFPGFIRYPLCGVGGSLLLAGLIALSSIDQDDARHTFGHSGGFICPLVPLLPIICILINMYLLVNLGSATWARVSVWLVIGVLVYVFYGRKHSSLANAVYVTTAHAEEIYREHGASLA

SEQ ID NO: 1685 - protein, 328 aa, Hordeum vulgare
  misc_feature (11)..(11): Xaa can be any naturally occurring amino acid
MSSSGAGEEGXLPVELRKGANGLDKVVLRQGPRISAEVYLYGGHVTSWKDQFGEELLFVSNKAIFKPPKAIRGGIPICFPQFSNFGHLEAHGFARNKIWTVDTDPPPFPVPISSRAYIDLILKPTDEDLKIWPHSFEYRLRIALGPGGDLMLTSRIRNTNADGKPFSFTFAYHTYFSISDISEIRVEGLETLDYLDNLQDRARFTEQGDAIVFESELDRIYLGTPSKIAIIDHEKKRTFVVRKGGLPDAVVWNPWDKKAKAMADFGDDEYKRMVCVEAAAIEKPITLKPGEEWTGKLELSAVPSSYYSGQLDPDRVIQDSVVPEDSVS

SEQ ID NO: 1686 - protein, 337 aa, Brachypodium distachyon
MSSSVAGAGEESGAAAPQGPAPVERCKGVNGLEKVVLREVRGSSAEVYLYGGHVTSWKDEHGEELLFVSNKAIFKPPKAIRGGIPICFPQFSNFGHLEPHGFARNKTWTVEADPPPFPVPISSKAYIDLILKPTEEDVKIWPHSFEYRLRIALGPGGDLMLTSRIRNTNADGKSFSFTFAYHTYFSISDISEIRVEGLETLDYLDNLQDRARFTEQGDAIVFESELDRIYLGTPSKIAIIDHEKKRTFVVRKGGLPDAVVWNPWDKKAKAMADFGDDEYKRMVCVEAAAIEKQVTLKPGEEWTGKLELSAVPSSYYSGQLDPDRVIQDSTVPEDSIS

SEQ ID NO: 1687 - protein, 344 aa, Oryza sativa
MSSAASASAAGGAGEEGAAAAAQPQQEGPVVTCKGVNGLDKVVLREVRGSSAEVYLYGGHVTSWKDEHGEELLFVSNKAIFKPPKAIRGGIPICFPQFSNFGNLDPHGFARNRTWSVENDPPPFPVPTSNKAYVDLILTHTEEDLKIWPHSYEFRLRVALGPGGDLMLTSRIRNTNADGKPFSFTFAYHTYFSISDISEVRVEGLETLDYLDNLQERNRYTEQGDAIVFESELDRIYLGTPSKIAIIDHEKKRTFVVRKGGLPDAVVWNPWDKKAKAMSDFGDDEYKRMVCVEAAAIEKPITLKPGEEWTGKLELSAVPSSYYSGQLDPDRVLQDSSVPEDSIS

SEQ ID NO: 1688 - protein, 335 aa, Sorghum bicolor
MSASASSPPAGEENKQEAAPVRHCKGVNDLDKVVLREVRGSSAEVYLYGGHVTSWKDEHGDELLFVSNKAIFKPPKAIRGGIPICFPQFSNFGNLEQHGFARNRTWCVDDDPPPFPVPTSNTAFVDLILKPTEEDLKIWPHSFEYRLRVALSPGGDLMLTSRIRNTNADGKSFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 1689 - protein, 335 aa, Saccharum officinarum
MSASASSPPAGEENRQEAAPVRHCKGVNDLDKVVLREVRGSSAEVYLYGGHVTSWKDEHGDELLFVSNKAIFKPPKAIRGGIPICFPQFSNFGNLEQHGFARNRTWCVDNDPPPFPVPTSNTAYVDLILKPTEEDLKIWPHSFEYRLRVALSPGGDLMLTSRIRNTNADGKSFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 1690 - protein, 333 aa, Panicum virgatum
MSASASTPAGEEKQELAPVVQCKGVNDLDKVVLREVRGSSAEVYLYGGHVTSWKDDHGDELLFVSNKAIFKPPKAIRGGIPICFPQFSNFGNLEQHGFARNRVWTIDTDPPPFPVPTTNTAYIDLILKPTEEDLKIWPHSFEYRLRVALSPGGDLMLTSRIRNTNADGKSFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSSVPEDSIS

SEQ ID NO: 1691 - protein, 334 aa, Triticum aestivum
  misc_feature (93)..(93): Xaa can be any naturally occurring amino acid
MSSSGAGEEGAAAPQGPLPVEHRKGANGLDKVVLREARRISAEVYLYGGHVTSWKDEHGEELLFVSNKAIFKPPKAIRGGIPICFPQFSNFGXLEAHGFARNKIWSVDTDPPPFPVPISSRAYIDLILKPTDEDLKIWPHSFEYRLRVALGPGGDLMLTSRIRNTNADGKPFSFTFAYHTYFSISDISEIRVEGLETLDYLDNLQDRARFTEQGDAIVFESELDRIYLGTPSKIAIIDHEKKRTFVVRKGGLPDAVVWNPWDKKAKAMADFGDDEYKRMVCVEAAAIEKAITLKPGEEWTGKLELSAVPSSYYSGQLDPDRVIQDSVVPEDSVS

SEQ ID NO: 1692 - protein, 582 aa, Oryza sativa
MRAKVELAVLLLVLVGVAAGTRPPSAPPPVTEDTLQKVAGSLEMYVDELPQMPKIYGFSMRHGHPSPIRLTIGMYQKKWKFHRDLPASTVFVFGTSAATATFPGPTIEAAQGVPLSVTWQNYLPARHILPWDPTVPTAIPRRGGVPTVVHLHGGAHPPQSDGSAFAWFTAGFGETGPAWSTPTYTYPNAQSPGVLWYHDHALGLTRANLLAGLLGAYVIRNPAVEAPLGLPCGDEFDRVLMLADRSFYADGSIYMNYTGIIPNIHPQWQPEYFGEAITVNGKAWPFLAVARRRYRFRIINTSNARYFNLSLTNGLPFTVVGSDTNYLSKPVTAASLLVSVAETFDVVVDFSQSTSSEAELVNTAPYPYPDGQAPNDLNGKVMKFVISPAKAKDTSRVPAKLLDYVAVAEEEAVQRRYIVMYEYEDAATGNPTHLYINGKRLEDPATETPRPGTTEVWEVINLTPDNHPLHLHLATFQATRVRGLVDEDAFKGCMAKLNDAVRCNVSRHAVGEEVAVPEHEKGWKNVVKIAPGYMTTIVVKFFMVDSGKPYPFDATAEPGYVYHCHILDHEDNAMIRPLKLIK

SEQ ID NO: 1693 - protein, 260 aa, Hordeum vulgare
  misc_feature (19)..(19): Xaa can be any naturally occurring amino acid
  misc_feature (22)..(22): Xaa can be any naturally occurring amino acid
  misc_feature (40)..(42): Xaa can be any naturally occurring amino acid
  misc_feature (56)..(56): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (73)..(73): Xaa can be any naturally occurring amino acid
  misc_feature (78)..(78): Xaa can be any naturally occurring amino acid
  misc_feature (83)..(83): Xaa can be any naturally occurring amino acid
  misc_feature (177)..(177): Xaa can be any naturally occurring amino acid
  misc_feature (204)..(204): Xaa can be any naturally occurring amino acid
  misc_feature (206)..(206): Xaa can be any naturally occurring amino acid
  misc_feature (209)..(209): Xaa can be any naturally occurring amino acid
  misc_feature (218)..(218): Xaa can be any naturally occurring amino acid
PSHARPRAPRTQQWPPSPXPSXPPRRSPRSRACPARRRAXXXPAPRPAATTTTAPXPLAXAXIKTXSAALALXSVLLXSAATXPPPAAADIAGLTPCKESKAFAKREKQSVKKLNSSLKKYAPDSAPALAIQATIDKTKRRFENYGKFGLLCGSDGLPHLIVSGDQRHWGEFITPGXLFLYIAGWIGWVGRSYLIAVSGEKKPXMXEIXIDVELAARXIPRGFIWPVAGYRELITGKLVVGRRPHSVTKKLPCVPACLVG

SEQ ID NO: 1694 - protein, 278 aa, Hordeum vulgare
PLAPRPLSPPLTNPHKLIIAHHPPTITNQNPSTRPPARATDAAMAALAASIATSTAFAAKPRLSRPPARLSVSCSASSGDNNNSTATPSLSASIKTFSAALALSSVLLSSAATSPPPAAADIAGLTPCKESKAFAKREKQSVKKLNSSLKKYAPDSAPALAIQATIDKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1695 - protein, 235 aa, Brachypodium distachyon
MAALAASIATSTAFASKPRLSSPTPRARLSVSCSATGDNNNNNPSLATAAKTFSAALALSSVLLSSAATFSPPPAAADIAGLTPCKDSKAFAKREKQSVKKLTSSLKKYAPDSAPALAIQATIEKTQRRFENYGKFGLLCGSDGLPHLIVSGDQRHWGEFVTPGVLFLYIAGWIGWVGRSYLIAVSGEKKPAMREIIIDVELAARIIPRGFIWPVAAYRELINGDLVVDDADIGY

SEQ ID NO: 1696 - protein, 251 aa, Festuca arundinacea
  misc_feature (12)..(12): Xaa can be any naturally occurring amino acid
  misc_feature (15)..(15): Xaa can be any naturally occurring amino acid
  misc_feature (60)..(60): Xaa can be any naturally occurring amino acid
GTRLSVHTPSAXATXAAAAAMAGLTASIATSTAFAAKPRLPRSPARLTVSCSASSNDNTXPSLSASVKTFSAALALSSVLLSSAATSPPPAAADIAGLTPCKESKAFAKREKQSVKKLTSSLKKYAPDSAPALAIQATIEKTKRRFDNYGKFGLLCGSDGLPHLIVSGDQRHWGEFITPGVLFLYIAGWIGWVGRSYLIAISGEKKPAMREIIIDVELASRIIPRGFIWPVAAYREWINGDLVVDDADIGY

SEQ ID NO: 1697 - protein, 231 aa, Leymus cinereus x Leymus triticoides
MAALTASIATTTAFAAKPRLSRPPARLSVSCSASGDNTTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1698 - protein, 232 aa, Zea mays
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 1699 - protein, 225 aa, Zea mays
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 1700 - protein, 232 aa, Pseudoroegneria spicata
MAALTASIATSTAFAAKPRLARPPARLSVSCSASGDNNTTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1701 - protein, 236 aa, Oryza sativa
MAALAAASTAFAAKPRLARAPSSPAARFSVSCSASGNNGGAGEMAQSLAASAKTFSAALALSSVLLSSAATSPPPAAADIAGLTPCKESKAFAKREKQSIKKLQSSLKKYAPDSAPALAINATIEKTKRRFENYGKFGLLCGADGLPHLIVSGDQRHWGEFITPGLLFLYIAGWIGWVGRSYLIAISGEKKPAMREIIIDVELAVKLLPRGFIWPVAAYRELITGNLVVDDADIGY

SEQ ID NO: 1702 - protein, 211 aa, Secale cereale
  misc_feature (7)..(7): Xaa can be any naturally occurring amino acid
  misc_feature (127)..(127): Xaa can be any naturally occurring amino acid
ALARPPXASPSPVRVRDNTTPSISTSIKTFSAALALSSVLLSSAATSPPPAAADIAGLTPCKESKAFAKREKQSVKKLTSSLKKYAPDSAPALAIQATIDKTKRRFENYGKFGLLCGSDGLPHLIVXGDQRHWGEFITPGVLFLYIAGWIGWVGRSYLIAVSGEKKPAMREIIIDVELASRIIPRGFIWPVAAFRELINGDLVVDDADIGY

SEQ ID NO: 1703 - protein, 229 aa, Sorghum bicolor
MAALAASSTAAFAAKPRLPRARLSVACSATGDGNANSVSLASSVKTFSAALALSSVLLSSAATSPPPAAADIAGLTPCKESKAFAKREKNSIKKLTASLKKYAPDSAPALAINATIEKTKKRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 1704 - protein, 233 aa, Panicum virgatum
MAALAASSTAAFAAKPRLPRARLSVACSATGGGDSSSSGSGVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 1705 - protein, 248 aa, Triticum aestivum
NPSTRPPARAKDTPDAAMAALAASMATSTAFAAKPRLVRPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1706 - protein, 255 aa, Triticum aestivum
DHESNPSTRPPARARAKDTPDAAAMAALTASIATSTAFAAKPRLARPPARLSVSCSASSGDNTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1707 - protein, 247 aa, Triticum aestivum
TSNPSTRSPARATDAAMAALTASIATSSAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 1708 - protein, 259 aa, Triticum aestivum
TLQRSRIKPLHTPARPRARQGHAGRRSNGRPHRLHRHLHGLRRQAAPGPSAGAPLRLLLRVQRRQHHPLPLRLHQDLLGGPGALLRPPLLRRQLPAAGCRRHWGPDPVQGVTRRTASGRSTRVKKLSSSLRKYAPDSAPALAIQATIENTKRRFENYGKFGLLCGSDGLPQLIVSGYQRHWGEFITPGVIFLYIAGWIAWVWRNYLIVVSGWNKPVMREIIIDVELAARIIPRSFIWPVCAYRKLIHGKLVGHHAEIGY

SEQ ID NO: 1709 - protein, 157 aa, Triticum aestivum
ASRKFSNDHESNPSTRPAARARAKDTPEAAAMAVLTDSIATSTAFAAKPSLARPPARLSVSCSASSGDNTTPSLSASMKTFSEALALSSVLLSSADTSPAAADADIEGLTPCKESKAYVKRDQAFGEESQLVSQEVRARVGPRARHPGHHREDQAPV

SEQ ID NO: 1710 - protein, 205 aa, Leymus cinereus x Leymus triticoides
  misc_feature (182)..(182): Xaa can be any naturally occurring amino acid
  misc_feature (191)..(191): Xaa can be any naturally occurring amino acid
MTSVWKTKVLPGLNKIFDKDGKKAAAVEFLKSFNKEEIDKEIEDKKTELEPKVVETIEASPPEIKGLIKDKKTSKIKKNSVAVTKFLDDLAKIDFPGAKLVSDAVAKSGTTPLSPAIVFILDKVAPFVPAPKEEPKAEPEAAAAAPAEETTTREVAVEEEKKEEAEPSAAPAEAAAPAAEVXEEKKEEEKXAEAAAPAAAEPEKK

SEQ ID NO: 1711 - protein, 159 aa, Brassica oleracea
  misc_feature (19)..(19): Xaa can be any naturally occurring amino acid
  misc_feature (24)..(24): Xaa can be any naturally occurring amino acid
MATGKSYYARPSYRFLGTXQSYYXANDSGFEFDESDLYSSDSPDFRRKISKPVRSVKKSSNRPSTCGASSAAAASSLPVNVPDWSKILREEHRDNRRRSIVDDDGDWLDASGGRLPPHEFLAKTRMASFSVHEGLGRTLKGRDLSRVRNAIFEKIGFQD

SEQ ID NO: 1712 - protein, 159 aa, Brassica napus
MATGKSYYARPSYRFLGTDQSYYAANDSGFEFDESDLYSSDSPDFRRKISKPVRSVKKSSNRPSTCGASSAAAASSLPVNVPDWSKILREEHRDNRRRSIVDDDGDWLDASGGRLPPHEFLAKTRMASFSVHEGLGRTLKGRDLSRVRNAIFEKIGFQD

SEQ ID NO: 1713 - protein, 371 aa, Phaseolus coccineus
MADGLEHPSVVQKLAGQSYLVSRLSPNFHSRNYSATGSCFNGGLHSSGLAALSSVSPITAHAPAEKGPGAFMVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERQFNGMIDVYRKTIKSDGIAGLYRGFNISCVGIIVYRGLYFGMYDSLKPVVLVGGMQDSFFASFLLGWGITIGAGLASYPIDTVRRRMMMTSGEAVKYNSSLHAFQTIVAKEGTKSLFKGAGANILRAVAGAGVLAGYDKLQLVLFGKKYGSGGG

SEQ ID NO: 1714 - protein, 380 aa, Theobroma cacao
MADGSQRPSVFQKIHGQSYFISRLSPNLHAKNYNVTGAYANGGIHVALQPSCQDTGFAHVSPVSPIFVQAPAEKGFSGFMVDFLMGGVSAAVSKTAAAPIERVKLLIQNQDEMIKAGRLSEPYKGITDCFARTIKDEGVLALWRGNTANVIRYFPTQALNFAFKDYFKRMFNFKKDRDGYWKWFAGNLASGGAAGASSLLFVYSLDYARTRLANDAKAAKKGGERQFNGLVDVYKKTIKSDGLAGLYRGFNISCVGIIVYRGLYFGMYDSLKPVVLVGGLQDSFLASFLLGWGITIGAGLASYPIDTVRRRMMMTSGEAVKYKSSLDAFSQIIKNEGTKSLFKGAGANILRAVAGAGVLAGYDKLQVIVLGKKYGSGGGG

SEQ ID NO: 1715 - protein, 379 aa, Manihot esculenta
MADGSWHPSVHQKISGQSSLISKLSPSLHTQNYALTGAYRNGLQNHLHPALQGTGLALLSSPSPVFIQAPSEKGASGFLIDFLMGGVSAAVSKTAAAPIERVKLLIQNQDEMIKAGRLSEPYKGISDCFARTIKDEGVLALWRGNTANVIRYFPTQALNFAFKDYFKRLFNFKKDRDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFLASFLLGWGITIGAGLASYPIDTVRRRMMMTSGEAVKYKSSLDAYSQIIQKEGAKSLFKGAGANILRAVAGAGVLAGYDKLQLIVFGKKYGSGGGG

SEQ ID NO: 1716 - protein, 379 aa, Ricinus communis
MADGSWNPSVFQKINGQSSLISRISPNTHTANYSMTGLYGNGLQNHLHPALRGTSLAVASPLSPVFVQAPSEKGVSGFLIDFLMGGVSAAVSKTAAAPIERVKLLIQNQDEMIKAGRLSEPYKGITDCFGRTMKDEGVLSLWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGIAGLYRGFNISCVGIIVYRGLYFGMYDSLKPVVLVGDLQDSFLASFLLGWGITIGAGLASYPIDTVRRRMMMTSGEAVKYKSSLDAFSQIMKNEGAKSLFKGAGANILRAVAGAGVLAGYDKLQLIVFGKKYGSGGGG

SEQ ID NO: 1717 - protein, 367 aa, Vigna unguiculata
MADGLHSRHPSVVQKLSGQSYFMSRLAPNHSRNYSTSGSYFNGGVQSLGLVPVTAHAPAEKGVSGFLVDFLMGGVSAAVSKTAAAPIERVKLLIQNQDEMIKSGRLSEPYKGIGDCFSRTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLEAFKIIIAKEGTKSLFKGAGANILRAVAGAGVLAGYDKLQLIVFGKKYGSGGGG

SEQ ID NO: 1718 - protein, 371 aa, Vigna unguiculata
MADGLEHPSVVQKLAGQSYLVSRLSPNFHSRNYSATGINLNGGLHTSGLAALSSVSPITAHAPAEKGPGAFMVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDSKAAKKGGERQFNGLIDVYRKTIKSDGIAGLYRGFNISCVGIIVYRGLYFGMYDSLKPVVLVGGLQDSFFASFLLGWGITIGAGLASYPIDTVRRRMMMTSGEAVKYKSSLHAFQTIVAKEGTKSLFKGAGANILRAVAGAGVLAGYDKLQLIMFGKKYGSGGG

SEQ ID NO: 1719 - protein, 380 aa, Zea mays
MADELRSTSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVVVFGKKYGSGGG

SEQ ID NO: 1720 - protein, 387 aa, Elaeis guineensis
MADELRPPSIVQKINGQSYLFSRLSPYSQARSFNIHNLPGTYINGGLKSPLLKLYHSNNGSLGFSSLSHPSPISACAPQEKGISGFLIDFLMGGVSAAVSKTAAAPIERVKLLIQNQDEMIKAGRLSEPYKGIGDCFGRTIKNEGMLSLWRGNTANVIRYFPTQALNFAFKDYFKRMFNFKKDKDGYWKWFAGNLASGGAAGASSLVFVYSLDYARTRLANDAKAAKKGGERQFNGLIDVYRKTIKTDGVAGLYRGFNISCVGIIVYRGLYFGMYDSLKPVVLVGALQDNFLASFLLGWGITIGAGLASYPIDTVRRRMMMTSGEAVKYRSSLDAFSQILKNEGAKSLFKGAGANILRAVAGAGVLAGYDKLQVLVFGKKYGSGGGG

SEQ ID NO: 1721 - protein, 379 aa, Carica papaya
MADGLQHPSLLGKIHGQSYFISRLSPNLQTCNYSLGSAYLNGGLQNSLQPTQHGIGLPLVSPVSPIFVQAPSEKGVSGFLVDFLMGGVSAAVSKTAAAPIERVKLLIQNQDEMIKAGRLSEPYKGITDCFARTIKDEGVLSLWRGNTANVIRYFPTQALNFAFKDYFKRLFNFKKDRDGYWKWFAGNLASGGAAGASSLLFVYSLDYARTRLANDAKAAKKGGERQFNGLVDVYRKTIKSDGLVGLYRGFNISCVGIIVYRGLYFGMYDSLKPVVLVGNLQDSFLASFLLGWGITIGAGLASYPIDTVRRRMMMTSGEAVKYKSSVDAFQQIIKKEGTKSLFKGAGANILRAVAGAGVLAGYDKLQVIVLGKKYGSGGG

SEQ ID NO: 1722 - protein, 386 aa, Ananas comosus
MAEELRPPSVVQKIHGQSTLFTKLSPCSVAHTNPGIHRATYLNGSLQGPVLRSCHGINGPIGLSSISTLSPVFANAPSEKGPYGFLIDFLMGGVSAAVSKTAAAPIERVKLLIQNQDEMIKSGRLSEPYKGIGDCFARTMKDEGILALWRGNTANVIRYFPTQALNFAFKDYFKSLFNFKKDRDGYWKWFAGNLASGGAAGASSLLFVYSLDYARTRLANDAKAAKKGGERQFNGLIDVYKKTLKSDGLAGLYRGFNISCVGIIVYRGLYFGMYDSLKPVVLVGPLQDNFFASFLLGWGITIGAGLASYPIDTVRRRMMMTSGEAVKYRSSLDAFQQIIKNEGAKSLFKGAGANILRAVAGAGVLAGYDKLQVIVFGKKYGSGGGG

SEQ ID NO: 1723 - protein, 380 aa, Sorghum bicolor
MADELRSTSVVQKVHGQSVLLSRISSYSAMNNPVFNNAYSAYNVPQRSYYGMNATVGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 1724 - protein, 371 aa, Glycine max
MADGPQHPSVVQKLAGQSYLVSRLSPNFNSRNYSATGSYVNGGMHSPGLAVVSPVSPVTVHAPAEKGVSGFLVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLILFGKKYGSGGG

SEQ ID NO: 1725 - protein, 367 aa, Glycine max
MADGLHSRHPSVVQKLSGQSYLLSRLAPTHSRNYSTTGSYFNGGLQSSGLVPVMAHAPAEKGVSGFLLDFMMGGVSAAVSKTAAAPIERVKLLIQNQDEMIKSGRLSEPYKGIGDCFSRTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGIAGLYRGFNISCVGIIVYRGLYFGMYDSLKPVVLVGGLQDSFFASFLLGWGITIGAGLASYPIDTVRRRMMMTSGEAVKYKSSLEAFKIIVAKEGTKSLFKGAGANILRAVAGAGVLAGYDKLQLILFGKKYGSGGGG

SEQ ID NO: 1726 - protein, 372 aa, Glycine max
MADGPQHPSVVQKLAGQSYLVSRLSPNFNSGNYSSTGSYFNGGLHSSGLAVVSPGSPVTVHAPAEKGVSGFLVDFLMGGVSAAVSKTAAAPIERVKLLIQNQDEMIKSGRLSEPYKGIGDCFARTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLVDVYRKTIKSDGVAGLYRGFNISCVGIIVYRGLYFGMYDSLKPVVLVGGLQDSFFASFLLGWGITIGAGLASYPIDTVRRRMMMTSGEAVKYKSSLHAFQTIVANEGAKSLFKGAGANILRAVAGAGVLAGYDKLQLVLFGKKYGSGGGG

SEQ ID NO: 1727 - protein, 380 aa, Saccharum officinarum
MADELRSTSVVQKVHGQSVLLSRISSYSAMNNPVFNNAYSAYNAPRRSYHGMNATVGLSSVMAPSPVFASAPKEKGFSGFMIDFMMGGVSAAVSKTAAAPIERVKLLIQNQDEMLKTGRLSEPYKGIGDCFARTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 1728 - protein, 380 aa, Panicum virgatum
MADELRSMSVVQKVHGQSVLLSRISSCSAMNNPVFNNAYSAYNMPRRSYQGMNATVGLPSVMAPSPFFASAPKEKGFSGFMIDFLMGGVSAAVSKTAAAPIERVKLLIQNQDEMIKSGRLSEPYKGIGDCFARTMKDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYKKTLASDGIRGLYRGFNISCVGIIVYRGLYFGMYDSLKPVLLVGSLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 1729 - protein, 380 aa, Panicum virgatum
MVDELRSTSVVQKVHGQSVLLSRISSCSAMNNPVFNNAYSAYNVPRRSYHRMNATVGLSSVMAPSPFFASAPKEKGFSGFMIDFLMGGVSAAVSKTAAAPIERVKLLIQNQDEMLKSGRLSEPYKGIGECFTRTIKDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYKKTLASDGIRGLYRGFNISCVGIIVYRGLYFGMYDSLKPVLLVGSLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 1730 - protein, 374 aa, Panicum virgatum
MEHELRSPSGIQRVHGQPVLLSRISSYSAMNNPVFNNVPLWSHHGMNATVGLPSVMMPSPVFASAPKEKGFSGFMVDFLMGGVSAAVSKTAAAPIERVKLLIQNQDEMIKSGRLSEPYKGIGDCFARTMKDEGVISLWRGNTANVIRYFPTQALNFAFKDHFKRMFNFKKDKDGYWKWFAGNLASGGAAGACSLFFVYSLDYARTRLANDAKAAKKGGGRQFNGLVDVYKKTLASDGIRGLYRGFNISCVGIIVYRGLYFGMYDSLKPVLLVGTLQDNFFASFLLGWGITIGAGLASYPIDTVRRRMMMTSGEAVKYNSSLDAFKQIVAKEGTKSLFKGAGANILRAVAGAGVLAGYDKLQVIVFGKKYGSGGA

SEQ ID NO: 1731 - protein, 540 aa, Zea mays
MAPEKPRKEQEEELMLEDGGIEESPRRSFEDCGDSEEDRGEGDDEEERDSDRDGVGSTRSFLPQKWPQSYRETTDTYTIAASPSFGYLGSSTSKYSLLDLGRSILGSDLKSPLISAKADSVRNLPKTLGSMRDGRVSFQLQHTGEIYISQGCNVTQTVFNGINVLAGVGLLSTPFTIHEAGWTGLAVLACFAIVCCYTGILLKHCFESKDGISSYPDIGEAAFGRIGRVLISIILYTELYSYCVEFIILEGDNLTSIFPKAGFDWLGIHVDGKHFFGVLTAILVLPTVWLRDLRVLSYLSAGGVIATLLVFLSVGLVGVTDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGTYSSVKKIVENY

SEQ ID NO: 1732 - protein, 543 aa, Zea mays
MAPEKPRKEQEEEEDELMLEDGGIEESPRRSFEDCGDSDEEDDDNDEERDGDGVGSPRSFQSHKWPQSYRETTDTYTIAASPSFGYLGPSTSKYSLLDLGRSGLGSDLKLPLLSDKADGKQDSVKTLPKTLGSIRDERVSFQLQHTGELYITQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTTIFPKAGIDWFGIHVDGKHFFGVLTAILVLPTVWLRDLRVLSYLSAGGVIATLLVFLSVGLVGATDGIGFHSTGKVVNWSGMPFAIGIYGFCYSGHSVFPNIYQSMSDRSKFPKALFICFAICTAMYGSFAVIGFLMFGENTLSQITLNLPKHSIASKVALWTTVINPFTKYALLLNPLARSLEELRPEGFLNETSCSIILRTALVASTVCIAFLLPFFGLVMALIGSLLSILVAVIMPALCFLKIAQNKATCPQVIASVGIVILGVVSAALGTYSSVKKIAENY

SEQ ID NO: 1733 - protein, 548 aa, Oryza sativa
MAAAAAAAEAKHRKEEEEDEEEMTLEDGDIEESPRRSFDDDYEDGGSGDDDRDDDGEGLGSPRSFQSRQWPQSYRETTDTYTIAASPSFGYLGPSTSKYSILDGGRSSLGSDLKLPLLSDKLDGKQDSVKSLRKTLGSAIDRKSSLLTQHTGEVYIAQGCSVTQTVFNGVNVLAGVGLLSTPFTIHEAGWVGLAVLAMFAIVCCYTGVLMKHCFESKDGISTYPDIGEAAFGRIGRLLISIILYTELYSYCVEFIILEGDNMTSIFSHIGFDWLGVHIDGKHFFGVLTALIVLPTVWLRDLRVLSYLSAGGVIATLLVFLSVVLVGATDGVGFHLTGKAVNLGGIPFAIGIYGFCYSGHSVFPNIYQSMSDRTKFTKALFICFAICTAIYGSFAIIGYLMFGDKTLSQITLNLPKHSFASKVALWTTVINPFTKYALLLNPLARSLEELRPEGFLNETICSIILRTALVASTVCIAFLMPFFGLVMALIGSLLSILVAVIMPALCFLKIRQNKATTAQVVASIGIIILGTISAALGTYSSVLRIVENY

SEQ ID NO: 1734 - protein, 551 aa, Sorghum bicolor
MAPEKPRKEQEQEKEEEEMLLEDGGIEESPRRSFEDCGDSEEDRGEDDDDDDEERHRDGDGVGSPRSFQSQKWPQSYRETTDTYTIAASPSFGYLGPSTSKYSLLDLGRSGLGSDLKLPLVSDKADGKQDSVKNLPKTLSSIRDERVSFQLQHTGEIYISQGCSVTQTVFNGINVLAGVGLLSTPFTIHEAGWTGLAVLACFAIVCCYTGILLKHCFESKDGISSYPDIGEAAFGRIGRLLISIILYTELYTYCVEFIILEGDNLTSIFPKAGFDWLGIHVDGKHFFGVITAILVLPTVWLRDLRVLSYLSAGGVFATLLVFLSVGLVGATDGIGFHSTGKVVNWSGMPFAIGIYGFCYSGHSVFPNIYQSMSDRSKFPKALFICFAICTAMYGSFAVIGFLMFGENTLSQITLNLPKHSVASKVALWTTVINPFTKYALLLNPLARSLEELRPEGFLNETSCSIILRTALVASTVCIAFLLPFFGLVMALIGSLLSILVAVIMPALCFLKIAQNKATCSQVIASIGIIILGVISAALGTYSSVKRIAENY

SEQ ID NO: 1735 - protein, 326 aa, Sorghum bicolor
MGMEEYKPCAAMVVTQCIYAALALWSKAAFTGGMSPLVFVVYRQAVATIVLVPVAVAANRRKMKEMMGRLGMTGFSLVFVASLVGATVNQCLYYQGVNLGSSSMATAMTNLIPAITFVMAASVGKCEICCYCRLMSPSISDSLNQRQAREGGGEEASEPRQDLRHGRLRERRHGHGLLQGPEAAAGRPARRSPPPPPLAGGGRRQQQVGGGRALPGGQQLLLVALAHPAGAHLQVVRGPAGAVGVDVPPLHAPVRAARRLPPAGPCRLADPLALRPLLLPLLGGVGVRRHVLPAVVEHLGERPALLRHVQPALHRDHHRLRRRRPP

SEQ ID NO: 1736 - protein, 238 aa, Saccharum officinarum
MEEYKPCAAMVVTQCIYAALALWSKAVFTGGMSPLVFVVYRQAVATIVLVPVVIAANRRKMKEMMGRLGITGFSLVFVASLVGATVNQCLYYQGVNLGSSSMATAMTNLIPAITFVMAASVGLERVDVRRPRSLAKIFGTAVCVSGAMAMAFFKGPKLLLCDLHALLLLHSPAAAGGRWVTGALFLVGSSSCWSLWLILQVPICKSYVDPLALSAWMCLLSTLQSALLVAFLLPDPTA

SEQ ID NO: 1737 - protein, 366 aa, Panicum virgatum
MEEYKPAAAMVVTQCIYAALALWSKAAFTGGMSPLVFVVYRQAVATIVLVPVVVAANRKKMKEMTTGLGVVGFVLVFVASLVGATANQCLYYQGVHLGSSSMATAMTNLIPAITFVMAASVGLEKVEVRRPRSLAKIFGTAVCVGGAMAMAFFKGPKLLGGLLALLHSPAPGSRWVTGALFLVGSSSCWSLWLILQVPICKSYVEPLALSAWMCLLSTLQSALLVSFLQPDPNAWRIRSLFELSCCLFSGVFGSGVTFYLQSWCISVRGPLYSAMFNPLCTVVTTVFAATVLREELHVGSLLGAIAVIAGLYVVLWGKAGDGGRRGRETEHTDDLEKTMTRSDSMLDAGNGIAEPLLPADGDLTEK

SEQ ID NO: 1738 - protein, 359 aa, Panicum virgatum
MVVTQCIYAALALWSKAAFTGGMSPLVFVVYRQAVATAVLVPVVVAANRKKMKEMTTGLGVVGLALVFVASLVGATMNQCFYYQGVHLGSSSMATAMANLIPAITFVMAASVGIEKVEVRRPRSLAKIFGTAVCVGGAMSMAFFKGPKLLHGGLHALLHWPPSSGSRWVTGALFLVGSSSCWSLWLILQVPICKSYVEPLALSAWMCLLSTLQSALLVSFLQPDPGAWRIRSLFELACCLFSGVFGSGVTFYLQSWCISVRGPLYSAMFNPLCTVITTVFAAIVLREELHVGSLLGAIAVIAGLYVVLWGKAGDGGKRGREPEHADDLEKTMTRSDSMLDAGNGIAEPLLPAEGDLTDT

SEQ ID NO: 1739 - protein, 281 aa, Sorghum bicolor
MVGVLSNRVDRDDLKAGDHIYTWRAAYIYAHHGIYAGHGMVIHFTRAAGHEIGTGTFLDWFLYSSSPAATEGPPCQKCGHLVKSDGVITSCLDCFLDGGSLYLFDYAVSPAFFLAKARGGTCTLAASDPSDVVIHRARYLLDNGFGMYSLFKNNCEDFAIYCKTGLLVETAFSVGRSGQLASLTAAFSAVASSPLRFLTTSAGGLAIVTSGMYCVGRYVSDIGVRRDVVKVPVERLVEQNVTSIPQSRATETDITSGAPQQQMEVPCVVAEEASIIPPTAP

SEQ ID NO: 1740 - protein, 281 aa, Saccharum officinarum
MVGVLSNRVDRDDLKAGDHIYTWRAAYIYAHHGIYAGDGMVIHFTRAAGHEIGTGTFLDWFLYSSSPAATEGPPCQKCGHLVKSDGVITSCLDCFLDGGSLYLFDYAVSPAFFLAKARGGTCTLAASDPSDVVIHRARYLLDNGFGMYSLFKNNCEDFAIYCKTGLLVETAFSVGRSGQLTSLTAAFSAVASSPLRFLTTSAGGLAIVTSGMYCVGRYVSDIGVRRDVVKVPVERLVEQNVTSIPQNRATETDIAAGAPQQQLEVPCVVADEASIISPAAP

SEQ ID NO: 1741 - protein, 514 aa, Malus domestica
ITTIVATPVPTFERRQRHCFGTSTPGEFPLAANPSIVLHVLTACNLDPQDLAKLEATCSFFRHPAHFAPDFELSISELAALDMCRKRAIFKPMTAEQRQELKQRCGGSWKLVLRFLLAGEACYRREKSQAIAGPGHSIAVTSKGSVYSFGSNSSGQLGHGTTEEECRPQPIRSLQGIRIIHAAAGAGRTMLISDAGKVYAFGKDSFGETEYGVQGSKLVTTPQLVESLKDIFVVQAAIGNFFTAVLSREGRVYTFSWGNDAKLGHQTEPTDVEPHPLLGALENVPVVQIAAGYCYLLALACQPNGMSVYSVGCGLGGKLGHGLRTDEKFPRLIEQFQVLNLQPMVVAAGAWHAAVVGQDGRVCTWGWGRYGCLGHGNEECESVPKVVEALSQVKAVHVATGDYTTFVVSDDGDVYSFGCGESASLGHSTAADGQGNRHANVLAPELVTSLKQVNERVVQISLTNSIYWNAHTFALTESGKLYAFGAGDKGQLGIELVANQTERGKPELVDIDLR

SEQ ID NO: 1742 - protein, 534 aa, Castanea mollissima
MDATTSGTPTIQYHNITDQPVTTIVATPVPAFQRQQRHCFGDSIPGEFPLSANPSIVLHVLTACNLDPQDLAKLEATCSFFRQQANFAPDFELSLSELAALDMCQKRAIFRRMATEERLDFKQRCGGSWKLVLRFLLAGEACCRREKSQAIAGPGHSIAVTSKGSVYTFGSNSSGQLGHGTTEEEWRPRPIRSLQGIRIIQAAAGAGRTMLISDAGLVYAFGKESFGEAEYGVQGGKLVTTPLLVESLKNIFVVQAAIGNFFTAVLSREGRVYTFSWGDDFKLGHQTDPNDLEPHPLLGALENIPVVQIAAGYCYLLALACQPSGMSVYSVGCGLGGKLGHGSRTDEKYPRLIEQFQLLNLQPMVVAAGAWHAAVVGRDGRVCTWGWGRYGCLGHGNEECESVPKVVESLSNVKAVHVATGDYTTFVVSDDGDVYSFGCGESASLGHSNGADGQGNRHANVLSPELVTSLKQVNERVVQISLTNSIYWNAHTFALTESGKLYAFGAGDKGQLGIELVANQSERGNPERVDIDLS

SEQ ID NO: 1743 - protein, 534 aa, Gossypium hirsutum
  misc_feature (56)..(56): Xaa can be any naturally occurring amino acid
  misc_feature (58)..(60): Xaa can be any naturally occurring amino acid
  misc_feature (399)..(399): Xaa can be any naturally occurring amino acid
MDATTSGTPTVQYHNMPDQPITAIVAAPVSAFLRQVRHCFGDSTPGEFPLAANPSXVXXXLTTCNLDPQDLAKLEATCSFFRQPANFAPDYELSISELAALDMCQRRAIFKPMTDEERQSLKHRCGGSWKLVLRFLLAGEACCRREKSQAIAGPGHSIAVTSSGAVYSFGSNSSGQLGHGNTEEDWRPQQIRSLQGIRIIQAAAGAGRTMLISDAGRVYAFGKDSFGEAEYGVQGTKLVTTPQPVESLKDIFVVQAAIGNFFTAVLSREGRVYTFSWGKDSKLGHKTEPNDVEPQPLLGALENIPVVQIAAGYCYLLCLACQPSGMSVYSVGCGLGGKLGHGSRTDEKYPRLIEQFQLLNLQPMVVAAGAWHAAVVGRDGRVCTWGWGRYGCLGHGNEXCESVPKVVEALRDVKAVHVATGDYTTFVVSDDGDVYSFGCGESASLGHNTAGEGQGNRHANVLSPELVMSLKQVNERVVQISLTNSIYWNAHTFALTESGKLYAFGAGDKGQLGIELANNQTERGNPERVDIDLN

SEQ ID NO: 1744 - protein, 534 aa, Vitis vinifera
MDATRSGTPTVQYHNIPDQPIAAIVTSPLPTFQRQQRHCFGDSSPGEFPLAANPSIVLHVLTACNLEPQDLAKLEATCSFFRQPAHFAPDFELSISELAALDMCLKRAIFRPMTLEEREVLKQRCGGSWKLVLRFLLAGEACCRREKSQAIAGPGHSIAVTVKGAVYSFGSNSSGQLGHGTTDEEWRPRQIRSLEGIRIIQAAAGAGRTMLISDAGQVYAFGKDSFGEAEYGVQGTKLVTTPQLVESLKNIFVVQAAIGNFFTAVLSREGRVYTFSWGNDAKLGHQTEVNDLEPHPLLGALENIPVVQIAAGYCYLLALACQPNGMSVYSVGCGLGGKLGHGTRTDEKHPRLIEQFRILNLQPMVVAAGAWHAAVVGRDGRVCTWGWGRYGCLGHGNEECESVPKVVEALINVKAVHVATGDYTTFVVSDDGDVYSFGCGESSSLGHNNGPDGQGNRHANILSPELVTSLKQIKERMVQISLTNSIYWNAHTFALTETGKLYAFGAGDKGQLGVELVANQTERGNPERVDIDLS

SEQ ID NO: 1745 - protein, 534 aa, Carica papaya
MDATTSGTPSLQYHNIPDQPITAIVPASVPTFQRQTRHCFGDSTPGEFPLAANPSIVLHVLTTCNLDPQDLAKLEATCSFFRQPANFAPDFELSISELAALDMCQKRAIFKPMNEVERQEMKRRCGGSWKLVLRFLLAGESCCRREKSHAIAGPGHSIAVTTSGLVYSFGSNSSGQLGHGTSEEEWRPRLIRSLQGIRIIQAAAGAGRTMLISDSGQVFSFGKDSFGETEYGVQGSKLVTTPQLVESLKNIFVVQAAIGNFFTAVLSREGRVYTFSWGNDGKLGHQTEPTDLEPHPLLGALENVPVVQIAAGYCYLLALACQPSGMSVYSVGCGLGGKLGHGSRTDEKYPRLIEQFQVLNLQPVVVAAGAWHAAVVGRDGRVCTWGWGRYGCLGHGNEECESVPKVVEALNKVKAVHVATGDYTTFVVSDDGDVYSFGCGESASLGHNTVADGQGNRHANVLSPELVTSLKQVNERVVQISLTNSIYWNAHTFALTESGKLYAFGAGDKGQLGIELVNNQSERGNPERVDIDLS

SEQ ID NO: 1746 - protein, 84 aa, Populus trichocarpa
MDATTSGTPTIQYHNINDQPVTVTAIVAVPVSTYQRNQRHCFGDLIPGEFPLATNPSIVLHVLTACNLDPQDLAKLEASNMLLL

SEQ ID NO: 1747 - protein, 82 aa, Populus trichocarpa
MDSTTSGTPTIQYHNITDQPVTAIVAVPVSTYQRNQRHCFGDSIPGEFPLAANPSIVLHVLTTCNLDPQDLAKLEASNMFLL

SEQ ID NO: 1748 - protein, 264 aa, Phaseolus coccineus
GIPASLSSLVLLLAALLLSSQGLANYDKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYQPPYGKPPHPKYPPSTN

SEQ ID NO: 1749 - protein, 214 aa, Phaseolus coccineus
MKNMASLSSLVLLLAALLLSSQGLANYDKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVYKPPVYKPPVEKPPVYKPPVEKPPVYKPPVEKPPVYKPPVEK

SEQ ID NO: 1750 - protein, 238 aa, Trifolium pratense
  misc_feature (208)..(208): Xaa can be any naturally occurring amino acid
NMASSSFLVLFLFALFAIPQGLANYENPPVYTPPIVKPPVYKPPVEKPPVYKPPVEKPPVYKPPVEKPPVYKPPVEKPPVYKPPVYKPPVEKPPVYKPPVEKPPVYKPPVYKPPVYKPPVYKPPVYKPPVEKPPVYKPPVYKPPVEKPPVYKPPVYKPPVYKPPVYKPPVEKPPVYKPPVEKPPVYKPPVEKPPVYKPPVEKPPVYKXPVEKPPVYKPPVEKPPVYKPPVYKPPVYKP

SEQ ID NO: 1751 - protein, 297 aa, Vigna unguiculata
MASLSSLVLLLAVLVLSPQGLANYEKPPVEKPPVYKPPIEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVYTPPHPKYPPSSN

SEQ ID NO: 1752 - protein, 223 aa, Medicago truncatula
NMASSNFLVLLLFALFAIPRGLANYDKPPVYQPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKP

SEQ ID NO: 1753 - protein, 108 aa, Medicago truncatula
MGGEVVRKLVASRLEACKPVACKLEVSQLGVCRPEACTQVASLLVACKLEVCTPVACKLEASLQEVCRPGVSRLGACTQVASQLVAYKLEASQQVACTLVVSLLVACR

SEQ ID NO: 1754 - protein, 281 aa, Medicago truncatula
  misc_feature (264)..(264): Xaa can be any naturally occurring amino acid
MASSNFLVLLLFALFAIPRGLANYDKPPVYQPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVYKPPVYKPPVEKPPVYKPPVYKPPVEKPPVYKPPXYKPPVEKPPVYGPPHHP

SEQ ID NO: 1755 - protein, 307 aa, Medicago truncatula
VLLLFALFAIPRGLANYDKPPVYQPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPIYKPPVEKPPVYKPPVEKPPVYKPPVEKPPVYKPPVEKPPVYKPPVEKPPVYKPPVYKPPVYKPPVEKPPVYKPPVYKPPV

SEQ ID NO: 1756 - protein, 220 aa, Glycine max
MASLSSLVLLLAALILSPQVLANYENPPVYKPPTEKPPVYKPPVEKPPVYKPPVENPPIYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPVYKPPVEKPPIYKPPVEKPPVYKPPYGKPPYPKYPPTDDTHF

SEQ ID NO: 1757 - protein, 230 aa, Brassica rapa
MLVLRAPTGPVSAARFITKPNPRIPSSDPWLGLVPSANTRRRRRVVLTLSNSDSNGSVKSATPSTPPTGDDTVFVGQENVPLEGVIQFDKPKSDASIKKWGRVALLAGGDVLALLIFSAIGRFSHGFPVLSFDTLHTADPFIAGWFLSAYFLGGYAEEGRGMKGQSKAVLAAAKSWALGVPLGVIIRSTSSGHIPSYSFILVTMGKYCCFTYWVESTIIQCASFRVKEER

SEQ ID NO: 1758 - protein, 256 aa, Raphanus sativus
MLVLRAPTGPVSAVRFITKPNPRTPPSSDPWLGLVPSANTRSRRRVVLTLSSSDSNGSVKSAAPSPPPSQQVPDDTVFVGQENVPLEGVIQFDKPKSNASIKKWGRVGLLAGGDVLALLIFSAIGRFSHGFPVFSLDTLHTADPFIAGWFLSAYFLGGYAEEGRGMKGQSKAVLAAAKSWALGVPLGVIIRSTSSGHIPAYSFVLVTMGSTAVLLIGWRALLFSVLPSESKKKDDTYRKGSAFELFELLTSLIRRW

SEQ ID NO: 1759 - protein, 253 aa, Thellungiella halophila
MLILRTPTGPVSAVRFITKPNPRVPSSDPWLGLLPAANTRRRRRVVLTLSNSDSNGSVKSSTPSQIPSTGDDTVFVGQESVPLEGVIQFDKPNSNASIKKWGRVALLAGGDVLALLLFSAIGRFSHGFPVFSIDTLHTADPFIAGWFLSAYFLGGYAEEGRGMKGQSKAVLAAAKSWALGVPLGMIIRSTSSGHIPAYTFILVTMGSTAVLLIGWRSLLFSVLPSESKKKDDTYRKGSAFELFELLTSLIRRW

SEQ ID NO: 1760 - protein, 364 aa, Arabidopsis thaliana
MGCFGCCGGGEDFRRVSETGPKPVHNTGGYNGGHHQRADPPKNLPVIQMQPISVAAIPADELRDITDNYGSKSLIGEGSYGRVFYGILKSGKAAAIKKLDSSKQPDQEFLAQVSMVSRLRQENVVALLGYCVDGPLRVLAYEYAPNGSLHDILHGRKGVKGAQPGPVLSWHQRVKIAVGAARGLEYLHEKANPHVIHRDIKSSNVLLFDDDVAKIADFDLSNQAPDMAARLHSTRVLGTFGYHAPEYAMTGTLSTKSDVYSFGVVLLELLTGRKPVDHTLPRGQQSVVTWATPKLSEDKVKQCVDARLNGEYPPKAVAKLAAVAALCVQYEADFRPNMSIVVKALQPLLNPPRSAPQTPHRNPY

SEQ ID NO: 1761 - protein, 361 aa, Brassica oleracea
MSCFGWCGNDDGFRNGDDTRPMPSHIPAGDSGSHYLRSDPPMNQPVVQMEPIAVPAIPADELSDVTENYGSKALVGEGSYGRVFHGVLKSGITSAIKKLDSSKQPDQEFLSQISMVSRLRHENVIALVGYCVDGPLRVLAYEYAPNGSLHDVLHGRKGVKGALRGPVMTWHQRVKIAVGAARGLEYLHEKVNPQVIHRDIKSSNVLLFDDDVAKIGDFDLSNQAPDMAARLHSTRVLGTFGYHAPEYAMTGTLSTKSDVYSFGVVLLELLTGRKPVDHTLPRGQQSLVTWATPKLSEDKVKLCVDARLLGEYPSKAVAKLAAVAALCVQYEANFRPNMSIVVKALQPLLNPPRSTPHRNPY

SEQ ID NO: 1762 - protein, 246 aa, Brassica rapa
MSCFGCCGDDDFHRVNETGPKTAYNTAGYDGHHQRVEPFKNPPAIQMQPISVPAIPADELKDITDNYGSKSLIGEGSYGRVFYGVLKNGKAAAIKKLDSSKQPDQEFLSQVSMVSRLRQDNVVALLGYCVDGPLRVLAYEYAPKGSLHDILHGKKGMKGAQPGPVLSWHQRVKIAVGAAKGLEYLHEKANPHVSTETSNPAVYFCLKMMLLRLLILICLIKPLTWLHAFTQLVCLEPLVITLQSMQ

SEQ ID NO: 1763 - protein, 350 aa, Brassica rapa
GFRNGDDTRPMPSHIPAGDSGSHYLRSDPPMNQPVVQMEPIAVPAIPADELSDVTDNYGSKALVGEGSYGRVFHGVLKSGITSAIKKLDSSKQPDQEFLSQISMVSRLRHENVIALVGYCVDGPLRVLAYEYAPNGSLHDVLHGRKGVKGALRGPVMTWHQRVKIAVGAARGLEYLHEKVNPQVIHRDIKSSNVLLFDDDVAKIGDFDLSNQAPDMAARLHSTRVLGTFGYHAPEYAMTGTLSTKSDVYSFGVVLLELLTGRKPVDHTLPRGQQSLVTWATPKLSEDKVKLCVDARLLGEYPSKAVAKLAAVAALCVQYEANFRPNMSIVVKALQPLLNPPRSTPHRNPY

SEQ ID NO: 1764 - protein, 248 aa, Brassica rapa
MSCFGCCGGDDFRRVAETGPKPVYGAGGHGGGHHVRTDPPKNTPVIQMQPISVPAIPADELKDITDNYGSKSLIGEGSYGRVFYGVLRSGKAAAIKKLDSSKQPDQEFLAQVSMVSRLRQDNVVALLGYCVDGPLRVLAYEFAPNGSLHDILHGRKGVKGAQPGPVSVVEPAELKLLLVRLGDSSTCMRRRTLMLFTETSNPAMCFCLTMMLPRLLTSISLTKPLTWLLAFTQLVCWERLVITLQSMQ

SEQ ID NO: 1765 - protein, 364 aa, Brassica napus
  misc_feature (26)..(26): Xaa can be any naturally occurring amino acid
MSCFGCCGGDDFRRVAETGPKPVYGXGGHGGGHHPRADPPKNTPVIQMQPISVPAIPADELKDITDNYGSKSLIGEGSYGRVFYGVLRSGKAAAIKKLDSSKQPDQEFLAQVSMVSRLRQDNVVALLGYCVDGPLRVLAYEFAPNGSLHDILHGRKGVKGAQPGPVLSWNQRVKIAVGAARGLEYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 1766 - protein, 336 aa, Brassica napus
  misc_feature (245)..(245): Xaa can be any naturally occurring amino acid
  misc_feature (254)..(255): Xaa can be any naturally occurring amino acid
  misc_feature (267)..(267): Xaa can be any naturally occurring amino acid
  misc_feature (273)..(276): Xaa can be any naturally occurring amino acid
  misc_feature (279)..(279): Xaa can be any naturally occurring amino acid
  misc_feature (281)..(282): Xaa can be any naturally occurring amino acid
  misc_feature (286)..(286): Xaa can be any naturally occurring amino acid
  misc_feature (288)..(289): Xaa can be any naturally occurring amino acid
MSCFGWCGNDDGFRNGDDTRPMPSHIPAGDSGSHYLRSDPPMNQPVVQMEPIAVPAIPADELSDVTDNYGSKALVGEGSYGRVFHGVLKSGITSAIKKLDSSKQPDQEFLSQISMVSRLRHENVIALVGYCVDGPLRVLAYEYAPNGSLHDVLHGRKGVKGALRGPVMTWHQRVKIAVGAARGLEYLHEKVNPQVIHRDIKSSNVLLFDDDVAKIGDFDLSNQAPDMAARLHSTRVLGTFGYHAXEYAMTGTLXXKSDVYSFGVVLXELLTGXXXXDHXLXXGQQXLXXWATPKLSEDKVKLCVDARLLGEYPSKAVAKLRWLHCACNMRQILDQT

SEQ ID NO: 1767 - protein, 361 aa, Raphanus sativus
MSCFGWCGNDDGFRNADDTRPMPTLIPAGDSGSHYLRSDPPMNQPVLQMEPIAVPAIPADELSDVTDNYGSKALVGEGSYGRVFHGVLKSGVTSAIKKLDSSKQPDQEFLSQISMVSRLRHENVIALVGYCVDGPLRVLAYEYAPNGSLHDVLHGRKGVKGALRGPVMTWQQRVKIAVGAARGLEYLHEKVNPQVIHRDIKSSNVLLFDDDVAKIGDFDLSNQAPDMAARLHSTRVLGTFGYHAPEYAMTGTLSTKSDVYSFGVVLLELLTGRKPVDHTLPRGQQSLVTWATPKLSEDKVKLCVDARLLGEYPSKAVAKLAAVAALCVQYEANFRPNMSIVVKALQPLLNHPRSTPHRNPY

SEQ ID NO: 1768 - protein, 364 aa, Raphanus sativus
  misc_feature (353)..(353): Xaa can be any naturally occurring amino acid
MSCFGCCGGDDFRRVAETGPKPVYGAAGHGGVHHARTDPPKNTPVIQMQPISVPAIPADELKDITDNYGSKSLIGEGSYGRVFYGVLRSGKAAAIKKLDSSKQPDQEFLAQVSMVSRLRQDNVVALLGYCVDGPLRVLAYEFAPNGSLHDILHGRKGVKGAQPGPVLSWNQRVKIAVGAARGLEYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKAFQPLLNPPRXAPQTPHRNNPY

SEQ ID NO: 1769 - protein, 364 aa, Raphanus sativus
MSCFGCFGGGEDFRRVSETGPKPVFNRDGLNGHHQKTDPPKNSPFIQMQPISVPAIPADELKDLTDNYGSKSLIGEGSYGRVFYGVLKNGKAAAIKKLDSSKQPDQEFLAQVSMVSRLRQDNVVALLGYCVDGPLRVLAYEFASNGSLHDILHGRKGVKGAQPGPVLSWNQRVKIAVGAARGLEYLHEKANPHVIHRDIKSSNVLLFEDDVAKIADFDLSNQAPDMAARLHSTRVLGTFGYHAPEYAMTGTLSTKSDVYSFGVVLLELLTGRKPVDHTLPRGQQSLVTWATPKLSEDKVEQCVDARLNGEYPPKAVAKLAAVAALCVQFEADFRPNMSIVVKALQPLLNPPRSAPQTPHRNNPY

SEQ ID NO: 1770 - protein, 364 aa, Thellungiella halophila
MSCFGCCGGEDFRRVAETGPKPVHNAAGYNGGHHQRADPPKYPPVIQMQPIAVPAIPADELKDITDNYGSKSLIGEGSYGRVFYGVLKSGKAAAIKKLDSSKQPDQEFLAQVSMVSRLRQDNVVALLGYCVDGPLRVLAYEYAPNGSLHDILHGRKGVKGAQPGPVLSWHQRVKIAVGAARGLEYLHEKANPHVIHRDIKSIFVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 1771 - protein, 340 aa, Triticum aestivum
MAKVNAGAALLSLCLLLAYSAGQSAAAYVDVEGTVRKEVENAIKGNPGIGAALVRLVFHDCWVNGCDGSVLLDKTPSGGNTEKKAINNIGLDGFNLIDTIKYKLGNSVSCADIVVFAARDAARYLSGGKIAYSVPSGRKDGIVSSDATADAILPQSTFEFQQLKDNFANKGFTQEELVILSGAHSIGVSHLSSFQDRLNDSTATPIDDSYKQALVKDVEDQKKSQNTSDPIEKNNIRDMSLKFQNDSGYDTTGVNTAAKGALDNSYYHANLQNRVLFKSDWVMRTDSKAGDDMAEYMNNATKWNNDFAAAMVKLSKLPAEGSTRYEIRKNCRVTNQNYYY

SEQ ID NO: 1772 - protein, 340 aa, Triticum aestivum
  misc_feature (209)..(209): Xaa can be any naturally occurring amino acid
  misc_feature (257)..(257): Xaa can be any naturally occurring amino acid
  misc_feature (324)..(324): Xaa can be any naturally occurring amino acid
MAKVNAGAALLSLCLLLACSAGGTKAAYVDVEGTVRTEVEKAIKSNPGIGAALVRLVFHDCWVNGCDGSVLLDKTPYGTNTEKKAINNIGLDGFNLIDTIKYKLGDGVSCADIVVFAARDAARYLSNGKIAYSVPSGRKDGINSSAAAADAVLPQSTFEFQQLVDNFDKKKFTPRELVILSGAHSIGVSHLSSFQDRLNKSTATPIDDXYKQALVADVEAQKKSQNTPDPIEKNNIRDMSSSFQTTAGYDPTGVNTXAKGALDNSYYHANLQNRVLFKSDWVMRTDTDAGNAMAEYMDNATKWNNDFAAAMVKLSKLPAESSTXYEIRKNCRVTNQNYYY

SEQ ID NO: 1773 - protein, 253 aa, Musa acuminata
MADEKESTSVPLSQAADPEDPAKAPPTSPSSSTRKACCAVLQSWVSKKFMTGCVVLFPVAITFYITWWFIQFVDGFFSPLYDKLGVDIFGLGFLTSLVFVFLIGIFVSSWLGATVIWVGEWFIKRMPFVRHIYSASKQISTAISPDQNTTAFKEVAIIRHPRVGEYAFGFITSSVVLQTDKGDEELCSVYVPTNHLYIGDIFLVNSEEIIRPNLSVREGIEIIVSGGMTMPQLITPLERIPRKNQSIRLNRIT

SEQ ID NO: 1774 - protein, 260 aa, Hordeum vulgare
  misc_feature (202)..(202): Xaa can be any naturally occurring amino acid
  misc_feature (237)..(237): Xaa can be any naturally occurring amino acid
  misc_feature (248)..(248): Xaa can be any naturally occurring amino acid
  misc_feature (252)..(252): Xaa can be any naturally occurring amino acid
  misc_feature (255)..(255): Xaa can be any naturally occurring amino acid
  misc_feature (257)..(258): Xaa can be any naturally occurring amino acid
MPEEKEYVAVPMGQAPEPADPEDPVKSPPRPTSPATSTRKACFAVLQSWVSRKFMTGCVVIFPMAVTFFITLWFIRFFDGFFSPLYAKLGFDVFGLGFVTSLVFIFIVGIFVSSWVGSTVFWVGEWFIKKMPFVRHIYSASKQVSTAVSPDQNTTAFKEVAIISHPRAGEYAFGFITSSMILQTDKGDEELCSVYVPTNHLXIGDIFLVNSAEIIRPNLSIREGIEIIVSGGMTMPXVITALGPAPDXNQGXRLXRXXTV

SEQ ID NO: 1775 - protein, 259 aa, Hordeum vulgare
MAEEKESTSVPLSQAAEAVDPEDPAKSPPRPSSPTTSTRKACCAVLQSWVSRKFMTGCVVLFPVAFTFFITWWFVQFVDGFFSPLYAKIGVDIFGLGFLTSLAFIFLVGIFVSSWVGSTVFWVGEWFIKKMPFVKHIYSASKQVSTAISPDQNTTAFKEVAIIRHPRVGEYAFGFITSTVVLQTDKGDEELCSVYVPTNHLYIGDIFLLNSEEIIRPNLSIREGIEIIVSGGMTMPQVIASLDPIPRKSQSIRLNRIMT

SEQ ID NO: 1776 - protein, 257 aa, Citrus sinensis
MAEEKESTSIPLSQAENGGEDPEDPVKSPPTSSASSTRQACCYVLQSWISKKFMTGCVVLFPVAVTFFITWWFVQFVDGFFSPLYEHLGFDIFGLGFITSLVFVFLVGVFVSSWLGSTVFWVGEWFIKRMPFVRHLYSASKQISAAISPDQNTTAFKEVAIIRHPRVGEYAFGFITSTVTLQKDNGDEELCSVFVPTNHLYIGDIFLVSSKEIIRPNLSIREGIEIIVSGGMTMPQVISPIERVARQGERIPLNRIM

SEQ ID NO: 1777 - protein, 259 aa, Gossypium hirsutum
MAEEKESTSIPLSQAENVGVDPEDPAKSPPRPSSPNSSTRKACCFVLQSWVSKKFMTGCVVLFPVAVTFFITWWFIQFVDGFFSPLYERLGIDIFGLGFITSLLFVFFVGVFVSSWMGAAVFSVGEWVIKRMPFVRHLYSASKQISAAISPDQNTTAFKEVAIIRHPRVGEYAFGFITSSVVLQRENEDEELCSVFVPTNHLYIGDIFLVNSKEIIRPNLSIREGIEIIVSGGMTMPQVISPQERFARQKERIPLNRMM

SEQ ID NO: 1778 - protein, 259 aa, Festuca arundinacea
MADEKESTSVPLSQAADAVDPEDPAKSPPRPSSPTTSTRKACCAVLQSWVSRKFMTGCVVLFPVAFTFFITWWFVQFVDGFFSPLYAKVGINIFGLGFLTSLAFIFLAGIFVSSWLGSTVFWVGEWFIKKMPFVKHIYSASKQVSTAISPDQNTTAFKEVAIIRHPRVGEYAFGFITSNVVLQTDKGDEELCSVYVPTNHLYIGDIFLLNTDEIIRPNLSIREGIEIIVSGGMTMPQVITSLEPIPKKSQSIRLNRIMT

SEQ ID NO: 1779 - protein, 258 aa, Zea mays
MAEEKESTSIPLSQAAEAVDPEDPAKSPPRPSSPTTSTRKACCAVLQSWVSRKFMTGCVVLFPVAVTFFITWWFIQFVDGFFSPLYAKIGIDIFGLGFLTSMVFIFLVGIFVSSWVGSTIFWVGEWFIKKMPFVRHIYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASLEPMPRKSQNIRLNRMT

SEQ ID NO: 1780 - protein, 263 aa, Zea mays
MPEDKEYAPVPLGQAAAEAAAPDSEDPAKSPPRPSSPGTSTRKAFFAVLQSWVSRKFMTGCVVLLPIAVTFFITWWFIQFVDGFFSPLYAKLGFDIFGLGFLTSLVFILLVGIFVSSWVGSTVFWVGEWFIKKMPFVRHIYSASKQVSTAVSPDQNTTAFKEVAIISHPRVGEYAFGFITSTMVLQTDKGDEELCSVYVPTNHLYIGDIFLVNSAEIIRPNLSIREGIEIIVSGGMTMPQVIMSLEPTPRKSQNVRLDRVRTV

SEQ ID NO: 1781 - protein, 257 aa, Zea mays
MPEEESTSIPLSQAAEAVDPEDPAKSPPRPSSPTTSTRKACCAVLQSWVSRKFMTGCVVLFPVAVTFFITWWFIQFVDGFFSPLYAKLGINIFGLGFLTSLVFIFLVGIFVSSWVGSTIFWVGEWFIKKMPFVRHIYSASKQVSTAISPDQNTTAFKEVAIIRHPRIGEYAFGFITSTVVLQTDKGDEELCSVYVPTNHLYIGDIFLVNSEEVIRPNLSIREGIEIIVSGGMTMPQVIASLEPMPRKSQNIRLNRMT

SEQ ID NO: 1782 - protein, 258 aa, Zea mays
MPEDKEYAPLPLGQAAAPDPEDPVKSPPRPSSPATSTRKACFAVLQSWVSRKFMTGCVVLFPIAVTFFLTWWFIQFVDGFFSPLYAKLGFDMFGLGFFTSLVFILLVGIFVSSWVGSTVFWVGEWFIKKMPFVRHIYSASKQVSTAVSPDQNTTAFKEVAIISHPRVGEYAFGFITSTMVLQTDKGDEELCSVYVPTNHLYIGDIFLVNSTDIIRPNLSIREGIEIIVSGGMTMPQVITSLEPTPRKSHVRLDRVRTV

SEQ ID NO: 1783 - protein, 243 aa, Allium cepa
MAEEKDQSTSIPLSQAADPEDPAKALPLSPSSSTRKACCAVLQSWVSKKFMTGCVVLFPVAVTFFITWWFIQFVDGFFSPIYERLGVNIVGLGFLTSLLFVFLIGIFVSSWLGATVIRLGEWFIKKLPFVKHIYSASKQISTAISPDQNTTAFKEVAIIRHPRIGEYAFGFITSTVVLQNEKGDEELCSVYVPTNHLYIGDIFLVNSEEIIRPNLSIREGIEIIVSGGMTMPQLITPLERIPH

SEQ ID NO: 1784 - protein, 259 aa, Pseudoroegneria spicata; identical to SEQ ID NO: 1775

SEQ ID NO: 1785 - protein, 260 aa, Oryza sativa
MPEEKEYAPVPLGQAPEAVDPEDPVKSPPRPTSPANSTRKACFAVLQSWVSRKFMTGCVVLFPVAVTFFITWWFVKFVDGFFSPLYAKLGFDIFGLGFLTSLLFIFLVGIFVSSWVGSTVFWIGEWFIKKMPFVRHIYSASKQVSTAVSPDQNTTAFKEVAIISHPRIGEYAFGFITSTMILQTDKGDEELCSVYVPTNHLYIGDIFLVRSEEIIRPNLSIREGIEIIVSGGMTMPQVIAAPGQTPHKGQSTRLNRMMSA

SEQ ID NO: 1786 - protein, 258 aa, Sorghum bicolor
MAEEKESTSIPLSQAAEAVDPEDPAKSPPRPSSPTTSTRKACCAVLQSWVSRKFMTGCVVLFPVAVTFFITWWFIQFVDGFFSPLYAKFGVDIFGLGFLTSLVFIFLVGLFVSSWVGSTIFWVGEWFIKKMPFVRHLYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASLEPMPRKSQSIRLNRMT

SEQ ID NO: 1787 - protein, 265 aa, Sorghum bicolor
MPEDKEYAPVPLGQAAAEASAVAPDPEDPVKSPPRPSSPGTSTRKACFAVLQSWVSRKFMTGCVVLFPIAVTFFITWWFIQFVDGFFSPLYAKLGFDIFGLGFLTSLLFILLVGIFVSSWVGSTVFWVGEWFIKKMPFVRHIYSASKQVSTAVSPDQNTTAFKEVAIISHPRVGEYAFGFITSTMVLQTDKGDEELCSVYVPTNHLYIGDIFLVNSAEIIRPNLSIREGIEIIVSGGMTMPQVITSLEPTPRKSQNIRLDRVRTV

SEQ ID NO: 1788 - protein, 258 aa, Saccharum officinarum
MAEEKESTSIPLSQAAEAVDPEDPAKSPPRPSSPTTSTRKACCAVLQSWVSRKFMTGCVVLFPVAVTFFITWWFIQFVDGFFSPLYAKLGVDIFGLGFLTSLVFIFLVGIFVSSWVGSTIFWVGEWFIKKMPFVRHIYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASLEPMPRKSQNIRLNRMT

SEQ ID NO: 1789 - protein, 258 aa, Panicum virgatum
MAEEKESTSIPLSQAAEAVDPEDPAKSPPRPSSPTNSTRKACCAVLQSWVSRKFMTGCVVLFPVAVTFFITWWFIQFVDGFFSPLYAKLGIDIFGLGFLTSLVFIFMVGIFVSSWVGSTIFWVGEWFIKKMPFVRHIYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASMEPMPRISQNIRLNRMT

SEQ ID NO: 1790 - protein, 264 aa, Panicum virgatum
MPEDKEYAPVPLGQAAAEAAAAPDPEDPVKSPPRPSSPATSTRKACFAVLQSWVSRKFMTGCVVLFPIAVTFFITWWFIQFFDGFFSPLYAKLGFDIFGLGFLTSLVFILLVGIFVSSWVGSTVFWIGEWFIKKMPFVRHIYSASKQVSTAVSPDQNTTAFKEVAIISHPRVGEYAFGFITSTMVLQTDKGDEELCSVYVPTNHLYIGDIFLVNSAEIIRPNLSIREGIEIIVSGGMTMPQVITSLDPTPRKNQNIRLDRVMTV

SEQ ID NO: 1791 - protein, 259 aa, Triticum aestivum
MAEEKESTSVPLSQAAEAVDPEDPAKSPPRPSSPTTSTRKACCAVLQSWVSRKFMTGCVVLFPVAFTFFITWWFVQFVDGFFSPLYAKLGVNIFGLGFLTSLAFIFLAGIFVSSWLGSTVFWVGEWFIKKMPFVKHIYSASKQVSTAISPDQNTTAFKEVAIIRHPRVGEYAFGFITSTVVLQTDKGDEELCSVYVPTNHLYIGDIFLLNSEEIIRPNLSIREGIEIIVSGGMTMPQVIASLDPIPRKSQSIRLNRIMT

SEQ ID NO: 1792 - protein, 260 aa, Triticum aestivum
  misc_feature (25)..(25): Xaa can be any naturally occurring amino acid
  misc_feature (45)..(45): Xaa can be any naturally occurring amino acid
MPEEKEYVAVPMGQAPEPADPEDPXKSPPRPTSPATSTRQACFAXLQSWVSRKFMTGCVVIFPMAVTFFITWWFIRFFDGFFSPLYAKLGVDVFGLGFVTSLVFIFIVGIFVSSWVGSTVFWVGEWFIKKMPFVRHIYSASKQVSTAVSPDQNTAAFKEVAIISHPRAGEYAFGFITSSMILQTDKGDEELCSVYVPTNHLYIGDIFLVNSAEIIRPNLSIREGIEIIVSGGMTMPQVITALGPAPDKNEGTRLSRMMTV

SEQ ID NO: 1793 - protein, 259 aa, Triticum aestivum
MAEEKESTSVPLSQAAEAVDPEDPAKSPPRPSSPTTSTRKACCAVLQSWVSRKFMTGCVVLFPVAFTFFITWWFVQFVDGFFSPLYAKLGVNIFGLGFLTSLAFIFLVGIFVSSWVGSTVFWVGEWFIKKMPFVKHIYSASKQVSTAISPDQNTTAFKEVAIIRHPRVGEYAFGFITSTVVLQTDKGDEELCSVYVPTNHLYIGDIFLLNSEEIIRPNLSIREGIEIIVSGGMTMPQVIASLDPIPRKSQSIRLNRIMT

SEQ ID NO: 1794 - protein, 367 aa, Cenchrus ciliaris
  misc_feature (72)..(73): Xaa can be any naturally occurring amino acid
  misc_feature (95)..(95): Xaa can be any naturally occurring amino acid
  misc_feature (97)..(97): Xaa can be any naturally occurring amino acid
  misc_feature (107)..(107): Xaa can be any naturally occurring amino acid
MARCHHLLLLLLSLFLALAAADPGKGHQGEASAVFMDAASHRYLRGQPADDQASMSLNEVSAAVSVLLGFAXXTSLPALSSSQLNKVLLPNPFDXPXAVFLVQIAGXSASADSFVSEAGSIFKTRIEGANNAATGLTDKDELIIIHSDESLDHTGSDLTDSELSSLANWLEGSYQKSTGKLVIPLESGSSLTLLLHKEADLEFVSSLASLLKTIERAIQVHEDFSGVLSPAELLVCHFTGIKALEDEYTSTEIVKQGTEIVRRAVTKAFQSLHGAYKGKIVGLVVSTQEASSFLGSIIEAPSSLHISRRLEEASQTNAIIASVVLVRKSLAWITGIILLVSTLIGVCLLMNMPLTRDTLLYSNVKID

SEQ ID NO: 1795 - protein, 365 aa, Zea mays
MARCRHHLLLLSVLLALAAAAARQAQSHGKASAVFIDASSHRYLRDQQADHQDASMSLNEVSAVVSVLLGFAPSTSLPAISSSKLNKVLLPNPFDRPRAVFLVQIDGFNVPSFVSEGSNIFKTRIEGANIADTGLTDKDDLIVIHSDESLDLSRSDYLDNELSSLANWLEGSYQKSTGKLVIPLENGNSLTLQLDKEADKEFMSSLASLLKTIERAIQVHEDFSGVVNPAELLECHFTGLKALENEYGSGEIVKQGTEIVQRAVTKSFQSLHEAYKGKIVGLVISTNEAPSSLGSIIDAPSSLHISRRLEEASKTTDIASVVLVRKSLAWITGIILLVSTLIGVCLLMNMPLTRDTLLYSNVKID

SEQ ID NO: 1796 - protein, 366 aa, Saccharum officinarum
MARCRHHLLLLPLFLALAAAAPGKAQSHGEASAVFIDAASHRYLRDQQADGQDASMSLNEVSAAVSVLLGFAPSTSLPAISSSKLNKVLLPNPFDRPRAVFLVQIAGSDASAPSFVSEGSNIFKTRIEGADSTDTGLTDTDDLIVIHSDESLDLSRSDYLDNELSSLANWLEGSYQKSSGKLVIPLESGNSLTLLLDKEADMEFVSSLASLLKTIERAIQVHEDFSGVVNRAELLECHFTGIKALENEYGSTEIVKQATEIVQRAVTKSFQSLHEAYKGKIVGLVISTKEASSSLGSIIDAPSSLHISRRLEEASKTKEASVALVRKSLAWITGIILLVSTLIGVCLLMNMPLTRDTLLYSNVKID

SEQ ID NO: 1797 - protein, 365 aa, Panicum virgatum
MARCLILLHLFLALASAASGHGQGHHGEASAVFIDAAPHRYLRDQQADDQGTSMSLNEVSAAVSVLLGFAPPTALPVLSSSQLNKLLIPNPFDRPRAVFLVQIAGSYASADSFVSEASNIFKTRIEGANNNATGLTDKDELIIIRSDESLDHPESGFLASELSSLANWLEGSYQKSSGKLVIPLESGNNLTLVLDKEADLEFVSSLASLLRTIERAIQIHEDFSGVISPAELLVCHFTGIKALENEYASTEIVKQGTEIVRRAITKAFQSLRGAYKGKIVGLVISTEEASSFLGSIIEAPSSLHISRRLEEASQTNATASIVLVRKSLAWITGIILLFSTLIGVCLLMNMPLTRDTLLYSNVKID

SEQ ID NO: 1798 - protein, 278 aa, Zea mays
MTMATKAACVLAVWVLVASGLSDLGSARAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYFKYNVTEMLSSGWIQVSNGKEYALSDVIDTIKHAFGGSPQIVCKRGSIEELRLCFDKELKPRDCLTTSLANGSVSKSKHCPRYITLPTYDPLVLANSTVEIMTQFDEFEVPAALYTA

SEQ ID NO: 1799 - protein, 274 aa, Saccharum officinarum
MTTACVLAVWVLVAAGLADLGSARAPLGSKPQREFDYFALSLQWPGTICASTRHCCATNGCCRSEPLQTFTIHGLWPDYDDGTWPSCCRRTQFDMDKILPLKEVLDKYWPSLYCSKSGTCFSGKGLFWAHEWEKHGTCSAPVVQDELQYFTIALDLYFKYNVTEMLSSGGIQVSNGKEYALSDVIDTIKHAFGGSPQIVCKSGSVQELRLCFDKELKPRDCLTTSLTIGSVSKSKHCPRYITLPTYDPLVLANSTVEVMSQFDEFEVPASLYTA

SEQ ID NO: 1800 - protein, 279 aa, Panicum virgatum
MAMATARTAVCVLVVWALVAAGLGSVSARAPLGRKPQREFDYFALSLQWPGTICASTRHCCTTNGCCRSEPLQWFTIHGLWPDYDDGTWPSCCRRTQFEMNKILPLKDILDKYWPSLYCSSSSTCFSGKGPFWAHEWEKHGTCSAPVVQDELQYFTIALDLYFKYNVTEMLSSGGIQISNGKEYALSDVIDTIKHAFGGSPQIVCKKGSVEELRLCFDKELKPRDCLTTSLTNGSVSKTKHCPQYITLPKYDPLVLANSTGEIMKQFDDFEVSAAIYTA

SEQ ID NO: 1801 - protein, 419 aa, Hordeum vulgare
MASSSFKVTRISEGAVKPASETPDHTLPLAWVDRYPTHRGLVESMHIFRSGADAAPGVIREALGKALAFFYPLAGRIVEQPEKGCPAIRCTADGVYFAEAVAECSLEDVRFLERPLLLPKEDLVPYPAADLWAVEPHNTIMMMQITKFTCGGFVMGLRFNHASADGMGAAQFIKAVGDMARGLPEPTVKPVWDREKFPNPSIKPGPLPELPVLALDYIVLDFPTGYIDGLKTQYKAHSGKFCSGFDVLTAKLWQCRTRALNLEPDATVKLCFFASVRHLLKLDAGYYGNSIFPVKMSGTSKKVLESSVMEVIDMIREAKQRMAVEFFQFAKEETRQDPFQMTFDYESIYVSDWSKLGFSDVDYGFGPPMFAGPLVNNDFIASVVILKAPLPLDGTRMLASCVTKEHSQEFARGMKEDLP

SEQ ID NO: 1802 - protein, 419 aa, Leymus cinereus x Leymus triticoides
MASSSFKVTRISEGAVKPASETPDHTLPLAWVDRYPTHRGLVESMHIFRSGADAAPGVIREALGKALAFFYPLAGRIVEQPEKGCPAIRCTADGVYFAEAVAECSLEDVRFLERPLLLPKEDLVPYPGDDLWGVEPHNTIMMMQITKFTCGGFVMGLRFNHASADGMGAAQFIKAVGDMARGLPEPTVKPVWDREKFPNPSIKPGPLPELPVLALDYIVLDFPTGYIDGLKTQYKAHSGKFCSGFDVLTAKLWQCRTRALNLEPDATVKLCFFASVRHLLKLDAGYYGNSIFPVKMSGTSKKVLESSVMEVIDMIREAKQRMAVEFSQFAKEETQQDPFQMTFNYESIYVSDWSKLGFSEVDYGFGPPMFAGPLVNNDFIASVVILKAPLPLDGTRMLASCVTKEHSEEFARGMKEDLP

SEQ ID NO: 1803 - protein, 417 aa, Zea mays
MAGFKVTRISEGPVKPASATPEETLPLAWVDRYPTHRGLVESMHIFRSGAGEAPAVIRAALAKALAFFYPLAGRIVEGEQPGRPAIRCTADGVYFAEAEADCSLEDVRFLERPLLLPKEDLVPYPGDDRWPVEPHNTIMMMQITKFTCGGFVMGLRFNHASADGMGAAQFINAVGDMARGLAEPRVLPVWHREKFPDPSIKPGPLPELPVLALDYVVLDFPTAYIDGLKREYKAHSGRFCSGFDVLTAKLWQCRTRALALDPAAEVKLCFFASVRHLLKLDRGYYGNSIFPVKMSAPADKVLASSLVEVVDIIREAKDRMAVEFSRFAGEETDQDPFQMTFNYESIYVSDWSKLGFSEVDYGFGPPIFAGPLVNNDFIASVVFLKAPLPLDGTRMLASCVTKEHSEEFARGMKEDLP

SEQ ID NO: 1804 - protein, 419 aa, Oryza sativa
MAGTGSFKVTRISEGAVKPAAATPEETLPLAWVDRYPTHRGLVESMHIFRSGADAAPGVIRDALARALVFFYPLAGRIVEPEAGSPAIRCTADGVYFAEAAADCSLEDVRFLERPLLLPKEDLVPYPGDDRWGVEPHNTIMMMQITKFTCGGFVMGLRFNHASADGMGAAQFINAVGDMARGLPEPRVKPVWDREKFPNPSIKPGPLPGLPVLALDYIVLDFPTGYIDGLKAQYKAHSGKFCSGFDVLTAKLWQCRTRALNLEPGATVKLCFFASVRHLLKLDRGYYGNSIFPVKMSAPSETVLSSSVMEVVDMIRQAKERMAVEFFQFAKEETEQDPFQMTFNYESIYVSDWSKLGFAEVDYGFGPPKFAGPLVNNDFIASVVILKAPLPLDGTRMLASCVTKEHSEEFVRGMKEDLP

SEQ ID NO: 1805 - protein, 417 aa, Panicum virgatum
MAGFKVTRISEGPVKPASATPEETLPLAWVDRYPTHRGLVESMHIFRSGADAAPGVIREALGKALAFFYPLAGRIVEGAEPGCPAIRCTADGVYFAEAEADCSLEDVRFLERPLLLPKEDLVPYPGDDRWGVEPHNTIMMMQITKFTCGGFVMGLRFNHASADGMGAAQFINAVGDMARGLAEPKVKPVWDREKFPNPKIKPGPLPELPVLALDYIVLDFPTGYIDGLKKQYKEHSGKFCSGFDVLTAKLWQCRTRALNLEPNAEVKLCFFASVRHLLKLDRGYYGNSIFPVKMSAPAEKVLGSSIMEVVDMIRQAKDRMAVEFFQFAKEETDQDPFQMTFNYESIYVSDWSKLGFSEVDYGFGPPVFAGPLVNNDFIASVVILKAPLPLDGTRMLASCVTKEHSEEFVRGMKADLP

SEQ ID NO: 1806 - protein, 419 aa, Triticum aestivum
MASSSFKVTRISEGAVKPASETPDHTLPLAWVDRYPTHRGLVESMHIFRSGADAAPAVIREALGKALAFFYPLAGRIVEQPEKGCPAIRCTADGVYFAEAVAECSLEDVRFLERPLLLPKEDLVPYPADDLWGVEPHNTIMMMQITKFTCGGFVMGLRFNHASADGMGAAQFIKAVGDMARGLPEPAVKPVWDREKFPNPSIKPGPLPELPVLALDYIVLDFPTGYIDALKTQYKAHSGKFCSGFDVLTAKLWQCRTRALNLEPDATVKLCFFASVRHLLKLDAGYYGNSIFPVKMSGSSKKVLESSVMEVIDMIREAKQRMAVEFFQFAKEETRQDPFQMSFDYESIYVSDWSKLGFSDVDYGFGPPMFAGPLVNNDFIASVVILKAPLPLDGTRMLASCVTKEHSEEFARGMKEDLP

SEQ ID NO: 1807 - protein, 280 aa, Hordeum vulgare
GTRLVFIIKANKAKEDSIPVSFDCIGREGRNPSLLSQNEDWVIGLEQMSSDPRNPNPPPPPGSSSSSLPAGPSYFPLPFHLQQQQQQPVATYQYQQLQQAHQLFQRDAQTITPEALESVKAALATSDVLDPSAARATASSSDPAAKKKTIPRRAAGQSWEDPTLTEWPENDYRLFCGDLGNEVNDDVLSKAFSRFPSFNMAKVVRDKRTGKTKGYGFVSFSNPTDLAAAIKEMNGKYVGNRPIKLRKSNWKERTDVEALQRQKNHIQKKPKTQKKGILHK

SEQ ID NO: 1808 - protein, 233 aa, Brachypodium distachyon
MSSDPRSSNPPPPPGSSSAPPPAGPSYFPLPFHLQQQPAATYQYQQYQQLQQAQQLFQRDAQTITPEALESVKAALATSDVLDPSSARAVASSSDAAAKKKAIPRRAAGQSWEDPTLTEWPDNDYRLFCGDLGNEVNDDVLSKAFSRFPSFNMAKVVRDKRTGKTKGYGFVSFSNPTDLAAAIKEMNGKYVGNRPIKLRKSNWKERTDVEALQRQKNHIQKKPKMLKKSILHK

SEQ ID NO: 1809 - protein, 233 aa, Leymus cinereus x Leymus triticoides
MSSDPRNPNPPPPPPPGSSSSALPAGASYFPLPFHLQQQQPVATYQYQQLQQAQQLFQRDAQTITPEALESVKAALATSDVLDPSAARVTASSSDAAAKKKTIPRRAAGQSWEDPTLTEWPENDYRLFCGDLGNEVNDDVLSKAFSRFPSFNMAKVVRDKRTGKTKGYGFVSFSNPTDLAAAIKEMNGKYVGNRPIKLRKSNWKERTDVEALQRQKNHIQKKPKTPKKGILHK

SEQ ID NO: 1810 - protein, 237 aa, Zea mays
MPVNPPPPPPGSSSLAPAGASYFPLPFHLQQHQPPPPQVPPPMAASSYQQYQQQLHQAHQLFQRDAQTITPEALQSVKAALATSDVLDPVAAANARLSDPSTSKKPIPRRAAGQSWEDPTLTEWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVKRKPKIPKKTILHK

SEQ ID NO: 1811 - protein, 237 aa, Zea mays
MPMNPPPPPPPGSASSAPAGPSYFPLPFHLQQHQPQPQMPPPMAASSYQQYQQQLHQAHQLFQRDAQTITPEALQSVKAALATSDVLDPAAAANARPSDPSTSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALQRQKNHVQRKPKIPKKSVLHK

SEQ ID NO: 1812 - protein, 235 aa, Oryza sativa
MSSSRNPNPPPGSSSSGTNYFPLPFHLQQQPPQPPPMAMASTYQYQQYQQLQQAQQLFQRDAQTITPEALESVKAALATSDVLDPANARATATSSSDPAAKKKAIPRRAAGQSWEDPTLTDWPDNDYRLFCGDLGNEVNDDVLSKAFSRFPSFNMARVVRDKRTGKTKGYGFVSFSNPTDLAGAIKEMNGKYVGNRPIKLRKSNWKERTDVDALERQKNHIQKKPKMPKKSILHK

SEQ ID NO: 1813 - protein, 237 aa, Saccharum officinarum
MPVNPPPPPPPGSSSSAPAGASYFPLPFHLQQHQPPPQMPPPMAASSYQQYQQQLHQAHQLFQRDAQTITPEALQSVKAALATSDVLDPAAAANARPSDPSTSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVQRKPKIPKKSILHK

SEQ ID NO: 1814 - protein, 237 aa, Panicum virgatum
MPSNPPPPPPPGSSSSAPAGASYFPLPFHLQQHQPQPQMPPPMAPNSYQQYQQQLHQAHQLFQRDAQTITPEALQSVKAALATSDVLDPATSAGARPSDPSSSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVQRKPKMPKKSILHK

SEQ ID NO: 1815 - protein, 266 aa, Triticum aestivum
HASADAWVLIASAGKEGTPNPGLLFSGVIGLEKMSSDPRNPNPPPPPPPGSSSSALPAGGSYFPLPFHLQQQQPVATYQYQQLQQAQQLFQRDAQTITPEALESVKAALATSDVLDPSAARASASSSDAAAKKKTIPRRAAGQSWEDPTLTEWPENDYRLFCGDLGNEVNDDVLSKAFSRFPSFNMAKVVRDKRTGKTKGYGFVSFSNPTDLAAAIKEMNGKYVGNRPIKLRKSNWKERTDVEALQRQKNHIQKKPKTQKKGILHK

SEQ ID NO: 1816 - protein, 444 aa, Zea mays
MAVENGSADEAAAVTVTVTGARTVAPAKNRCTLATFDLPYITFYYNQKLLLYRAAPDFPDAVARMTAALADALRVFYPLAGRIRQDDGGALAVEGDEGAEVFEAEAQGVAVDDLAGGDCSDEAEKVLQHLVPYTGVMNLEGLRRPLLAVQFTKLKDGLAVGCAFNHAVLDGTSTWHFMSSWAELCRGVPLSLQPIHDRSLSRSVRVRLELPASAEAHEKTDPNGPKKALVARVFSFPEPTVARIKAAANAALPPGAKPFSTFQSLGAHIWRAVSRARGLGPADITAFAVFADCRARLDPPLPPAYFGNLIQAVFTGVPAGMLLGGPPELPAGLLQKAIDEHDAAAVTRRLEEYEAAPKLFHYSDAGPNCVAVGSSPRFRVYDVDFGFGRPERVRSGGNNKFDGMVYLYPGRGGDGGIDVELALQPEPMQRLEKDDDFFLRQAAA

SEQ ID NO: 1817 - protein, 445 aa, Oryza sativa
MAAVDNAPPSPVVTVTSTRTVAPAAAKCVLATFDLPYITFYYNQKLLLYRLPNGASDFPDAVARMSASLSDALAYFYPLAGRIRQDDHDGSLSIHGQHGAEVIEASADHVSVDQLAGEECSEEAEKVMQLLVPYTGVMNLEGLNRPLLAVQLTRLRDGVAVGCAFNHAVLDGTSTWHFMTSWAELCRGGGAPSLLPVHNRGMARSVRVNLPLPASAEAHEKTDPNGPKVPLVARVFSFPPSAVARAKAAANAALPPGAKPFSSFQSLAAHIWRAVSRARALGPSDITVFAVFADCRARLSPPLPPAYFGNLIQAVFTGVPAGMLLAGPPELAAGLLQKAIDDHDAAAITRRLEEYEAAPKLFHYSDAGPNCVAVGSSPRFRVYDVDFGFGRPERVRSGANNKFDGMVYLYPGRGGDGGIDVELSLQPEPMQRLDKDQDFLQMRAP

SEQ ID NO: 1818 - protein, 437 aa, Triticum aestivum
MAVAVTGTRTVAPAKTKVTLATFDLPYITFYYNQKLLLYRLPQGAADFQDVTARMADALGDALAYFYPLAGRIRQEKGDGGALYVDGEEGAEVVEAAAEGVSVDQLAGEDCGEEAEKLMQQLIPYTGVMNLEGLHRPLLAVQFTKLKDGLAVGCAFNHAVLDGTATWHFMSSWAELCRGAAAPSALPIHNRAMARSVRVGLTLPASAEAHEKTDPNGPKKPLVARVFSFPGPVVARIKTAANAALPPGAKPFSAFQSLGAHIWRSVSRARELGPADITVFAVFADCRARLDPPVPATYFGNLIQAVFTGVPAGMLLGGPPELAAGMLQKAIGEHDAAAVTRRLDEYEAAPKLFHYSDAGPNCVAVGSSPRFRVYDVDFGFGRPERVRSGGNNKFDGMVYLYPGRGGDSGGIDVELALQPEPMQRLEKDEEFLQIAAA

SEQ ID NO: 1819 - protein, 452 aa, Hordeum vulgare
  misc_feature (291)..(291): Xaa can be any naturally occurring amino acid
MRVKVISRSTDDFTRERSQDLQKVFRNYDPALRSQEKAVEYTRALNAAKLEKIFARPFIGAMDGHIDAVSCMAKNSNYVKAMFSGSMDGDIRLWDIAARKTVCQFPGHQGAVRGLATSTDGDLLVSCGVDCTVRLWKDPMRKMMDSNDAIGDASQPSAVYTWKHAFWGVDHQWDHNVFATVGAQVDIWDHNRSEPINTFEWGKDTVLSVRFNPGEPDVLLTSSSDRSLTLFDLRMSSPARKLIMKTRCNSVCWNPKEPMNFTAANEDTNCYSFDARKLNEAKVVHKGHVSXVMDVDYNPTGREFVTGSYDRTVRIFNYIGDHSREIYHTKRMQRVFCVKYTYDGTYLVSGSDDTNLRLWKSNASEQLGVVLPRERKKQEYLDAVKLRYGHLPEIRRIVKHKHVPKPIYKAGKIRRAMIEAESRKEERRRAHSAPGSRTMQPFRKRRLITEVE

SEQ ID NO: 1820 - protein, 452 aa, Brachypodium distachyon
MRVKVISRSTDEFTRDRSQDLQKVFRNYDPALRSQEKAVEYTRALNAAKLEKIFAKPFIGAMDGHIDAVSCMAKNPNNLKAVFSGSMDGDIRLWDIAARKTVCQFPGHQGAVRGLATSTDGDLLISCGVDCTVRLWKDPMRRMMDTSDAIGDASQPSAVYTWKHAFWGVDHQWDGNIFATVGAQVDIWDHNRSEPINSFEWGKDTLLSVRFNPGEPDVLITSASDRSLTLYDLRMSSPARKLIMKTRCNSVCWNPREPMNFTAANEDTNCYSFDSRKLEEAKIVHRGHVSAVMDIDYSPTGREFVTGSYDRTVRIFQYNGDHSREIYHTKRMQRVFCVKYTYDGTYLVSGSDDTNLRLWKSKASEQLGVILPRERKKQEYLDAVKERYKHLPEIKRIVRHRHLPKPIYKAANIRRTMIEAESRKEERRRAHSAPGSRPVQPFRKRRLIKEVE

SEQ ID NO: 1821 - protein, 452 aa, Oryza sativa
MRVKVISRSTDEFTRERSQDLQKVFRNYDPALRSQEKAVEYTRALNAAKLEKIFARPFIGAMDGHVDAVSCMAKNPNYLKAIFSGSMDGDIRLWDIAARKTVCQFPGHQGAVRGLATSTDGDLLVSCGVDCTVRLWKVPMLKMVDTNDAIGDASQPSAVYTWKHAFWGVDHQWDGNLFATVGAQVDIWDQNRSEPINSFEWGKDTVLSVRFNPGEPDVLITSASDRSITLYDLRMSSPARKLIMKTRCNSICWNPREPMNFTAVNEDTNCYSFDARKLDEAKVVHKGHVSAVMDIDYSPTGREFVTGSYDRTVRIFQYNGDHSREIYHTKRMQRVFCVKYTYDGTYLVSGSDDTNLRLWKSKASEQLGVLLPRERRKQEYLDAVKERYKHLPEVKRIVRHRHLPKPIYKAANLRRTMIEAENRKEERRRAHSAPGSMPVQPFRKRRIIKEVE

SEQ ID NO: 1822 - protein, 452 aa, Sorghum bicolor
MRVKVISRSTDDYTRERSQDLQKVFRNYDPALRSQEKAVEYTRALNAAKLEKIFAKPFIGAMDGHIDAVSCMAKNPNHLKAIFSGSMDGDVRLWDIAARKTVCQFPGHQGAVRGLTTSTDGDFLVSCGVDCTVRLWKDPMLKMVDNSDRAGDNSQPSAVYTWKHAFWGADHQWDGNLFATVGAQVDIWDPDRSEPINSFEWGKDTILSVRFDPGDCNILITSGSDRSLTLYDLRMSSPARKLIMKTRCNSVCWNPREPMNFTAANEDTNCYSFDARKLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKLEYQDALKERYKHLPEVKRIVRHRHLPKPIYKAANLRRTMMEAENRKEERRRKHSAPGSMPVQPFRKRRIIKEVE

SEQ ID NO: 1823 - protein, 452 aa, Saccharum officinarum
  misc_feature (425)..(425): Xaa can be any naturally occurring amino acid
MRVKVISRSTDDYTRERSQDLQKVFRNYDPALRSQEKAVEYTRALNAAKLEKIFAKPFIGAMDGHLDAVSCMAKNPNHLKAIFSGSMDGDVRLWDIAARKTVCQFPGHQGAVRGLTTSTDGDLLVSCGVDCTVRLWKDPMLKMVDPSDRAGDNSQPSAVYTWKHAFWGADHQWDGNLFATVGAQVDIWDPDRSEPINSFEWGKDTVLSVRFDPGDCNILITSGSDRSLTLYDLRMSSPARKLIMKTRCNSVCWNPREPMNFTAANEDTNCYSFDARRLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKQEYQDALKERYKHLPEVKRIVRHRHLPKPIYKAANLRRTMIEAENRKXERRRKHSAPGSMTVQPFRKRRIIKEVE

SEQ ID NO: 1824 - protein, 452 aa, Panicum virgatum
MRVKVISRSTEEFTRDRSQDLQKVFRNYDPGLRSQEKAVEYTRALNAAKLEKIFAKPFIGAMDGHIDAVSCMAKNPNHLKAIFSGSMDGDIRLWDIAARKTVCQFPGHQGAVRGLTTSTDGDLLVSCGVDCTVRLWKVPMLKMVDTSDHTGDTSQPSAVYTWKHAFWGADHQWDGNLFATVGAQVDIWDPNRSEPINNFEWGKDTVLSVRFDPGDCNILITSASDRSLTLYDLRMSSPARKLIMKTRCNSVCWNPREPMNFTAANEDTNCYSFDARRLDEAKIVHKGHVSAVMDIDYSPTGREFITGSYDRTVRIFNYLGDHSREIYHTKRMQRVFCVKYTYDGTYLVSGSDDTNLRLWKSKASEQLGVLLPRERKKQEYLDAVKERYKHLPEVKRIVRHRHLPKPIYKAANLRRTMVEAENRKEERRRKHSAPGSMPGQPFRKRRIIKEVE

SEQ ID NO: 1825 - protein, 452 aa, Triticum aestivum
  misc_feature (381)..(381): Xaa can be any naturally occurring amino acid
  misc_feature (385)..(386): Xaa can be any naturally occurring amino acid
  misc_feature (389)..(389): Xaa can be any naturally occurring amino acid
  misc_feature (392)..(392): Xaa can be any naturally occurring amino acid
  misc_feature (398)..(398): Xaa can be any naturally occurring amino acid
MRVKVISRSTDDFTRERSQDLQKVFRNYDPALRSQEKAVEYTRALNAAKLEKIFARPFIGAMDGHIDAVSCMAKNSNYVKAMFSGSMDGDIRLWDIAARKTVCQFPGHQGAVRGLATSTDGDLLISCGVDCTVRLWKDPMRKMMDSNDAIGDASQPSAVYTWKHAFWGVDHQWDRNVFATVGAQVDIWDHNRSEPINTFEWGKDTVLSVRFNPGEPDVLLTSSSDRSLTLFDLRMSSPARKLIMKTRCNSLCWNPREPMNFTAANEDTNCYSFDARKLNEAKVVHKGHVSAVMDVDYNPTGREFVTGSYDRTVRIFNYNGDHSREIYHTKRMQRVFCVKYTYDGTYLVSGSDDTNLRLWKSKASEQLGVILPRERKKQEYXDAVXXRYXHLXEIRRIXKHKHLPKPIYKAGKIRRAMIEAESRKEERRRAHSAPGSRTMQPFRKRRLITEVE

SEQ ID NO: 1826 - protein, 433 aa, Malus domestica
MYSNFKEQAIEYVKQAVQEDNAGNYAKAFPLYMNALEYFKTHLKYEKNPKIKEAITQKFTEYLRRAEEIRAVLDDGGPGPASNGDAAVATKPKTKPKDGEGGDGEDPEQAKLRAGLNSAIIREKPNVQWNDVAGLESAKQALQEAVILPVKFPQFFTGKRRPWRAFLLYGPPGTGKSYLAKAVATEADSTFFSISSSDLVSKWMGESEKLVSNLFQMARDSAPSIIFIDEIDSLCGTRGEGNESEASRRIKTELLVQMQGVGTNDQKVLVLAATNTPYALDQAIRRRFDKRIYIPLPDLKARQHMFKVHLGDTPHNLTESDYESLARKTDGFSGSDIAVCVKDVLFEPVRKTQDAMFFFKDPKDMWIPCGPKQPGAVQITMQDLAAKGLASQILPPPITKTDFDKVLARQRPTVSKNDLEVHERFTREFGEEG

SEQ ID NO: 1827 - protein, 435 aa, Arabidopsis thaliana
MYSNFKEQAIEYVKQAVHEDNAGNYNKAFPLYMNALEYFKTHLKYEKNPKIREAITQKFTEYLRRAEEIRAVLDEGGSGPGSNGDAAVATRPKTKPKDGEGGGKDGEDPEQSKLRAGLNSAIVREKPNIKWSDVAGLESAKQALQEAVILPVKFPQFFTGKRRPWRAFLLYGPPGTGKSYLAKAVATEADSTFFSVSSSDLVSKWMGESEKLVSNLFEMARESAPSIIFVDEIDSLCGTRGEGNESEASRRIKTELLVQMQGVGHNDEKVLVLAATNTPYALDQAIRRRFDKRIYIPLPEAKARQHMFKVHLGDTPHNLTEPDFEYLGQKTEGFSGSDVSVCVKDVLFEPVRKTQDAMFFFKSPDGTWMPCGPRHPGAIQTTMQDLATKGLAEKIIPPPITRTDFEKVLARQRPTVSKSDLDVHERFTQEFGEEG

SEQ ID NO: 1828 - protein, 433 aa, Brassica rapa
MYSNFKEQAIEYVKQAVQEDNAGNYNKAFPLYMNALEYFKTHLKYEKNPKIREAITQKFTEYLRRAEEIRAVLDEGGSGPGPNGDAAVATRPKSKPKDGGGEGGEDAEQSKLRAGLNSAIVREKPNIKWTDVAGLESAKQALQEAVILPVKFPQFFTGKRRPWRAFLLYGPPGTGKSYLAKAVATEADSTFFSVSSSDLVSKWMGESEKLVSNLFEMARESSPSIIFVDEIDSLCGQRGEGNESEASRRIKTELLVQMQGVGHSDDKVLVLAATNTPYALDQAIRRRFDKRIYIPLPEAKARQHMFKVHLGDTPHNLTESDFEYLGLKTEGFSGSDVSVCVKDVLFEPVRKTQDAMFFFKSPDGTWMPCGPRQPGAIQTTMQDLAAKGLAEKIIPPPITRTDFEKVLARQRPTVSKSDLDVHERFTQEFGEEG

SEQ ID NO: 1829 - protein, 433 aa, Brassica rapa
  misc_feature (274)..(274): Xaa can be any naturally occurring amino acid
MYSNFKEQAIEYVKQAVQEDNAGNYSKAFPLYMNALEYFKTHLKYEKNPKIREAITHKFTDYLRRAEEIRAVLDEGGPGPGSNGGDAAVATKPKSKPKDGGGDGEDPEQSKLRAGLDSAIVREKPNIKWTDVAGLESAKQALQEAVILPVKFPQFFTGKRRPWRAFLLYGPPGTGKSYLAKAVATEADSTFFSVSSSDLVSKWMGESEKLVSNLFEMARESSPSIIFVDEIDSLCGQRGEGNESEASRRIKTELLVQMQGVGHSDDKVLVLAAXNTPYALDQAIRRRFDKRIYIPLPEAKARQHMFKVHLGDTPHNLTESDFEYLGLKTEGFSGSDVSVCVKDVLFEPVRKTQDAMFFFKSPDGTWMPCGPRQPGAIQTTMQDLATKGLAEKIIPPPITRTDFEKVLARQRPTVSKSDLDVHERFTQEFGEEG

SEQ ID NO: 1830 - protein, 438 aa, Hordeum vulgare
MYSNFKEQAIEYVKQAVQEDNAGNYVKAFPLYMNALEYFKTHLKYEKNPKIKEAITAKFTEYLRRAEEIRAVLDEGGGGPPGAPNGGDAAVATRPKTKGKDAGGDGAGGDDSEQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGTRGEGNESEASRRIKTELLVQMQGVGHNDDKVLVLAATNTPYALDQAVRRRFDKRIYIPLPDAKARQHMFKVHLGDTPHSLSESDFEVLGRRTEGFSGSDVAVCVKDVLFEPVRKTQDAMYFFKTDGDMWMPCGSKQPGAVQTTMQDLASKGLASQILPPPISKSDFEKVLARQRPTVGKKDLEVHEKFTKEFGEEG

SEQ ID NO: 1831 - protein, 437 aa, Ocimum basilicum
  misc_feature (383)..(383): Xaa can be any naturally occurring amino acid
  misc_feature (385)..(385): Xaa can be any naturally occurring amino acid
RLVPNRHEGNFKEPVIEYVRQAVAEDNAGNYAKAFPLYMNALEYFKTHLKYEKNPKIKEAITQKFTEYLRRAEEIRAVLDEGGSGPAANGDAAVATRPKTKPKDGNEGEDGDKEKLRSGLNSAIIREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESSPSIIFIDEIDSLCGQRGEGNESEASRRIKTELLVQMQGVGHNDDKVFVLVATNTPYAFDQAIRRRFDKRIYIPLPDVKARQHMFKVHLGDTPHNLTESDFEALARKTEGFSGSDISVCVKDVLFEPVRKTQDAMFFIKTFNGPWMPCGPKQQGAVQXTXQELAAKGLAEKIIPPPISKTDFDKVLARQRPTVSKSDLDVHERFTKEFGEEG

SEQ ID NO: 1832 - protein, 434 aa, Phaseolus coccineus
MYSNFKEQAIEYVKQAVQEDNAGNYAKAFPLYMNALEYFKTHLKYEKNPKIKEAITQKFTEYLRRAEEIRAVLDDGGPGPASNGDAAVAARPKTKPKDGEGGGDGEDPEQAKLRAGLNSAIVREKPNVKWNDVAGLESAKQALQEAVILPVKFPQFFTGKRRPWRAFLLYGPPGTGKSYLAKAVATEAESTFFSVSSSDLVSKWMGESEKLVSNLFEMARESAPSIIFIDEIDSLCGQRGEGNESEASRRIKTELLVQMQGVGHNDQKVLVLAATNTPYALDQAIRRRFDKRIYIPLPDLKARQHMFKVHLGDTPHNLTESDFEYLASRTDGFSGSDISVCVKDVLFEPVRKTQDAMFFFKNSEGMWIPCGPKQQGAVQTSMQDLATKGLASKILPPPITRTDFEKVLARQRPTVSKSDLDVHERFTKEFGEEG

SEQ ID NO: 1833 - protein, 438 aa, Brachypodium distachyon
MYSNFKEQAIEYVKQAVQEDNAGNYVKAFPLYMNALEYFKTHLKYEKNPKIKEAITAKFTEYLRRAEEIRAVLDEGGGGGPGAPNGGDAAVATKPKSKGKDGGGGGDGGDDSEQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFVDEIDSLCGTRGEGNESEASRRIKTELLVQMQGVGHNDDKVLILAATNTPYALDQAVRRRFDKRIYIPLPDAKARQHMFKVHLGDTPHNLTESDFEVLGRRTDGFSGSDIAVCVKDVLFEPVRKTQDAMYFFKTDGDMWMPCGSKQPGAVQTTMQELASKGLASQILPPPISKTDFEKVLARQRPTVGKKDLEVHERFTKEFGEEG

SEQ ID NO: 1834 - protein, 437 aa, Theobroma cacao
MYSNFKEQAIEYVKQAVQEDNAGNYSKAFPLYMNALEYFKTHLKYEKNPKIREAITQKFTEYLRRAEEIRAVLDEGGPGPASNGDAAVATRPKSKPKDVSGGGEGGDGEDPEQAKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARDSAPSIIFIDEIDSLCGQRGEGNESEASRRIKTELLVQMQGVGHNDQKVLVLAATNTPYALDQAIRRRFDKRIYIPLPDLKARQHMFKVHLGDTPHNLTESDFENLARRTEGFSGSDISVCVKDVLFEPVRKTQDAMFFYKTPNDMWMPCGPKQPGAVQITMQELAGKGLAAQILPPPISRSDFDKVLARQRPTVSKADLEVHERFTKEFGEEG

SEQ ID NO: 1835 - protein, 430 aa, Brassica napus
  misc_feature (249)..(249): Xaa can be any naturally occurring amino acid
  misc_feature (268)..(268): Xaa can be any naturally occurring amino acid
  misc_feature (283)..(283): Xaa can be any naturally occurring amino acid
  misc_feature (306)..(306): Xaa can be any naturally occurring amino acid
MYSNFKEQAIEYVKQAVQEDNAGNYNKAFPLYMNALEYFKTHLKYEKNPKIREAITQKFTEYLRRAEEIRAVLDEGGSGPGSNGDAAVATKAKSKGKDGDGEDKEQSKLRAGLDSAIVREKPNVKWSDVAGLESAKQALQEAVILPVKFPQFFTGKRRPWRAFLLYGPPGTGKSYLAKAVATEADSTFFSVSSSDLVSKWMGESEKLVSNLFEMARESAPSIIFVDEIDSLCGQRGEGNESEASRRIKXELLVQMQGVGHNDEKVLVXAATNTPYALDQAIRXRFDKRIYIPLPDVKARQHMFKVXLGDTPHNLNESDFEYLARKTEGFSGSDVAVCVKDVLFEPVRKTQDARFFFKSADGTWMPCGPKQSGAIQITMQDLAEKGLAEKIIPPPISRTDFEKVLARQRPTVSKSDLEVHERFTKEFGEEG

SEQ ID NO: 1836 - protein, 433 aa, Brassica napus
MYSNFKEQAIEYVKQAVQEDNAGNYNKAFPLYMNALEYFKTHLKYEKNPKIREAITQKFTEYLRRAEEIRAVLDEGGSGPGSNGDAAVATRPKSKPKDGGGEGGEDAEQSKLRAGLNSAIVREKPNIKWTDVAGLESAKQALQEAVILPVKFPQFFTGKRRPWRAFLLYGPPGTGKSYLAKAVATEADSTFFSVSSSDLVSKWMGESEKLVSNLFEMARESSPSIIFVDEIDSLCGQRGEGNESEASRRIKTELLVQMQGVGHSDDKVLVLAATNTPYALDQAIRRRFDKRIYIPLPEAKARQHMFKVHLGDTPHNLTESDFEYLGLKTEGFSGSDVSVCVKDVLFEPVRKTQDAMFFFKSPDGTWMPCGPRQPGAIQTTMQDLAAKGLAEKIIPPPITRTDFEKVLARQRPTVSKSDLDVHERFTQEFGEEG

SEQ ID NO: 1837 - protein, 431 aa, Ricinus communis
MYSNFKEQAIEYVRQAVQEDNAGNYAKAFPLYMNALEYFKTHLKYEKNPKIREAITQKFTEYLRRAEEIRAVLDEGGPGPASNGDAAVATRPKTKPKDGEDGEDPEQTKLRAGLNSAIIREKPNVNWNDVAGLESAKQALQEAVILPVKFPQFFTGKRRPWRAFLLYGPPGTGKSYLAKAVATEADSTFFSISSSDLVSKWMGESEKLVSNLFQMARESQPSIIFIDEIDSLCGQRGEGNESEASRRIKTELLVQMQGVGNNDQKVLVLAATNTPYALDQAIRRRFDKRIYIPLPDLKARQHMFKVHLGDTPHNLTESDFESLARRTEGFSGSDISVCVKDVLFEPVRKTQDAMFFIKTPNDMWVPCGPKQPGAVQISMQELAAQGLAAKILPPPITKTDFDKVLARQRPTVSKSDLEVHERFTKEFGEEG

SEQ ID NO: 1838 - protein, 435 aa, Castanea mollissima
MYSNFKEQAIEYVKQAVQEDNAGNYAKAFPLYMNALEYFKTHLKYEKNPKIKEAITQKFTEYLRRAEEIRAVLDDGGPGPASNGDAAVATRPKTKPKDGGEGGGDGEDPEQSKLRAGLNSAIVREKPNVKWTDVAGLESAKQALQEAVILPVKFPQFFTGKRRPWRAFLLYGPPGTGKSYLAKAVATEADSTFFSVSSSDLVSKWMGESEKLVSNLFQMARESEPSIIFIDEIDSLCGTRGEGNESEASRRIKTELLVQMQGVGHNDQKVLVLAATNTPYALDQAIRRRFDKRIYIPLPEAKARQHMFKVHLGDTPHNLTESDFESLGYKTEGFSGSDIAVCVKDVLFEPVRKTQDAMFFYKNSNDMWVPCGPKQPGSVQITMQELAAQGLASKILPPPISKADFDKVLARQRPTVSKSDLDVHERFTKEFGEEG

SEQ ID NO: 1839 - protein, 436 aa, Citrus sinensis
MYSNFKEQAIEYVKQAVQEDNAGNYAKAFPLYMNALEYFKTHLKYEKNPKIKEAITQKFTEYLRRAEEIRAVLDDGGPGPAHNGDAAVATRPKTKPKDGGDGGGGDGEDPEQAKLRAGLNSAIIREKPNVKWNDVAGLESAKQALQEAVILPVKFPQFFTGKRQPWRAFLLYGPPGTGKSYLAKAVATEADSTFFSISSSDLVSKWMGESEKLVSSLFQMARESAPSIIFIDEIDSLCGQRGEGNESEASRRIKTELLVQMQGVGHNDQKVLVLAATNTPYALDQAIRRRFDKRIYIPLPDLKARQHMFKVHLGDTPHNLTESDFESLARKTEGFSGSDISVCVKDVLFEPVRKTQDAMFFFKTSNGMWMPCGPKQSGAVQISMQELAAKGLAEQILPPPISKTDFDKVLARQRPTVSKSDLEVQERFTKEFGEEG

SEQ ID NO: 1840 - protein, 435 aa, Gossypium hirsutum
MYSNFKEQAIEYVKQAVQEDNAGNYSKAFPLYMNALEYFKTHLKYEKNPKIREAITQKFTEYLRRAEEIRAVLDEGGPGPASNGDAAVATRPKSKPKSGGGEGGDGEDPEQAKLRAGLNSAIIREKPNVKWNDVAGLESAKQALQEAVILPVKFPQFFTGKRRPWRAFLLYGPPGTGKSYLAKAVATEADSTFFSVSSSDLVSKWMGESEKLVSNLFEMARDSAPSIIFIDEIDSLCGQRGEGNESEASRRIKTELLVQMQGVGHNDQKVLVLAATNTPYALDQAIRRRFDKRIYIPLPDVKARQHMFKVHLGDTPHNLTESDFENLARRTEGFSGSDISVCVKDVLFEPVRKTQDAMFFFKTPNNMWMPCGPKQPGAVQITMQELAAKGLAAQILPPPISRSDFDKVLARQRPTVSKADLEVHERFTKEFGEEG

SEQ ID NO: 1841 - protein, 437 aa, Gossypium hirsutum
  misc_feature (395)..(395): Xaa can be any naturally occurring amino acid
MYSNFKEQAIEYVKQAVQEDNAGNYSKAFPLYMNALEYFKTHLKYEKNPKIREAITQKFTEYLRRAEEIRTVLDEGGPGPATNGGAAVATRPKSKPKDGSGGGEGGDGEDPDQAKLRAGLDSAIIREKPNIKWNDVAGLESAKQALQEAVILPVKFPQFFTGKRRPWRAFLLYGPPGTGKSYLAKAVATEADSTFFSVSSSDLVSKWMGESEKLVSNLFQMARDSAPSIIFIDEIDSLCGQRGEGNESEASRRIKTELLVQMQGVGNNDQKVLVLAATNTPYALDQAIRRRFDKRIYIPLPDLKARQHMFKVHLGDTPHNLTENDFESLAHRTDGFSGSDISVCVKDVLFEPVRKTQDAMFFFKTPDDMWMPCGPKQPGAVQITMQELAAKGLAXQILPPPISRSDFDKVLARQRPTVSKADLEVHERFTNEFGEEG

SEQ ID NO: 1842 - protein, 438 aa, Gossypium hirsutum
  misc_feature (251)..(251): Xaa can be any naturally occurring amino acid
MYSNFKEQAIEYVKQAVHEDNEGNYSKAFPLYMNALEYFKTHLKYEKNPKIREAITQRLIEYLRRAEEIRAVLDEGGPGPASNGDAAVATRPKSKPKNGGGGGEGGDGGEDPDQAKLRSGLNSAIIREKPNVKWNDVAGLESAKQALQEAVILPVKFPQFFTGKRRPWRAFLLYGPPGTGKSYLAKAVATESDSTFFSISSSDLVSKWMGESEKLVSNLFQMARDSAPSIIFIDEIDSLCGQRGEGNESEXSKRIKTELLVQMQGVGHTDQKVLVLAATNTPYALDQAIRRRFDKRIYIPLPDLKARQHMFKVHLGDTPHNLTESDFENLARRTEGFSGSDISVCVKDVLFEPVRKTQDAMFFYKTPEDMWMPCGPRQPSAVQITMQELAAKGHAAQILPPPISRSDFDKVLARQRPTVSKGDLEVHERFTKEFGEEG

SEQ ID NO: 1843 - protein, 437 aa, Gossypium hirsutum
MYSNFKEQAIEYVKQAVQEDNAGNYSKAFPLYMNALEYFKTHLKYEKNPKIREAITQKFTEYLRRAEEIRAVLDEGGPGPASNGDAAVATRPKSKPKNGGGGGEGGDGEDPEQAKLRAGLDSAIIREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARDSAPSIIFIDEIDSLCGQRGEGNESEASRRIKTELLVQMQGVGHSDQKVLVLAATNTPYALDQAIRRRFDKRIYIPLPDLKARQHMFKVHLGDTPHNLTESDFESLARRTEGFSGSDISVCVKDVLFEPVRKTQDAMFFYKTPNDMWMPCGPKQAGVVQITMQELAAKGLAAQVLPPPISRSDFDKVLARQRPTVSKADLEVHERFTNEFGEEG

SEQ ID NO: 1844 - protein, 433 aa, Vigna unguiculata
MYSNFKEQAIEYVKQAVDEDNKGNYAKAFQLYMNALEYFKTHLKYEKNPKIKEAITQKFTEYLRRAEEIRAVLDDGPSGPPSSGDAAVATRPKTKPKDGAGGDGEDPEQAKLRAGLNSAIVREKPDVKWNDVAGLESAKQALQEAVILPVKFPQFFTGKRRPWRAFLLYGPPGTGKSYLAKAVATEADSTFFSVSSSDLVSKWMGESEKLVSNLFEMARESAPSIIFIDEIDSLCGQRGEGNESEASRRIKTEVLVQMQGVGHNDQKVLVLAATNTPYALDQAIRRRFDKRIYIPLPDLKARQHMFKVHLGDTPHSLTESDFEHLARRTEGFSGSDISVCVKDVLFEPVRKTQDAMFFFKNPEGMWIPCGPKQQSAIQITMQELAAKGLASQILPPPISRTDFDKVLARQRPTVSKTDLDVHERFTKEFGEEG

SEQ ID NO: 1845 - protein, 434 aa, Mesembryanthemum crystallinum
MYSNFKEQAIEYVKQAVQEDNAGNYSKAFPLYMNALEYFKTHLKYEKNPKIREAITQKFTEYLRRAEEIRAVLDEGGGAGPAANGGDAAVAARPKGKPKDGGGDGEDAEQAKLRSGLNSAIIREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESAPSIIFVDEIDSLCGQRGEGNESEASRRIKTELLVQMQGVGHNDEKVLVLAATNTPYALDQAIRRRFDKRIYIPLPDLKARQHMFKVHLGDTPHNLTESDFEFLARKTEGFSGSDIAVCVKDVLFEPVRKTQDAMFFYKTSDDVWVPCGPRQPGAVQITMQDLAAKGLAAKIVPPPIARTDFEKVLARQRPTVSKSDLEVHERFTQEFGEEG

SEQ ID NO: 1846 - protein, 436 aa, Lactuca sativa
MYSNFKEQAIEYVKQAVQEDNAGNYAKAFPLYMNALEYFKTHLKYEKNPKIREAITQKFTEYLRRAEEIRAVLDEGGTGPAASGGDAAVAARPKTKPKDGEGGGGDGEDPEQSKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESAPSIIFIDEIDSLSGQRGEGNESEASRRIKTEILVQMQGVGHNDDKVLVLAATNTPYSLDQAIRRRFDKRIYIPLPDMKARQHMFKVHLGDTPNNLTDSDFEALGRKTEGFSGSDIAVCVKDVLFEPVRKTQDAMFFVNTNDGLWVPCGPKQPGAVQITMQELAAKGLASKISPPPIIRADFDKVLVRQRPTVSKSDLELHERFTKEFGEEG

SEQ ID NO: 1847 - protein, 435 aa, Lactuca sativa
MYSNFKEQAIVYVKQAVEEDTAGNYAKAFTLYMNALEYFKTHLKYEKNPKLKEAITQKFTDYLRRAEEIRAVLEDGGGNKPSSNGGDTGVATRPKSNKKNGDGDGGEDSEQSKLRSGLNSAIIREKPNVKWNDVAGLQSAKQALQEAVILPVKFPQFFVGKRRPWRAFLLYGPPGTGKSYLAKAVATEADSTFFSISSSDLVSKWMGESEKLVSNLFQMARESAPSIIFIDEIDSLVGQRGEGNESEASRRIKTELLVQMQGVGNNDDKVLVLAATNTPYSLDQAIRRRFDKRIYIPLPDVKARQHMFKVHLGDTPHNLTDRDFEQLGYRTEGFSGSDIAVCVNEVLFEPVRKTQDAMFFIKTSDDTWVPCGPRHPGAIEITMQDLAAQGQAEKILPPPISRTDFDKVLARQKPTVSKSDLELHDRFTREFGEER

SEQ ID NO: 1848 - protein, 435 aa, Zea mays
MYSNFKEQAIEYVKQAVQEDNAGNYVKAFPLYMNALEYFKTHLKYEKNPKIKEAITAKFTEYLRRAEEIRAVLDEGGAGPGANGGDAAVATRPKTKGKDGDGGNGGDDSEQSKLRAGLNSAIITEKPNVKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDTKARQHMFKVHLGDTPHSLTESDFESLARRTDGFSGSDVAVCVKDVLFEPVRKTQDAMFFFKADGDMWMPCGPKQPGSVQTTMQELASKGLAAKILPPPISRTDFEKVLSRQRPTVSKKDLEVHERFTKEFGEEG

SEQ ID NO: 1849 - protein, 435 aa, Zea mays
MYSNFKEQAIEYVKQAVQEDNAGNYVKAFPLYMNALEYFKTHLKYEKNPKIKEAITAKFTEYLRRAEEIRAVLDEGGAGPGANGGDAAVATRPKTKGKDGDGGNGGDDSEQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDMKARQHMFKVHLGDTPHSLTESDFESLARRTDGFSGSDVAVCVKDVLFEPVRKTQDAMFFFKADGDMWMPCGPKQPGAVQTTMQELASKGLAAKILPPPISRADFEKVLSRQRPTVSKKDLEVHERFTKEFGEEG

SEQ ID NO: 1850 - protein, 116 aa, Medicago truncatula
MYSNFKEQAIEFVKQAVTEDNSGNYAKAFPLYMNALEYFKTHLKYEKNPKIKEAITQKFTEYLRRAEEIRAVLDDGGPGPASNGDAAVATKPKTKGKGGGEGEGGGMLTRVSLGRG

SEQ ID NO: 1851 - protein, 439 aa, Pinus taeda
MYSNFKEQAIEYVRQAVQEDNAGNYAKAFPLYMNALEYFRTHLKYEKNPKIKEAITQKFTEYLRRAEEIRVVLDEGTNSRPTANGDAAVATKPKSKPGAKGDGDGDGEDPEQAKLRSGLNSAIIREKPNIKWTDVAGLESAKQALQEAVILPVKFPQFFTGKRKPWRAFLLYGPPGTGKSYLAKAVATEADSTFYSISSSDLVSKWMGESEKLVSNLFQMARDCAPSIIFIDEIDSLCGQRGEGNESEASRRIKTELLVQMQGVGNNDQKVLVLAATNTPYALDQAIRRRFDKRIYIPLPDLKARQHMFKVHLGDTPNNLTEGDFEDLARRTDGFSGSDISVCVKDVLFEPVRKTQDAMFFSKVSTEDGEMWVPCGPRQPGAVQTTMQELAVKGLASKILPPPISKADFDKVLARQRPTVSKHDLEVHERFTKEFGEEG

SEQ ID NO: 1852 - protein, 438 aa, Pinus taeda
MYSNFKEQAIEYVRQAVKEDNAGNYAKAFPLYMNALEYFKTHLKYEKNPKIKEAITQKFTEYLRRAEEIRVVLDDGASAGPTANGDAAVVTRPKTKPGNKDGDGDGEDPEQTKLRAGLNSAIIREKPNVKWSDVSGLESAKQALQEAVILPVKFPQFFTGRRKPWKAFLLYGPPGTGKSYLAKAVATEADSTFFSISSSDLVSKWMGESEKLVANLFQMARDSAPAIIFIDEIDSLCGTRGESNESEASRRIKTEVLVQMQGVGNNDDKVLVLAATNTPYALDQAIRRRFDKRIYIPLPEVKARQHMFKVHLGDTPHNLTESDFEELACRTEGFSGSDVAVCVKDVLFEPVRKTQDAMFFRKVSTEEGEMWMPCGPRQAGAVQTTMQELAAEGLAAKILPPPIAKADFDKVIARQRPTVSKSDLEVHERFTKEFGEDG

SEQ ID NO: 1853 - protein, 431 aa, Populus trichocarpa
MYSNFKEQAIEYVKQAVQEDNAGNYSKAFPLYMNALEYFKTHLKYEKNPKIREAITQKFTEYLRRAEEIRTVLDEGGPGPNSNGDAAVATRAKTKPKDGEDGDDPEKDKLRAGLNSAIVREKPNVKWNDVAGLESAKQALQEAVILPVKFPQFFTGKRRPWRAFLLYGPPGTGKSYLAKAVATEAESTFFSVSSSDLVSKWMGESEKLVSNLFQMARESAPSIIFVDEIDSLCGQRGEGNESEASRRIKTELLVQMQGVGTTDQKVLVLAATNTPYALDQAIRRRFDKRIYIPLPDLKARQHMFKVHLGDTPHNLTESDFESLARRTEGFSGSDISVCVKDVLFEPVRKTQDAMFFIHTSDDMWVPCGPKQPGAVQISMQDLAAQGLAEKILPPPIMKTDFDKVLARQKPTVSKADLDVHERFTKEFGEEG

SEQ ID NO: 1854 - protein, 431 aa, Populus trichocarpa
MYSNFKEQAIEYVKQAVQEDNAGNYSKAFPLYTNALEYFRTHLKYEKNPKIREAITQKFNEYLRRAEEIKTVLDEGGPGPNSNGDAAVATRPKTKPKDGEDGDDPEKDKLRAGLNSAIVREKPNVKWNDVAGLESAKQALQEAVILPVKFPQFFTGKRRPWRAFLLYGPPGTGKSYLAKAVATEADSTFFSISSSDLVSKWMGESEKLVSNLFQMARESAPSIIFVDEIDSLCGQRGEGNESEASRRIKTELLVQMQGVGNNDQKVLVLAATNTPYALDQAIRRRFDKRIYIPLPDMKARQHMFKVHLGDTPHNLNESDFESLGRRTEGFSGSDISVCVKDVLFEPVRKTQDAMFFINNPDDMWVPCGPKQPGAVQISMQELAAKGLAKKLLPPPIMKTDFDKVLARQRPTVSKADLGVHERFTKEFGEEG

SEQ ID NO: 1855 - protein, 431 aa, Populus trichocarpa
MYSNFMEHGIEYAKQAVKEDDTGNYSKAFQLYMNALEYFQAQLKYEKNQQIEKTIRERCLGYLKRAEEIRAVLDNGGSVPASNGDASVAAQPKSSPKPKDGGGKDKEDPEKAKLKAGLDSVIIREKPNVKWSDVAGLENAKLALQEAVILPVKFPQFFTGKRKPWRAFLLYGPPGTGKSYLAKAVATEADSTFFSVSSSDLVSKWMGESEKLVSNLFQMARDSAPSIIFVDEIDSLCGQRGEGNESEASRRIKTELLVQMQGVGSDDHKVLVLAATNTPYALDQAIRRRFDKRIYIPLPDLKARQHMFKVHLGDTPHNLTESDFEKLAQKTEGFSGSDISVCVKDVLFEPVRKIQDAEYFMKSSDGMWVPCEPKQRGAVKTTLQELDAQDLASKVLLPPITRADFDKVLARQKPTVSKADLEVHERFTKEF

SEQ ID NO: 1856 - protein, 434 aa, Populus trichocarpa
MYCNFMEHGIEYAKQAVKEDDAGNYRKAFQLYMNALEYFQAQLKYEKNPQIEKTIRQKCMGYLRRAEEIRSVLDNGRSMPASNGDASVAARPKTSPKPKDGGRKGKEDPELAKLKEGLDSVIIREKPNVKWSDVAGLENAKLALQEAVILPVKFPQFFTGKRKPWRAFLLYGPPGTGKSYLAKAVATEADSTFFSVSSSDLVSKWMGESEKLVSNLFQMARDNAPSIIFIDEIDSLCGQRGECNESEASRRIKTELLVQMQGIGNDDQKVLVLAATNTPYALDQAIRRRFDKRIYIPLPDLKARQHMFKVHLGDTPHDLTERDFEKLARKTEGFSGSDISVCVKDVLFEPVRKTRDAEYFIKSSDGMWVPCELQRVAVKTTLQELDAQGLASKVLPPHITRADFNKVLARQKPTVSKADLEVHERFTKEFGEEG

SEQ ID NO: 1857 - protein, 435 aa, Solanum tuberosum
MYSNFKEQAVAYVKQAVEEDNAGNYAKAFSLYMNALEYFKTHLKYEKNPKIKEAITQKFVEYLRRAEEIRSVLDEGGGGPTSNGDAAVASRAKSKPKNGGGGGEGDDSENVKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESSPSIVFIDEIDSLCGQRGEGSESEASRRIKTELLVQMQGVGHDDDKKVLVLAATNTPYSLDQAIRRRFDKRIYIPLPDLKARQHMFKVHLGDTPHNLTESDFEQLARKTEGFSGSDISVCVNEVLFEPVRKTQDAEFFIKTSDGLWVPCGPRQPGAIQTNMQELAAKGLASKITPPPISIRDFDRVLWKQKPTVSKADLEVHERFTKEFGEEG

SEQ ID NO: 1858 - protein, 432 aa, Solanum tuberosum
MYSNFKEQAIEFVRQAVQEDNGGNYAKAFPLYMNALEYFKTHLKYEKNPKIKEAITQKFTEYLRRAEEIRAVLDEGGSGPGPNGGDAAVIAKPKTKPKDGEDGEDPEQSKLRAGLNSAIVREKPNVKWNDVAGLESAKQALQEAVILPVKFPQFFTGKRRPWRAFLLYGPPGTGKSYLAKAVATEAESTFFSVSSSDLVSKWMGESEKLVSNLFQMARESAPSIIFVDEIDSLCGQRGEGNESEASRRIKTELLVQMQGVGHNDDKVLVLAATNTPYALDQAIRRRFDKRIYIPLPDLKARQHMFKVHLGDTPHNLSESDFEDLARKTEGFSGSDVSVCVKDVLFEPVRKTQDAVFFTQTSNGTWIPCGPKQQGAVQTTMQELDAKGLASQIIPPPITKTDFDKVLARQRPTVSKSDLEVHDRFTKEFGEEG

SEQ ID NO: 1859 - protein, 433 aa, Oryza sativa
MYSNFKEQAIEYVKQAVQEDNAGNYVKAFPLYMNALEYFKTHLKYEKNPKIKEAITAKFTEYLRRAEEIRAVLDEGGGGGGANGGDAAVATRPKTKGKDGEGGGDDSEQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDLKARQHMFKVHLGDTPHNLNESDFENLARRTDGFSGSDIAVCVKDVLFEPVRKTQDAMFFFKADGDMWMPCGPKQSGAVQTTMQELASKGLAAKILPPPISRTDFEKVLARQRPTVSKKDLEVHERFTKEFGEEG

SEQ ID NO: 1860 - protein, 436 aa, Sorghum bicolor
MYSNFKEQAIEYVKQAVQEDNAGNYVKAFPLYMNALEYFKTHLKYEKNPKIKEAITAKFTEYLRRAEEIRAVLDEGGAGPGSNGGDAAVATRPKTKGKDNGDGGNGGDDSEQSKLRAGLNSAIITEKPNVKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDLKARQHMFKVHLGDTPHSLTESDFESLARRTDGFSGSDIAVCVKDVLFEPVRKTQDAMFFFKADGDMWMPCGPKQPGAVQTTMQELASKGLAAKILPPPISRTDFEKVLSRQRPTVSKKDLEVHERFTKEFGEEG

SEQ ID NO: 1861 - protein, 434 aa, Glycine max
MYSNFKEQAIEYVKQAVDEDNKGNYAKAFQLYMNALEYFKTHLKYEKNPKIKEAITQKFTEYLRRAEEIRAVLDDGPSGPASSGDAAVATRPKTKPKDGGKDGDGEDPEQAKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESAPSIIFVDEIDSLCGQRGEGNESEASRRIKTELLVQMQGVGHNDQKVLVLAATNTPYALDQAIRRRFDKRIYIPLPDLKARQHMFKVHLGDTPHNLAESDFEHLARKTEGFSGSDISVCVKDVLFEPVRKTQDAMFFFRNPEDMWIPCGPKQQSAVQTTMQDLAAKGLASKILPPPISRTDFDKVLARQRPTVSKSDLDVHERFTKEFGEEG

SEQ ID NO: 1862 - protein, 434 aa, Glycine max
MYSNFKEQAIEYVKQAVDEDNKGNYAKAFQLYMNALEYFKTHLKYEKNPKIKEAITQKFTEYLRRAEEIRAVLDDGPSGPASSGDAAVATRPKTKPKDGGKDGDGEDPEQAKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESAPSIIFVDEIDSLCGQRGEGNESEASRRIKTELLVQMQGVGHNDQKVLVLAATNTPYALDQAIRRRFDKRIYIPLPDLKARQHMFKVHLGDTPHNLAESDFEHLARKTEGFSGSDISVCVKDVLFEPVRKTQDAMFFFRNPEGMWIPCGPKQQGSVQTTMQDIAAKGLASKILPPPISRTDFDKVLARQRPTVSKSDLDVHERFTKEFGEEG

SEQ ID NO: 1863 - protein, 443 aa, Glycine max
MYSNFKEQAIEYVKQAVQEDNAGNYAKAFPLYMNALEYFKTHLKYEKNPKIKEAITQKFTEYLRRAEEIRAVLDDGGPGPASNGDAAVAARPKTKPKDGESGGGGDGEDPEQAKLRAGLNSAIIREKPNVKWNDVAGLESAKQALQEAVILPVKFPQFFTGKRRPWRAFLLYGPPGTGKSYLAKAVATEAESTFFSVSSSDLVSKWMGESEKLVSNLFEMARESAPSIIFIDEIDSLCGQRGEGNESEASRRIKTELLVQMQGVGHNDQKVLVLAATNTPYALDQAIRRRFDKRIYIPLPDLKARQHMFKARTIYLIVHLGDTPHNLTESDFEYLASRTEGFSGSDISVCVKDVLFEPVRKTQDAMFFLKNPEGMWIPCGPKQQGAVQTSMQELAAKGLASKILPPPITRTDFEKVLARQRPTVSKADLDVHERFTKEFGEEG

SEQ ID NO: 1864 - protein, 440 aa, Selaginella moellendorffii
MYSNFKEQAIEYVKQAVVEDNAGNYAKAFPLYMNALEYFKTHLKYEKNPKIKEAITQKFTEYLRRAEEIRAVIDDGGPGGGGAAPNGGDAGLATKAKSSKKGGEDGDGEDPEQAKLRSGLNSAIIREKPDVKWSDVAGLESAKQALQEAVILPVKFPQFFTGKRRPWRAFLLYGPPGTGKSYLAKAVATEADSTFYSISSSDLVSKWMGESEKLVANLFQMARDSAPSIIFIDEIDSLCGQRGEGNESEASRRIKTELLVQMQGVGNNDQKVLVLAATNTPYSLDHAVRRRFDKRIYIPLPDLKARQHMFKVHLGDTPSNLSERDFEDLAKRTEGFSGSDIAVCVKDVLFEPVRKTQDAMHFKRLKTKEGEFLVPCAPLTPGAIQTTMQELATKGLAAQILPPPISKADFDKVLARQRPTVSKDDLEIHEKFTKEFGEEG

SEQ ID NO: 1865 - protein, 439 aa, Picea glauca
MYSNFKEQAIEYVRQAVQEDNAGNYAKAFPLYMNALEYFRTHLKYEKNPKIKEAITQKFTEYLRRAEEIRVVLDEGVGSRPSANGDAAVATKPKSKPGAKGDGDGDGEDPEQAKLRSGLNSAIIREKPNVKWTDVAGLESAKQALQEAVILPVKFPQFFTGKRKPWRAFLLYGPPGTGKSYLAKAVATEADSTFYSISSSDLVSKWMGESEKLVSNLFQMARDCAPSIIFIDEIDSLCGQRGEGNESEASRRIKTELLVQMQGVGNNDQKVLVLAATNTPYALDQAIRRRFDKRIYIPLPDLKARQHMFKVHLGDTPNNLTEGDFEDLARRTDGFSGSDISVCVKDVLFEPVRKTQDAMFFSKVSTKDGEMWMPCGPRQPGAVQTTMQELAVKGLASQILPPPISKADFDKVLARQRPTVSKHDLEVQERFTKEFGEEG

SEQ ID NO: 1866 - protein, 433 aa, Fragaria vesca
MYSNFKEQAIEYVKQAVHEDNNGNYAKAFPLYMNALEYFKTHLKYEKNPKIKEAITQKFTEYLRRAEEIRAVLDDGGPGPASNGDAAVATRPKTKPKDGEGGDGEDPEQAKLRAGLNSAIIREKPNVKWNDVAGLESAKQALQEAVILPVKFPQFFTGKRRPWRAFLLYGPPGTGKSYLAKAVATEADSTFFSISSSDLVSKWMGESEKLVSNLFQMARDSAPSIIFVDEIDSLCGQRGEGNESEASRRIKTELLVQMQGVGTTDQKVLVLAATNTPYALDQAIRRRFDKRIYIPLPDVKARQHMFKVHLGDTPNNLTESDFESLARKTEGFSGSDVAVCVKDVLFEPVRKTQDAMFFYKNSDNMFIPCGPKQPGAVQITMQELAAQGLASQILPPPITKTDFDKVLARQRPTVSKGDLEVHERFTKEFGEEG

SEQ ID NO: 1867 - protein, 435 aa, Saccharum officinarum
MYSNFKEQAIEYVKQAVQEDNAGNYVKAFPLYMNALEYFKTHLKYEKNPKIKEAITAKFTEYLRRAEEIRAVLDEGGAGPGPNGGDAAVATRPKTKGKDGDGGNGGDDSEQSKLRAGLNSAIITEKPNVKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDLKARQHMFKVHLGDTPHSLTESDFESLARRTDGFSGSDIAVCVKDVLFEPVRKTQDAMFFFKADGDMWMPCGPKQPGAVQTTMQELASKGLAAKILPPPISRTDFEKVLSRQRPTVSKKDLEVHERFTKEFGEEG

SEQ ID NO: 1868 - protein, 112 aa, Helianthus annuus
  misc_feature (111)..(111): Xaa can be any naturally occurring amino acid
MYSNFKEQAIEYVKQAVQEDNAGNYAKAFPLYMNALEYFKTHLKYEKNPKIREAITQKFTEYLRRAEEIRAVLDDGGAGPAANGGDAAVAARPKTKPKDGEGGGGDVRRFXT

SEQ ID NO: 1869 - protein, 434 aa, Helianthus annuus
  misc_feature (80)..(80): Xaa can be any naturally occurring amino acid
  misc_feature (363)..(363): Xaa can be any naturally occurring amino acid
  misc_feature (365)..(365): Xaa can be any naturally occurring amino acid
MYSNFKEQAIIYVKQAVEEDTAGNYAKALTLYMNALEYFKTHLKYEKNPKLKEAITQKFTDYLRRAEEIRDVLEGGGGGXPGSNGGETGVATKPKSGKKGDGDGGEDAEVSKLRSGLDSAIIREKPNVKWNDVAGLQGAKQALQEAVILPVKFPQFFVGKRRPWRAFLLYGPPGTGKSYLAKAVATEADSTFFSISSSDLVSKWMGESEKLVSNLFQMARESAPSIIFIDEIDSLVGQRGEGNESEASRRIKTELLVQMQGVGNDDKKVLVLAATNTPYSLDQAIRRRFDKRIYIPLPDLKARQHMFKVHLGDTPHSLTDRDFEQLAYKTEGFSGSDIAVCVNEVLFEPVRKTQDAMFFIKKXDXTWVPCGPRHPGAIEITMQDLATRGEASKIIPPPISRTDFDKVLARQKPTVSKSDLEVHDRFTREFGEEG

SEQ ID NO: 1870 - protein, 435 aa, Panicum virgatum
MYSNFKEQAIEYVKQAVQEDNAGNYVKAFPLYMNALEYFKTHLKYEKNPKIKEAITAKFTEYLRRAEEIRAVLDDGGAGPGANGGDAAVATRPKTKGKDGDGGNGGDDSEQSKLRAGLNSAIITEKPNIKWNDVAGLESAKQALQEAVILPVKFPQFFTGKRKPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDLKARQHMFKVHLGDTPHSLTESDFESLARRTDGFSGSDIAVCVKDVLFEPVRKTQDAMFFFKADGDMWMPCGPKQQGAIQTTMQELASKGLAAKILPPPISRTDFEKVLSRQRPTVSKKDLEVHERFTKEFGEEG

SEQ ID NO: 1871 - protein, 432 aa, Solanum lycopersicum
MYSNFKEQAIEYVRQAVQEDNSGNYAKAFPLYMNALEYFKTHLKYEKNPKIKEAITQKFTEYLRRAEEIRAVLDEGGSGPGPNGGDAAVIAKPKTKPKDGEDGEDPEQSKLRAGLNSAIVREKPNVKWNDVAGLESAKQALQEAVILPVKFPQFFTGKRRPWRAFLLYGPPGTGKSYLAKAVATEAESTFFSVSSSDLVSKWMGESEKLVSNLFQMARESAPSIIFVDEIDSLCGQRGEGNESEASRRIKTELLVQMQGVGHNDDKVLVLAATNTPYSLDQAIRRRFDKRIYIPLPDLKARQHMFKVHLGDTPHNLNECDFEDLARKTEGFSGSDVSVCVKDVLFEPVRKTQDAVFFTQTSNGTWIPCGPKQRGAVQTTMQELAAKGLASQIIPPPITKTDFDKVLARQRPTVSKSDLEVHDRFTKEFGEEG

SEQ ID NO: 1872 - protein, 436 aa, Solanum lycopersicum
MYSNFKEQAVAYVKQAVEEDNAGNYAKAFSLYMNALEYFKTHLKYEKNPKIKEAITQKFVEYLRRAEEIRSVLDEGGGGPTSNGDAAVASRAKSKPKNGGGGGGEGDDSENVKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESSPSIVFIDEIDSLCGQRGEGSESEASRRIKTELLVQMQGVGHDDDKKVLVLAATNTPYSLDQAIRRRFDKRIYIPLPDLKARQHMFKVHLGDTPHNLTESDFEQLARKTEGFSGSDISVCVNEVLFEPVRKTQDAEFFIKTSDGLWVPCGPRQPGAIQTNMQELAAKGLASKITPPPISIRDFDRVLWKQKPTVSKADLEVHERFTKEFGEEG

SEQ ID NO: 1873 - protein, 433 aa, Triphysaria pusilla
MYSNFKEQAIEYVRQAVSEDNAGNYAKAFPLYMNALEYFRTHLKYEKNPKIKEAITQKFQEYLRRAEEIRAVLDDGGSGPASNGDAAVAARPKTKPKDGGGNDGEDGDKEKLRAGLNSAIVREKPNVKWNDVAGLESAKQALQEAVILPVKFPQFFTGKRRPWRAFLLYGPPGTGKSYLAKAVATEADSTFFSISSSDLVSKWMGESEKLVSNLFQMARESSPSIIFIDEIDSLCGQRGEGNESEASRRIKTELLVQMQGVGHNDDKVLVLAATNTPYALDQAIRRRFDKRIYIPLPDPKARQHMFKVHLGDTPHNLTESDFEVLGRKTEGFSGSDVSVCVKDVLFEPVRKTQDAMFFVNTSNGVWMPCGPKQPGAIQITMQELAAQGLAAQITPPPISKTDFDKVLARQRPTVSKTDLDVHERFTKEFGEEG

SEQ ID NO: 1874 - protein, 438 aa, Triticum aestivum
MYSNFKEQAIEYVKQAVQEDNAGNYVKAFPLYMNALEYFKTHLKYEKNPKIKEAITAKFTEYLRRAEEIRAVLDEGGGGPPGAPNGGDAAVATRPKTKGKDGGGDGAGGDDSEQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGTRGEGNESEASRRIKTELLVQMQGVGHNDDKVLVLAATNTPYALDQAVRRRFDKRIYIPLPDAKARQHMFKVHLGDTPHSLSESDFEVLGRRTEGFSGSDVAVCVKDVLFEPVRKTQDAMYFFKIDGDMWMPCGPKQPGAVQTTMQDLASKGLASQILPPPISKNDFEKVLARQRPTVGKKDLEVHEKFTKEFGEEG

SEQ ID NO: 1875 - protein, 1206 aa, Zea mays
MVRLLGLRSLSFGPEDSPREIPSTADVAPPVGSSGWLVRFFDSAFFCEWIAVSYLYKHDHAGVRDYLCNRMYTLPLPGLEAYLFQVCYMLVHKPSPSLDRFVIDTCAKSLRIALKVHWLLAAELELEDADDLDGIDKVQEQCQVAATVQGEWPPLVRPSPPSPAASPRGNPMLSRIRSSKQRLLSLASSPSLGLSPPAGGGVNVAEDAMGTGGKQPATPSSEDNKLLKRLSIGPKMRDALLFRRSGEKDEEQDRDGFFKRLLRDSRDKEEEDGDREGFFKRLLSREKDNEEEESDRDGFFRRLLRDSKEEDMELTPSSDGLLKRLFRDKEDRQGEDDEKEGFFRRMFKDKNEERRDSSHARHGNEERLGKSVEDDDREGFFRKIFKDKNEERKDEGHQKPDEREKVGANIEDDKRDGFFRQLFKEKNDEKKEGSTPSKKEEDDKGHKNADDDNFFRRLFKDKNEEKKGIVHDRNEDDKCEEGDKENFFRKLFKDKHEERRTEGPDKNDDYGKGSSGIEEEDNPEFLSFRRLFRVHPEDSKSGHIESSQSNNLSEGSPGSESFFKRLFRDRDRSLEDSEIFGSKMAKEARIWSHKHPGTTGINEKQSGKPPLPINAVAELRKGSYYASLELVQALCDTSYGLVDIFPIEDRKIALRESLTEINSQIASAEKNGGVCFPMGKGIYRVVHIPEDESVLLNSREKAPYLICVEVLKAEAPSHSKGSSDGHKLSKGGIPLANGDVQLPKPPPWAYPLWSRHETQNYETDRMLKSTSQVIDQAMAQLWETKVKFVNVSFSIEKLGRSRSIVLSETGRRLRHDATDSHDPPGDSQTVADQPIEWVKVTLSAVPGVNMEDVDDNEPTRKKDHRRVPSTIAIEEVKAAALKGEAPPGLPLKGVAQSTQNLDPKATDGGDPKPTDALAGELWAVKRERIRRSSVHGKSPGWDLRSIIVKSGDDCRQEHLAVQLVAHFYDIYQEAGLPLWLRPYEVIVTSAYTALIETIPDTASIHSVKSRFPNISSLRDYYVAKYEENSPNFKLAQRNFVESMAGYSILCYLLQVKDRHNGNLLIDEEGHIIHIDFGFILSNSPGGVNFESAPFKLTRELLEVMDSDAEGTPSEFFDYFKVLCIQGFLTCRKHAERIILLVEMLQDSGFPCFKGGPRTIQNLRKRFHLSLTEEQCVSLVLSLISSSMDAWRTRQYDYYQRVLNGIL

SEQ ID NO: 1876 - protein, 1215 aa, Oryza sativa
MVRLLGLRSLSFGPEESPREITVAGGGGGDAAAHPVGSSGWLVRFFDSAFFCEWIAVSYLYKHDHQGVRDYLCNRMYTLPLPGLEAYLFQVCYMMVHKPSPSLDRFVIDTCSKSLRIALKVHWLLAAELELEDTDDLDGIDRVQEQCQAAATVQGEWPPLVRPAPPSPIASPRGNPMLSRIRSSKQRLLSLASSPSLGLSPPAGASNAAAAEDVGGSGVKQPATPSSEDNKLLKRLSIGPKVRDAASFFRRSVEKDDEQDKEGFFKRLLRDSKDKEEEDGDKEGFFKRLLSKEKENEEEEGDRDGFFRRLLRDSKDEDMELTPSSEGLLKRLFRDKEDRQGDDEEKEGFFRRIFKDKNEERRESLHGRHGDEERVGKSLEDDDKEGFFRKIFKDKNEERKDGGHSKQQDDKEKTAGNIEDDKRDGFFRQLFKEKNEEKKEGTTPNKKEEDDKGHRTMDDENFFRRLFKDKNEEKKGAAHDRNDDDKCEEGDKENFFRKLFKDKHEERRSDGLDKHDDDGKGTSGIDDEENSEFLSFRRLFRVHPEDAKSGHIESCQPNGISEGSPGSESFFKRLFRDRDRSLEDSELFGSKLLKEARHQLPEKNSVPTGNGDKQSGKPPLPNNAIAELRKGCYYASLELVQSLCDTSYGLVDIFPMEDRKIALRESLTEINSQIASTEKNGGVCFPMGKGIYRVVHIPEDEAVLLNSREKAPYLICVEVLKAEAPSHSKGSSDVNKLSKGGIPLANGDVQLPKPPPWAYPLWSRHETQNYETDRMLKSTSQVIDQAMAQLWEAKVKFVNVSFSVEKLGRSRSVAISDSGHRSRQSTADSNEPSGDSQPIADQPIEWVKVTLSAVPGVNMDDVDDNEPTRKKDHRRVPSTIAIEEVKAAALKGEAPPGLPLKGVGQNAQNIESKATDGGDPKPTDALAGELWAVKRERIRRSSVHGKLPGWDLRSVIVKSGDDCRQEHLAVQLVAHLYDIYQEAGLPLWLRPYEVIVTSAYTALIETIPDTASIHSIKSRFPDITSLRDYYVAKYEENSPNFKLAQRNFVESMAGYSILCYLLQVKDRHNGNLLIDEEGHIIHIDFGFMLSNSPGGVNFESAPFKLTRELLEVMDSDAEGTPSEFFDYFKVLCIQGFLTCRKHAERIILLVEMLQDSGFPCFKGGPRTIQNLRKRFHLSLTEEQCVSLVLSLISSSMDAWRTRQYDYYQRVLNGIL

SEQ ID NO: 1877 - protein, 269 aa, Aquilegia formosa
MGFAQLVIGPAGSGKSTYCSSLHQHCETVGRTIHIVNLDPAAENFDYPVAMDIRELISLDDVMEELSLGPNGGLMYCMEHLEENLDDWLTEELDNYLDDDYLVFDCPGQIELLSHVPVLRNFVEHLKRKNFNVCVVYLLDSQFITDVTKFISGCMASLSAMIQLELPHVNILSKMDLVTNKKDIDDYLNPVSSILLSELNQRMAPQYEKLNKALMELLDDFNMVSFLPLDLRKESSIQYVLSQIDFCIQYGEDADVKVKDFDVDGEDDD

SEQ ID NO: 1878 - protein, 257 aa, Persea americana
MGYAQLVIGPAGSGKSTYCSSLYRHCETIRRTVHIVNLDPAAESFDYPVAMDIRELICLDDVMEELGLGPNGGLIYCMEHLEENLDDWLADELENYLDDDYLVFDCPGQIELFSHVPVLRNFVDHLKRKSFNVCAVYMLDSQFMTDVTKYISGCMASLSAMIQLELPHINILSKMDLVRNKRHLEDFLNPEAQLLLSNLNQHMAPQFAKLNKALAELVDEFSMVSFLPLDLRKETSIQYVLSHIDSCIQYGEDADVK

SEQ ID NO: 1879 - protein, 251 aa, Brachypodium distachyon
STYCSGLYQHCETVGRRIHMVNLDPAAEHFSYPVATDIRELISLDDVMEELGMGPNGGLIYCMEHLEDNLDDWLDEQLENYLDDDYLVFDCPGQIELFTHVPVLRNFVEHLKRKNFTVCAVYLLDSQFVSDVTKYISGCMASLSAMIQLELPHINILSKMDLVSNKKDVEEYLNPEAQVLLSQLNRHMAPRFGKLNKALAELVDDYSMVNFIPLDLRKESSIQYVLSCIDNCIQYGEDADVRVRDFIPEED

SEQ ID NO: 1880 - protein, 267 aa, Ricinus communis
MGYAQLVIGPAGSGKSTYCSSLYQHCETVGRSIHIVNLDPAAENFDYPVSMDIRELISLDDVMEELGLGPNGALMYCMDELEDNLDDWLSEELDNYMDDDYLVFDCPGQIELFSHVSVLRNFVEHLKRKNFNVCAVYLLDSQFITDVTKFISGCMASLSAMIQLELPHVNILSKMDLVTNKKDIEDYLNPESRVLLSELNKRMAPQFVKLNKALIELVDEYSMVSFVPLDLRKESSIQYVLAQIDNCIQFGEDADVKIKDFDPEDDE

SEQ ID NO: 1881 - protein, 268 aa, Centaurea maculosa
MGYAQLVIGPAGSGKSTYCSSLYQHCEATRRTIHIVNLDPAAENFDYPVAIDIRELISLDDVMEELGLGPNGALMYCMEHLEENLDEWLSEELENYMEDDYLVFDCPGQIELFSHVPVLKNFVEHLQRKNFNVCCVYLLDSQFITDVTKFISGCMASLSAMVQLELPHVNILSKMDLVTRKRDIEDYLNPEPQVLLSELNERMAPQFQKLNKALIDLVDQYSMVSFVPLDLRKESSIQYVLSQIDNCIQFGEDADVKIRDFDQDEDQD

SEQ ID NO: 1882 - protein, 267 aa, Castanea mollissima
MGYAQLVIGPAGSGKSTYCSSLYRHCETMQRSIHIVNLDPAAENFDYPVAMDIRELINLDDVMEELGLGPNGGLMYCMEHLEDNLDDWLTEELDNFLDDDYLVFDCPGQIELFSHVPVLRNFVEHLKRKNFNVCGVYLLDSQFMTDVTKFISGCMASLSAMIQLELPHVNILSKMDLVTNKKDVEDFLNPEPQFLLSELNQRMAPQFAKLNKALIELVDGFSMVSFVPLDLRKERSIQYVLAQIDNCIQYGEDAEVKIKDFDPEDDD

SEQ ID NO: 1883 - protein, 268 aa, Citrus sinensis
MGYAQLVIGPAGSGKSTYCSSLYRHCETVRRTMHIVNLDPAAENFDYPVAMDIRELISLEDVMEELGLGPNGGLIYCMEHLEDNLDDWLAEELDNYLDDDYLVFDCPGQIELFTHVPVLRNFVDHLKSRNFNVCAVYLLDSQFITDVTKFISGCMASLSAMVQLELPHVNILSKMDLVTNKKEIEDYLNPESQFLLSELNQHMAPQFAKLNKSLIELVDEYSMVSFMPLDLRKESSIRYVLSQIDNCIQWGEDADLKIKDFDPEDDDE

SEQ ID NO: 1884 - protein, 201 aa, Gossypium hirsutum
  misc_feature (174)..(176): Xaa can be any naturally occurring amino acid
  misc_feature (180)..(181): Xaa can be any naturally occurring amino acid
  misc_feature (186)..(186): Xaa can be any naturally occurring amino acid
MGYAQLVIGPAGSGKSTYCSSLYQHCETLGRSIHIVNLDPAAENFDYPVAMDIRELISLDDVMEELGLGPNGGLIYCMEHLEDNLDDWLNEELDNYLDDDYLVFDCPGQIELFSHVPVLRNFVEHLKRKNFNVCAVYLLDSQFITDVTKYVSGCMASLSAMVQLEVPHINILSXXXPLPXXQEGCXKLLGSRASSFTVRVE

SEQ ID NO: 1885 - protein, 267 aa, Actinidia deliciosa
MGYAQLVIAPAGSGKSTYCSSLYQHCETMRRTIHIVNLDPAAENFDYPVAMDIRELISLDDVMEELGLGPNGGLMYCMEHLEENLDEWLTEELDNYMDDDYLVFDCPGQIELFSHVPVLKNFVEHLKRKNFNVCVVYLLDSQFMTDVTKFISGCMASLSAMVQLELPHVNILSKMDLVANKRDIEEYLNPEPQFLLSELNQRMAPQFEKLNKALIDVVDQYSMVSFVPLDLRKESSIQYILSQIDVSIQYGEDADVKVKDFDPEDDD

SEQ ID NO: 1886 - protein, 267 aa, Leymus cinereus x Leymus triticoides
  misc_feature (35)..(35): Xaa can be any naturally occurring amino acid
MGFAQLVIGPAGSGKSTYCSGLYQHCETVGRRIHXVNLDPAAEHFSYPVSTDIRELISLDDVMEELGMGPNGGLIYCMEHLEDNLDDWLDEQLENYLDDDYLVFDCPGQIELFTHVPVLRNFVEYLKRKNFTVCAVYLLDSQFVSDVTKYISGCMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEEED

SEQ ID NO: 1887 - protein, 267 aa, Carica papaya
MGYAQLVIGPAGSGKSTYCSSLYQHCETVGRTIHVVNLDPAAENFDYPVAMDIRELISLDDVMEELGLGPNGGLMYCMEHLEDSLDDWLTEELDNYMDDDYLVFDCPGQIELFSHVPVLKNFAEHLKRRNFNVCAVYLLDSQFITDVTKFISGCMASLSAMIQLELPHVNILTKMDLVTNKRDLEDYLNPDSQILLSQLNQQMAPQFAKLNKSLIDLVDEYNMVSFVPLDLRKESSIKYVLAQIDNCIQFGEDADVKVKDFDPEDDE

SEQ ID NO: 1888 - protein, 267 aa, Solanum tuberosum
MGYAQLVIGPAGSGKSTYCSSLYQHCETTRRTIHIVNLDPAAENFDYPVAMDIRELISLDDVMEELGLGPNGGLMYCMEHLEENLDEWLTEELENYLDDDYLVFDCPGQIELFSHVPVLKNFVEHLRRKNFNVCVVYLLDSQFITDVTKFISGCMASLSAMVQLELPHVNILSKMDLVTNKKEVENYLNPEPHLLLAELNQRMAPQFQKLNKSLIEVVDQYSMVSFIPLDLRKESSIQYILSQIDNCIQYGEDADVKVKDFDPEEDD

SEQ ID NO: 1889 - protein, 267 aa, Pseudoroegneria spicata
MGFAQLVIGPAGSGKSTYCSGLYQHCETVGRRIHMVNLDPAAEHFSYPVSTDIRELISLDDVMEELGMGPNGGLIYCMEHLEDNLDDWLDEQLENYLDDDYLVFDCPGQIELFTHVPVLRNFVEYLKRKNFTVCAVYLLDSQFVSDVTKYISGCMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEEDD

SEQ ID NO: 1890 - protein, 265 aa, Oryza sativa
MGYAQLVIGPAGSGKSTYCSSLYQHCETVGRTIHMVNLDPAAEHFSYPVSTDIRELISLDDVMEELGMGPNGGLIYCMEHLEDNLDDWLDEQLDGYLDDDYLVFDCPGQIELFTHVPVLRNFVEHLKRKNFNVCAVYFLDSQFVSDVTKYISGCMASLSAMIQLELPHINILSKMDLVANKKDVEEYLNPEAQVLLSQLNRQMAPKFGKLNKSLAELVDDYSMVNFIPLDLRKESSIQYVLSHIDNCIQYGVDADVKVRDFDPED

SEQ ID NO: 1891 - protein, 279 aa, Oryza sativa
MGYAQLVIGPAGSGKSTYCSSLYQHCETVGRTIHMVNLDPAAEHFSYPVSTDIRELISLDDVMEELGMGPNGGLIYCMELLKLLTDPSENHRHLEDNLDDWLDEQLEGYLDDDYLVFDCPGQIELFTHVPVLRNFVEHLKRKNFNVCAVYLLDSQFVSDVTKYISGCMASLSAMIQLELPHINILSKMDLVSNKKDVEEYLNPEAQVLLSQLNRQMAPNFGKLNKSLAELVDDYSMVNFIPLDLRKESSIQYVLSHIDNCIQYGEDADVKVRDFDPEED

SEQ ID NO: 1892 - protein, 268 aa, Saccharum officinarum
MGYAQLVIGPAGSGKSTYCSSLYDHCQTVGRTIHIVNLDPAAEHFDYPVDMDIRELISLDDVMEEIGLGPNGGLIYCMEHLEDNLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKEVEEYLDPNAQVLLSQLNRQMAPRFGKLNKCLAELVDDYSMVNFIPLDLRKESSIQYVLSYIDTCIQYGEDADVKVRDFEPIEDED

SEQ ID NO: 1893 - protein, 268 aa, Saccharum officinarum
MGYAQLVIGPAGSGKSTYCSSLYDHCQTVGRTIHIVNLDPAAEHFDYPVDMDIRELISLDDVMEEIGLGPNGGLIYCMEHLEDNLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKEVEEYLDPNEQVLLSQLNRQMAPRFGKLNKCLAELVDDYSMVNFIPLDLRKESSIQYVLSYIDTCIQYGEDADVKVRDFEPIEDED

SEQ ID NO: 1894 - protein, 268 aa, Helianthus annuus
MGYAQLVIGPAGSGKSTYCSSLYQHCETTRRTIHIVNLDPAAENFDYPVAMDIRELISLDDVMEELGLGPNGGLLYCMEHLEENLDEWLNEELENFMEDDYLVFDCPGQIELFSHVPVLKNFVEHLQRKNFNVCAVYLLDSQFITDVTKFISGCMASLSAMVQLELPHVNILSKMDLVTRKRDIEDYLNPEPQTLLAELNQRMGPQFQKLNKALIELVDQYSMVSFVPLDLRKESSIQYVLSQIDTCIQFGEDADVKIKDFDEDEDED

SEQ ID NO: 1895 - protein, 268 aa, Panicum virgatum
MGYAQLVIGPAGSGKSTYCSSLYDHCQTVGRSIHIVNLDPAAEHFNYPVDMDIRELISLDDVMEDFGMGPNGGLIYCMEHLEDSLDDWLDEQLENYLDDDYLVFDCPGQIELFTHVPVLRNFVEHLKRKNFNVCAVYLLDSQFVSDVTKYISGCMASLSAMIQLELPHVNILSKMDLVSNKKDIEEYLDPNAQVLLSQLNRQMAPRFGKLNKSLAELVDDYNMVNFIPLDLRKESSIQYVLSYIDSCIQYGEDADVKVRDFDPPEDDD

SEQ ID NO: 1896 - protein, 267 aa, Nicotiana tabacum
  misc_feature (260)..(260): Xaa can be any naturally occurring amino acid
MGYAQLVIGPAGSGKSTYCSSLHQHCETTRRTIHIVNLDPAAENFDYPVAMDIRELISLDDVMEELGLGPNGGLMYCMEHLEENLDEWLTEELDNYLDDDYLVFDCPGQIELFSHVPVLKNFVEHLRRKNFNVCVVYLLDSQFITDVTKFISGCMASLSAMVQLELPHVNILSKMDLVTNKKDVENYLDPEPQLLLAELNKRMAPQFQKLNKSLIEVVDQYSMVSFLPLDLRKESSIQYILSQIDNCIQYGEDADVKVKXFDPEEDD

SEQ ID NO: 1897 - protein, 267 aa, Solanum lycopersicum
MGYAQLVIGPAGSGKSTYCSSLYQHCETTRRTIHIVNLDPAAENFDYPVAMDIRELISLDDVMEELGLGPNGGLMYCMEHLEENLDEWLTEELENYLDDDYLVFDCPGQIELFSHVPVLKNFVEHLRRANFNVCVVYLLDSQFITDVTKFISGCMASLSAMVQLELPHVNILSKMDLVTNKKEVENYLNPEPHLLLAELNQRMAPQFQKLNKSLIEVVDQYSMVSFIPLDLRKESSIQYILSQIDNCIQYGEDADVKVKDFDQEEDD

SEQ ID NO: 1898 - protein, 267 aa, Triticum aestivum; identical to SEQ ID NO: 1889

SEQ ID NO: 1899 - protein, 267 aa, Triticum aestivum
MGFAQLVIGPAGSGKSTYCSGLYQHCETVGRRIHMVNLDPAAEHFSYPVSTDIRELISLDDVMEELGMGPNGGLIYCMEHLEDNLDDWLDEQLENYLDDDYLVFDCPGQIELFTHVPVLRNFVEYLKRKNFTVCAVYLLDSQFVSDVTKYISGCMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEDDD

SEQ ID NO: 1900 - protein, 138 aa, Festuca arundinacea
MSASVMASLALKPSPPPLWERSKIRGVRPSARPSLLIVASKVKKIQTAQPYGPGGGADFKDGLDASGRVAKGKGVYQFANKYGANVDGYSPIYTPEEWSPGGDVYVGGKTGLFLWAVTLAGILLGGALLVYNTSALAS

SEQ ID NO: 1901 - protein, 139 aa, Pseudoroegneria spicata
MSASVMASLFLKPSPSPLLERAKLRGVRPSARPSLLIVASKKAKKVQTAQPYGPGGGVVFKEGVDASGRAAKGKGVYQFADKYGANVDGYSPIYTPEEWSPSGDVYVGGKTGLFLWAVTLAGILLGGALLVYNTSALAS

SEQ ID NO: 1902 - protein, 137 aa, Oryza sativa
MAASVMASLALKPSASPLLERSKLRGKGTMARPSLIIVAKKAKKIQTSQPYGPAGGVVFKEGVDASGRVAKGKGLYQFSNKYGANVDGYSPIYTPEEWSSTGDVYVGGKAGLLLWAITLAGILVGGAILVYNTSALA

SEQ ID NO: 1903 - protein, 139 aa, Triticum aestivum
MSASVMASLVLKPSPSPLLERAKLRGARPSARPSLLIVASKKAKKVQTAQPYGPGGGVVFKEGVDASGRVAKGKGVYQFADKYGANVDGYSPIYTPEEWSPSGDVYVGGKTGLFLWAVTLAGILLGGALLVYNTSALAS

SEQ ID NO: 1904 - protein, 140 aa, Triticum aestivum
MSASVMASMVLTKPSPSPLLERAKLRGLRPSARPSLLIVASKKAKKVQTAQPYGPGGGVEFKEGVDASGRVAKGKGVYQFADKYGANVDGYSPIYTPEEWSPSGDVYVGGKTGLFLWAITLAGILLGGALLVYNTSALAS

SEQ ID NO: 1905 - protein, 140 aa, Triticum aestivum
MSASVMASLVLLKPSPSPLLGRAKLRGVRPSARPSLLIVASKKAKKVQTAQPYGPGGGVVFKEGVDASGRAAKGKGVYQFADKYGANVDGYSPIYTPEEWSPSGDVYVGGKTGLFLWAVTLSGILLGGALLVYNTSALAS

SEQ ID NO: 1906 - protein, 87 aa, Triticum aestivum
MSASVMASLVLKPSPSPLLERAKLRGARPSARPSLLIVASKKAKKVQTAQPYGPGGGVVFKEGVDASGRVAKGKGVYQVCRQVWSKR

SEQ ID NO: 1907 - protein, 57 aa, Triticum aestivum
MEQTLMGTARYIHQEEWSPIGDVYFGGKTRLFLWAVTLAGILLGGALLVYNTNALVS

SEQ ID NO: 1908 - protein, 280 aa, Zea mays
MARRSLALLLASSLALMAAAVASADSWLYDKFNTDGTVRTQYDASGQEVAMLSLDRSSGAGFNSKEQYLYGEFSVQMKLIPGNSAGTVSCFYLSSGDGDGHDEIDMEFMGNASGQPVVLNTNVWASGDGKKEHQFDLWFDPSADYHTYTIIWNPTNILFKVDGDVIRCFKRYADLPYPSARPMALHATLWDGSYWATEKGKVPVDWSAAPFVVSYRGYSANACVSGGACGGGGDDGWMSKQPDDAEWGTVRWAESNYMRYNYCDDGWRFPQGLPPECSRS

SEQ ID NO: 1909 - protein, 277 aa, Sorghum bicolor
MAPRSLGVLAVALALLQAASAKSWLGAKFTTDGTVREGYDSSGQQVVMLSLDQHSGAAGFNSKEQYLYGEFSIEMKLIRGNSAGTVSCFYLSSGDGDGHDEIDMEFMGNATGQPVVLNTNVWANGDGKKEHQFDLWFDPAADYHTYTIIWNPTNILFKVDNLFIRSFKRYADLAYPSSKPMTLHATLWDGSYWATEKGKMPIDWSGAPFVVSYRSYAANACVSGGACRTGRDGWMHRQLDNAEWGTVRWAEKNFMRYNYCQDGWRFPQGLPAECSRH

SEQ ID NO: 1910 - protein, 277 aa, Saccharum officinarum
MERRSLALFASFALMMAAVASAESWLYEKFNTDGTVRANYDASGQQVAMLNLDRSSGAGFNSKEQYLFGEFTIQMKLIPGNSAGTVSCFYLSSGDGDGHDEIDMEFMGNSSGQPVVLNTNVWANGDGKKEHQFDLWFDPAADYHTYTITWNPTNIIFKVDGNVIRCFKRYADLPYPSSKPMTLHATLWDGSYWATEKGKVPIDWSGAPFVVSYRGYSADACVSGGACAAGSDAWMNKQPDSAEWGTVKWAESNYMRYNYCDDGWRFPQGLPAECSRS

SEQ ID NO: 1911 - protein, 279 aa, Panicum virgatum
MAARLPPLALLAASLAVMAAVASADSWLYEKFNTDGTVRADYDASGQQVAMLNLDRSSGAGFNSKEQYLYGEFSIQMKLIPGNSAGTVSCFYLSSGDSDDHDEIDMEFMGNSSGQPVVLNTNVWASGDGKKEHQFDLWFDPAADYHTYTIVWNPTNILFKVDGTVIRCFKRYDDLPYPSSRPMALHATLWDGSYWATEKGKVSIDWAGAPFVVSYRGYSADACVSGGACPAGSDRWMNKQPDAAEWGTVKWAESNYMRYNYCEDGWRFPQGLPAECSRS

SEQ ID NO: 1912 - protein, 279 aa, Panicum virgatum
MAARRAPLALLAASVALLAAAASADSWLYEKFNTDGTVRADYDASGQQVAMLNLDRSSGAGLNSKEQYLYGEFSIQMKLIPGNSAGTVSCFYLTSGDSDDHDEIDMEFMGNSSGQPVVLNTNVWASGDGKKEHQFDLWFDPAADYHTYTIVWNPTNILFKVDGNVIRCFKRYADLPYPSSRPMALHATLWDGSYWATEKGKVPIDWAGGPFVVSYRGYSADACVSGGACPAGSDRWMNKQPDAAEWGTVKWAESNYMRYNYCEDGWRFPQGLPAECSRS

SEQ ID NO: 1913 - protein, 278 aa, Panicum virgatum
MAGRRSLALLAVSLALLQVASAARSWLTEFTTDGTVRTGYDASGQKVMMLNLDRSSGPAGFNSKEQFLYGEFSIEMKLIPGNSAGTVSCFYLSSGTDDWRDEIDMEFMGNSSGQPVVLNTNVWANGDGKKEHQFDLWFDPSADYHTYTIIWNPENILFKVDNVFIRSFKRYADLPYPSSKPMTLHATLWDGSYWATEKGKVPIDWSNAPFVVSYRSFYANACVSGGACHAGRDGWMHRQLDAAEWGTVRWAERNYMRYNYCQDGWRFSQGLPAECSRN

SEQ ID NO: 1914 - protein, 1470 aa, Ricinus communis
MGRLKLQPGIKSIEEEPEECDSSYSNKATLACMINAEVGAVLAVMRRNVRWGGRYMSGDDQLEHSLVQSLKSLRKQIFSWQHPWHTINPAVYLQPFLDVIRSDETGAPITGVALSSVYKILTLDVIDQNTVNVEDAMHLVVDAVTSCRFEVTDPASEEVVLMKILQVLLSCMKSKASVTLSNQHVCTIVNTCFRIVHQAGSKGELLQRIARHTMHELVRCIFSHLPDVDNTEHALVNGVSTVKQEIGGMDNDYTFVNKQSENGNSSSELDGQTSSVSFGSSVSTGLVPTVTEENTIGGSGKDALPYDLHLMTEPYGVPCMVEIFHFLCSLLNVVEHMGMGPRSNTIAFDEDVPLFALGLINSAVELGGPSIRHHPRLLSLIQDELFRNLMQFGLSMSPLILSMVCSIVLNLYHHLSTELKLQLEAFFACVILRLAQSRYGASYQQQEVAMEALVDFCRQKTFMVEMYANLDCDITCSNVFEDLANLLSKSAFPVNCPLSAMHILALDGLIAVIQGMAERIGNGSVSSEQAPVNLEEYIPFWMVKCDNYGDPDHWVPFVRRRKYIKRRLMIGADHFNRDPKKGLEFLQGTHLLPDKLDPQSVACFFRYTAGLDKNLVGDFLGNHDEFCVQVLHEFAGTFDFQGMNLDTALRLFLETFRLPGESQKIQRVLEAFSERYYEQSPQILANKDAALLLSYSLIMLNTDQHNVQVKKKMTEEDFIRNNRHINGGNDLPREFLSELYHSICRNEIRTTPEQGAGFPEMTPSRWIDLMLKSKKTAPFIVSDSRAYLDHDMFAIMSGPTIAAISVVFDHAEHEDVYQTCIDGFLAVAKISACHHLEDVLDDLVVSLCKFTTLLNPSSVEEPVLAFGDDTKARMATVTVFTIANRYGDYIRTGWRNILDCILRLHKLGLLPARVASDAADESELSTEPGQGKPITNSLSSVHMQSMGTPRRSSGLMGRFSQLLSLDTEEPRSQPTEQQLAAHQRTLQTIQKCHVDSIFTESKFLQAESLLQLARALIWAAGRPQKGNSSPEDEDTAVFCLELLIAITLNNRDRIVLLWQGVYEHIANIVQSTVMPCALVEKAVFGLLRICQRLLPYKENLADELLRSLQLVLKLDARVADAYCEQITQEVSRLVKANATHIRSLMGWRTITSLLSITARHPEASEAGFDALLYIMSDGAHLMPANYVLCVDAARQFAESRVAQAERSVRALDLMAGSVDCLARWSHEAKEAMGEEEAAKLLQDIGEMWLRLVQGLRKVCLDQREEVRNHALLSLQKCLTVVDGINLPHGLWLQCFDLVIFTMLDDLLEIAQGHSQKDFRNMDGTLIIAVKLLSRVFLQLLHDLAQLTTFCKLWLGVLSRMEKYLKVKVRGKKSEKLQEVVPELLKNTLLAMKAKGVLVQRSALGGDSLWELTWLHVNNIAPSLQSEVFPDQDWEQSQHKQGETIGSLASDGTGSVPSNGSVASEGSGMGG

SEQ ID NO: 1915 - protein, 1470 aa, Populus trichocarpa
MGRLKLNPGIKSIEEEPEERDAAVESNRADLLAYSINSEVSAVLAVMRRNVRWGGRYISGDDQLEDSLIQSLKTLRKQIFSWQNPWHTINPALYLQPFLDVIRSDETGAPITGVALLSVYKILTLDVIDENTVNVEDAMQLVVDAVTSCRFEVTDPSSEEMVLMKILQVLLACMKSKASVMLSNQHVCTIVNTCFRIVHQAGSKSELLQRISRHTMHELVKCIFSHLPDVESAEQTLVNGVTSHKHEIGGLDNDYAFGSKQMENGNGNSELDGQASTVSFGSNASTALVAREENAIGTGGGKDGLPFDLHLMTEPYGVPCMVEIFHFLCSLLNVVEHIGMGPRSNTIAFDEDVPLFALGLINSAIELGGPSIRCHPRLLSLIQDELFRNLMQFGLSVSPLILSMVCSIVLNLYHHLRTELKLQLEAFFSCVILRLAQSRYGASYQQQEVAMEALVDFCRQKTFMVEMYANLDCDITCSNVFEELANLLSKSAFPVNCPLSAMHILALDGLIAVIQGMAERIGNGSVSSEQGPVNLEEYTPFWMVKCDNYSDPNHWVPFVRRRKYIKRRLMIGADHFNRDPKKGLEFLQGTHLLPDKLDPQSVACFFRYTAGLDKNLVGDFLGNHDEFCVQVLHEFAWTFDFQDMNLDTALRLFLETFRLPGESQKIQRVLEAFSERYYEQSPQILANKDAALLLSYSLIMLNTDQHNVQVKKKMTEEDFIRNNRHINGGNDLPREFLTELYHSICKNEIRTTPEQGFGYPEMTPSRWIDLMHKSKKTAPFILSDSRAYLDHDMFAIMSGPTIAAISVVFDNAEHEDVYQTCIDGFLAVAKISACHHLEDVLDDLVVSLCKFTTLLNQSSVEEPVLAFGDDAKARMATVTVFTIANRYGDYIRTGWRNILDCILRLHKLGLLPARVASDAADESELAADPVHGKPITNSLSSVHMQSMGTPRRSSGLMGRFSQLLSLDTEEPRSQPTEQQLAAHQRTLQTIQKCHVDSIFTESKFLQAESLLQLARALIWAAGRPQKGNSSPEDEDTAVFCLELLIAITLSNRDRIVLLWQGVYEHIANIVQSTVMPCALVEKAVFGLLRICQRLLPYKENLADELLRSLQLVLKLDARVADAYCEQITQEVTRLVKANATHIRSLMGWRTITSLLSITARHPEASEAGFDALLFIMTDEAHLLPANYVLCVDAARQFSESRVGQAERSVRALELMAGSVNCLARWSHDAKETMGEEESAKLSQDIGEMWLRLVQGLRKVCLDQREEVRNHALLSLQKCLTGVDEINLPHGLWLQCFDLVIFTMLDDLLEIAQGHQKDYRNMEGTLIIAVKLLSKVFLQLLNELAQLTTFCKLWLGVLSRMEKYLKVKVKGKKNENLQETVPELLKNTLLAMKSRGVLVQRSALGGDSLWELTWLHVNNIAPSLQAEVFPDQDREQSHHKLGETGGSLVSDETDSVSSKESVHAEVAGTGG

SEQ ID NO: 1916 - protein, 1473 aa, Glycine max
MGRLKLQAGINAIEEEEPEECDAAYPNKTTLACMINSEIGAVLAVMRRNVRWGGRYMSGDDQLEHSLIQSFKTVRRQIFSWHHHQWQAINPALYLQPFLDVIRSDETGAPITSVALSSVYKILTLDVIDHNTVNVEDAMHLVVDAVTSCRFEVTDPSSEEVVLMKILQVLLACMKSKASIMLSNQHVCTIVNTCFRIVHQAGSKGELLQQIARYTMHELVRCIFSHLQDVGNTDHALVNGSTNLKQETGGLDNEYAFGSRQSENGSMTSEYDNQSLSTNSAPNAASVVKTTVMDENTAITITGKEGGPHDMHLMTEPYGVPCMVEIFHFLCSLLNVVEHTGMGPRSNTLAFDEDVPLFALNLINSAIELGGPSICRHPRLLSLIQDELFHNLMQFGLSTSPLILSMVCSIVLNLYHHLRTELKLQLEAFFSCVILRLAQSRYGASYQQQEVAMEALVDFCRQKTFMVDMYANFDCDITCSNVFEDLANLLSKSAFPVNCPLSAMHILALDGLIAVIQGMAERIANGSVSSEYSPVNLEEYTPFWMVKCENYNDPNHWVPFVRRRKYIKRRLMIGADHFNRDPKKGLEFLQGTHLLPDKLDPQSVACFFRYTAGLDKNLVGDFLGNHDEFCVQVLHEFAGTFDFQDMNLDTALRLFLETFRLPGESQKIHRVLEAFSERYYEQSPHILANKDAALVLSYSMIMLNTDQHNVQVKKKMTEEDFIRNNRHINGGNDLPREMLTEIYHSICKNEIRTIPEQGVGFPEMTPSRWIDLMHKSKKTAPFIVSDSKAYLDHDMFAIMSGPTIAAISVVFDHAEQEEVYQTCMDGFLAIAKISACHHLEDVLDDLVVSLCKFTTLLNPSSVEEPVLAFGDDMKARLATVTVFTIANRYGDYIRTGWRNILDCILRLHKLGLLPARVASDAADESELSAETVHGKPIMNSLSSAHMQSIGTPRRSSGLMGRFSQLLSLDTEEPRSQPTEQQLAAHQRTLQTIQKCHIDSIFTESKFLQAESLLQLARALIWAAGRPQKGNSTPEDEDTAVFCLELLIAITLNNRDRIGILWQGVYEHISNIVQSTVMPCALVEKAVFGLLRICQRLLPYKENIADELLRSLQLVLKLDARVADAYCEQITQEVSRLVKANASHIRSQLGWRTITSLLSITARHIEASEAGFDALLFIMSDGTHLLPANYILCVDTARQFAESRVGQAERSVRALDLMAGSVNCLAQWTSEAKGAMEEEQMSKLSQDIGEMWLRLVQGLRKVCLDQREEVRNHALLSLQKCLTGADGIYLPYSLWLQCFDLVIFTVLDDLLEIAQGHSQKDYRNMEGTLILAMKLLSKVFLQLLPELSQLTTFCKLWLGVLTRMEKYIKVKVRGKRSEKLQETMPELLKNSLLVMKMRGILAQRSALGGDSLWELTWLHVNNISPSLQLEVFPEQDSEHLQHKQGESIGGTVPDEKVSMPSSETASREDAGIVG

SEQ ID NO: 1917 - protein, 335 aa, Zea mays
MGNSIYRFLCGLCAPSSSEHGLHGAHPAVAALGRDVLSFQSTSQVPDELSRHVVSSKKAQANWYKKLLVAWKKARPPPKTPEEAAAFVVQTLKNHQKADVEGLLSFYGLPHPNAAAAAAGAPAARPPPKKAQQGAKFELHTLPIDPKSVADGDTVNVYVDAADPREAGSVPREVQKAAAERARARAAKDYQKADALQKVIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWAASKPQKPWEWRKDKRNGTA

SEQ ID NO: 1918 - protein, 331 aa, Oryza sativa
MGNSIYRFLCGLCSPSPEYQPHGAHPAVAALGRDIQQFEATSQVPDGLSRHVVSSKKAQANWYKKLIVTWKKARPTPRTPEEAARLVVTTLKNHQKADVEGFLVFYGLPIPNAAASTPAPHTAHVPKPQGCKFELHTLPVDAKAVADGDTITVYIDTADPRESGNVPREIQKAAAERTRARAARDYQKADGLQKMIADAGYRQVPNARGEEVLAKKYRIRLRGIDAPESAMPYGKEAKEALLKMVQGKSLKVYVYDEDRYGRCVGDIYCDGVFVQEQMLKKGCAWHYTAYDQRPELAKWEKQAQSGRKGLWAASRPQKPWEWRRDKRNGTA

SEQ ID NO: 1919 - protein, 172 aa, Saccharum officinarum
  misc_feature (105)..(105): Xaa can be any naturally occurring amino acid
  misc_feature (114)..(114): Xaa can be any naturally occurring amino acid
MGNSIYRFLCGLCAPSHGLHGAHPAVAALGRDILSFQSTSQVPDELSRHVVSSKKAQANWYKKLLVAWKKARPPPKTPEEAAAFVVQTLKNHQKADVEGLLSFYXLPHPNAAAXAPAAPPPPKKPQGAKFELHTLPVRLRPASSRLLNLSVVASKKLDPVGKRPPHGFQIRN

SEQ ID NO: 1920 - protein, 463 aa, Hordeum vulgare
MRTSMALLAASAALLLMVSLAAAADMSIVSYGERSEEEVRRMYAEWMAEHGSTYNAIGEEERRFEAFRDNLRYIDQHNAAADAGVHSFRLGLNRFADLTNEEYRSTYLGARTKPDRERKLSARYQAADNDELPESVDWRKKGAVGAVKDQGGCGSCWAFSAIAAVEGINQIVTGDMIPLSEQELVDCDTSYNQGCNGGLMDYAFEFIINNGGIDSEEDYPYKERDNRCDANKKNAKVVTIDGYEDVPVNSEKSLQKAVANQPISVAIEAGGRAFQLYKSGIFTGTCGTALDHGVAAVGYGTENGKDYWLVRNSWGSVWGEDGYIRMERNIKASSGKCGIAVEPSYPTKTGENPPNPGPTPPSPAPPSSVCDSYNECPASTTCCCIYEYGKECFAWGCCPLEGATCCDDHYSCCPHNYPICNTKQGTCLAAKDSPLSVKAQRRTLAKPIGAFSGIAIDGKKSSA

SEQ ID NO: 1921 - protein, 456 aa, Brachypodium distachyon
MRSSMALVAAAALLLLVSLAAAADMSIVSYGERSEEEVRRMYVEWMAENGRTYNAIGEEERRFEVFRDNLRYVDQHNAAADAGLHSFRLGLNRFADLTNEEYRDTYLGVRTKPVRERRLSGRYQAADNEELPESVDWREKGAVAKVKDQGGCGSCWAFSAIAAVEGINQIVTGDMIALSEQELVDCDTSYNQGCNGGLMDYAFEFIINNGGIDSEEDYPYKERDNRCDANKKNAKVVTIDGYEDVPVNSELSLKKAVANQPISVAIEAGGRAFQLYKSGIFTGRCGTALDHGVTAVGYGSENGKDYWIVKNSWGTVWGEDGYVRLERNIKATSGKCGIAIEPSYPLKKGANPPNPGPTPPSPAPPSTVCDSYNECPASTTCCCIYTYGKECFAWGCCPLEGATCCDDHYSCCPHSYPICNVQQGTCLAGKDSPMSVKALKRILAKPHGTFSGKSSA

SEQ ID NO: 1922 - protein, 463 aa, Festuca arundinacea
  misc_feature (442)..(442): Xaa can be any naturally occurring amino acid
MRSSTALLAAAAALLLSLAAAADMSIVSYGERSEEEARRMYAEWKAEHGRNSNAIGGEDELRFAVFRDNLRYIDEHNAAADAGLHSFRLGLNRFADITNEEYRSTYLGVRTKPERKQKLSARYQAADNEDLPESVDWRTKGAVPAVKDQGGCGSCWAFSAIAAVEGINAIATGDLIALSEQELVDCDTSYNEGCNGGLMDYAFEFIINNGGIDSEEDYPYTEKDGRCDANKKNAKVVTIDGYEDVPVNSEKSLQKAVANQPISVAIEAGGRAFQLYSSGIFTGTCGTALDHGVAAVGYGTEDGKDYWIVRNSWGSSWGEAGYVRMERNIKSTDGKCGIAIEPSYPLKTGANPPNPGPTPPAPVPPTPPSSVCDSYYTCPASTTCCCIFEYGKECFAWGCCPLEGASCCDDHYSCCPHDYPVCNTRRGTCSATKDSPLSVKAXKRIMATRTGARRAEDGMKSSA

SEQ ID NO: 1923 - protein, 463 aa, Leymus cinereus x Leymus triticoides
MRSSMALLGAAAALLLLVSLAAAVDMSIVSYGERSEEEVRRMYAEWMSEHRRTYNAIGEEERRFEIFRDNLRYIDQHNAAADAGVHSFRLGLNRFADLTNEEYRSTYLGARTKPDRERKLSARYQADDNEELPESVDWRKKGAVAAIKDQGGCGSCWAFSAIAAVEGINQIVTGDMIPLSEQELVDCDTSYNEGCNGGLMDYAFEFIINNGGIDSEEDYPYKERDNRCDANKKNAKVVTIDGYEDVPVNSEKSLQKAVANQPISVAIEAGGRAFQLYKSGIFTGTCGTALDHGVAAVGYGTENGKDYWLVRNSWGTVWGEDGYVRLERNIKASSGKCGIAVEPSYPLKTGENPPNPGPTPPSPAPPSSVCDSYNECPASTTCCCIYEYGKECFAWGCCPLEGATCCDDHYSCCPHNYPICNTRQGTCLAAKDSPLSVKAQRRTLAKPIGAFSGIAADGKKSSA

SEQ ID NO: 1924 - protein, 468 aa, Zea mays
MAAPASTTAAAAAALLLLLLLSLAAAADMSIVSYGERSDEEARRMYAEWMAAHGRTYNAVGEEERRYQVFRDNLRYIDAHNAAADAGVHSFRLGLNRFADLTNDEYRATYLGARTRPQRERKLGARYHAADNEDLPESVDWRAKGAVAEVKDQGSCGSCWAFSTIAAVEGINQIVTGDLISLSEQELVDCDTSYNQGCNGGLMDYAFEFIINNGGIDTEKDYPYKGTDGRCDVNRKNAKVVTIDSYEDVPANDEKSLQKAVANQPVSVAIEAAGTAFQLYSSGIFTGSCGTALDHGVTAVGYGTENGKDYWIVKNSWGSSWGESGYVRMERNIKASSGKCGIAVEPSYPLKEGANPPNPGPSPPSPTPAPAVCDNYYSCPDSTTCCCIYEYGKYCFAWGCCPLEGATCCDDHYSCCPHDYPICNVRQGTCLMGKDSPLSLSVKATKRTLAKPHWAFSGNTADGMKSSA

SEQ ID NO: 1925 - protein, 469 aa, Zea mays
MGASTTPLASAAALLLLLLAPLAAAADSMSIVSYGERSEEEARRMYAEWMAAHGRTYNAVGEEERRFEVFRDNLRYVDAHNAAADAGVHSFRLGLNRFADLTNDEYRATYLGVRSRPQRERRLGDRYLAGDNEDLPESVDWRAKGAVAEVKDQGSCGSCWAFSTIAAVEGINQIVTGDMISLSEQELVDCDTSYNQGCNGGLMDYAFEFIINNGGIDTEEDYPYKGTDGRCDVNRKNAKVVTIDSYEDVPANSEKSLQKAVANQPISVAIEAGGRAFQLYNSGIFTGTCGTALDHGVTAVGYGTENGKDYWIVKNSWGSSWGESGYVRMERNIKASSGKCGIAVEPSYPLKKGANPPNPGPTPPSPTPPPTVCDNYYSCPDSTTCCCIYEYGKYCFAWGCCPLEGATCCDDHYSCCPHDYPVCNVKQGTCLMGKDSPLSLSVKATKRTLAKPHWAFSGNTAADGMKSSA

SEQ ID NO: 1926 - protein, 458 aa, Oryza sativa
MRISMALAAAALLLLLSLAAADMSIVSYGERSEEEARRLYAEWKAEHGKSYNAVGEEERRYAAFRDNLRYIDEHNAAADAGVHSFRLGLNRFADLTNEEYRDTYLGLRNKPRRERKVSDRYLAADNEALPESVDWRTKGAVAEIKDQGGCGSCWAFSAIAAVEGINQIVTGDLISLSEQELVDCDTSYNEGCNGGLMDYAFDFIINNGGIDTEDDYPYKGKDERCDVNRKNAKVVTIDSYEDVTPNSETSLQKAVANQPVSVAIEAGGRAFQLYSSGIFTGKCGTALDHGVAAVGYGTENGKDYWIVRNSWGKSWGESGYVRMERNIKASSGKCGIAVEPSYPLKKGENPPNPGPTPPSPTPPPTVCDNYYTCPDSTTCCCIYEYGKYCYAWGCCPLEGATCCDDHYSCCPHEYPICNVQQGTCLMAKDSPLAVKALKRTLAKPNLSFLFGNGKKSSA

SEQ ID NO: 1927 - protein, 465 aa, Saccharum officinarum
MGASTTSLAAAAALLLLLVSLAAAADMSIISYGERSEEETRRMYAEWMAAHGRTYNAIGEEERRYQVFRDNLRYIDEHNAAADAGVHSFRLGLNRFADLTNEEYRATYLGVRTKPQRERKLSARYHADDNVELPESVDWRTKGAVAEVKDQGSCGSCWAFSTIAAVEGINQIVTGDLISLSEQELVDCDTSYNQGCNGGLMDYAFEFIINNGGIDTESDYPYKGTDGRCDANKKNAKVVTIDSYEDVPANSEKSLQKAVANQPVSVAIEAGGSAFQLYSSGIFTGKCGTALDHGVTAVGYGTENGKDYWIVKNSWGSSWGESGYIRMERNIKASSGKCGIAVEPSYPLKEGANPPNPGPTPPSPTPEPSVCDNYYSCPESTTCCCIYEYGKYCFAWGCCPLEGATCCDDHYSCCPHDYPICNVQQGTCLMGKDSPLSVKATKRTLAKPHWAFSGNTADDGMKSSA

SEQ ID NO: 1928 - protein, 463 aa, Panicum virgatum
MGTSTAASLAAAALLLLVSLAAAADMSIVSYGERSEEETRRMYAEWMATHGRAYNAIGEEERRYQVFRDNLRYIDAHNAAADAGVHSFRLGLNRFADLTNDEYRATYLGVRPKPQRERKLSARYQADDNEELPESVDWRAKGAVAEIKDQGSCGSCWAFSTIAAVEGINQIVTGDLISLSEQELVDCDTSYNEGCNGGLMDYAFEFIINNGGIDTEEDYPYKGTDNRCDVNRKNAKVVTIDSYEDVPVNSEKSLQKAVANQPVSVAIEASGRAFQLYSSGIFTGRCGTALDHGVTAVGYGTENGKDYWIVKNSWGSSWGEAGYIRMERNVKASSGKCGIAVEPSYPLKKGANPPNPGPTPPSPTPPPAVCDNYYSCPDSTTCCCIYEYGKYCFSWGCCPLEGATCCDDHYSCCPHDYPICNVKEGTCLMAKDSPLSVKALKRTLAKPHWAFSGNAADGMKSSA

SEQ ID NO: 1929 - protein, 463 aa, Panicum virgatum
MGTSSTASLAAAALLLLVSMAAAADMSIVSYGERSEEETRRMYAEWMATHGRAYNAIGEEERRYQVFKDNLRYIDAHNAAADAGVHSFRLGLNRFADLTNEEYRATYLGVRAKPQRERKLSARYHAEDNEELPESVDWRAKGAVVEVKDQGSCGSCWAFSTIAAVEGINQIVTGDLISLSEQELVDCDTSYNEGCNGGLMDYAFEFIINNGGIDTEEDYPYKGRDNRCDVNRKNAKVVTIDSYEDVPVNSEKSLQKAVANQPISVAIEASGRAFQLYSSGIFTGRCGTELDHGVTAVGYGTENGKDYWIVKNSWGASWGEAGYIRMERNVKASSGKCGIAVEPSYPLKKGANPPNPGPTPPSPAPPPAVCDNYYSCPDSTTCCCIYEYGKYCFSWGCCPLEGATCCDDHYSCCPHDYPICNVREGTCLMGKDSPLSVKALKRTLAKPHWAFSGNAADGMKSSA

SEQ ID NO: 1930 - protein, 461 aa, Triticum aestivum
MRSSMALLAAALLLLVSLAAAADMSIVSYGERSEEEVRRMYAEWMSEHRRTYNAIGEEERRFEVFRDNLRYIDQHNAAADAGLHSFRLGLNRFADLTNEEYRSTYLGARTKPDRERKLSARYQADDNEELPETVDWRKKGAVAAIKDQGGCGSCWAFSAIAAVEGINQIVTGDMIPLSEQELVDCDTSYNEGCNGGLMDYAFEFIINNGGIDSEEDYPYKERDNRCDANKKNAKVVTIDGYEDVPVNSEKSLQKAVANQPISVAIEAGGRAFQLYKSGIFTGTCGTALDHGVAAVGYGTENGKDYWLVRNSWGTVWGEDGYIRMERNIKASSGKCGIAVEPSYPTKTGENPPNPGPTPPSPAPPSSVCDSYNECPASTTCCCIYEYGKECFAWGCCPLEGATCCDDHYSCCPHNYPICNTQQGTCLAAKDSPLSVKAQRRTLAKPIGAFSVIATDGKKSSA

SEQ ID NO: 1931 - protein, 461 aa, Triticum aestivum
MRTSMVLLAAALLLLVSLAAAADMSIVSYGERSEEEVRRMYAEWMAEHRRTYNAIGEEERRFEVFRDNLRYIDQHNAAADAGLHSFRLGLNRFADLTNEEYRSTYLGARTKPDRERKLSARYQADDNEELPESVDWRKKGAVAAIKDQGGCGSCWAFSAIAAVEGINQIVTGDMIPLSEQELVDCDTSYNEGCNGGLMDYAFEFIINNGGIDSEEDYPYKERDNRCDANKKNAKVVTIDGYEDVPVNSEKSLQKAVANQPISVAIEAGGRAFQLYKSGIFTGTCGTALDHGVAAVGYGTENGKDYWLVRNSWGTVWGEDGYIRMERNIKASSGKCGIAVEPSYPTKTGENPPNPGPTPPSPAPPSSVCDSYNECPASTTCCCIYEYGKECFAWGCCPLEGATCCDDHYSCCPHNYPICNTQQGTCLAAKDSPLSVKAQRRTLAKPIGAFSGIATDGKKSSA

SEQ ID NO: 1932 - protein, 438 aa, Brassica rapa
  misc_feature (436)..(436): Xaa can be any naturally occurring amino acid
MKVETTGKEIIKPSSTTPDDLRTLQLSIYDHFLPPIYTVAYLFYAKDELISPEHTSHKLKTSLSETLTKFYPLAGRINGVTVDCNDEGAVFVDARVDNCSLSGFLASPDLNALQQLLPLDAVVNPYEAASTWPMLLVKATYFQCGGMAIGVCITHKIADAASMSTFIRTWSAEARGEAGNTVMDPKFAAANFYPPANETYKLPVDEKANKRSSITKRFVFSAAKLEELKTKATSPESADRPTRVESVTALLWKCFVSASFLDTCGRKVLIQLADLRSKLPSLLPESLIGNVMFSSVVLSTGQGEEVKIEEATRDLQKKKEDLQTMIQDVGDGSSSMIGSKLANLMLTNYARMSYETHEPYTVSSWCKLPLYEASFGWGYPVWVVGNVAPTFENIAMLIDSKDGHGIEAFVTLPEENMSSLEQNPELLAFASLNPCXVV

SEQ ID NO: 1933 - protein, 559 aa, Brachypodium distachyon
MVGRSSLPEGALFLGFDSSTQSVKATVLNNELTIVASETVNFDSELPHYKTEGGVYRDPTDDGRIFSPTIMWVEALELVLEKLKPKIDFSKVVAVSGSGQQHGSVYWKKGSEAVLSSLDPSKSLLSQLKDAFSTMDSPIWMDSSTTKQCREIENAVGGALELSKLTGSRAHERYTGPQIRKIYQTTPDVYESTERISLVSSFMASILVGCYASIDETDGAGMNLMDINHRIWSKTALEATAPDLEQKLGNLAPAYAVAGRISPYFVERLQFDKNCLVIQWSGDNPNSLAGLTLNTPGDLAISLGTSDTVFGITAEAKPGLEGHVFPNPVEPDGYMVMLCYKNGSLTREDVRNRCAEKSWDVFNNYLEKTAPMNGGKLGFYYKDHEILPPLPAGFHRYVVENFNENSPDNLTEREVQEFDPPSEVRGIVEGQMLSMRGHAERFGMPNPPKRIIATGGASSNESILKLIAQVFGCPVFTVQRPDSASLGAALRAAHGWLCKEEGGFVPISCMYMSNLEKTSLAAKLAVPAPGDGELLKKYTSLVKKRMEIERRLVEKIGRA

SEQ ID NO: 1934 - protein, 562 aa, Zea mays
MAGRDSLPEGSLFLGLDSSTQSLKATVLNNELTIVASEIVNFDSELPHYKTEGGVYRDPADDRHIFSPTIMWVEALEVLLEKLKPKINFGKVVAVSGSGQQHGSVYWKKGSHAVLSSLDASKSLLSQLKDAFSTMNSPLWMDSSTTKQCREIENAVGGALELAKLTGSRAYERFTGPQIRKIYQTEPDVYEDTERISLVSSFMASILVGSYASIDETDGAGMNLMDIKQRTWSKSALEATAPGLEAKLGNLAPAYSAAGRIAPYFVERFQFDKNCLVIQWSGDNPNSLAGLTLNTPGDLAISLGTSDTVFGITTEAKPSLEGHVFPNPVEPNGYMVMLCYKNGSLTREDVRNRCADKSWDVFNSYLEKTPPLNGGKIGFYYKDHEILPPLPVGFHRYTVENLNDVSSDALLEREVEELDPPSEVRAIIEGQMLSMRGHAERFGMPNPPKRIIATGGASSNESILKSVAQIFGCPVFTVQRPDSASLGAALRAAHGWLCNAQGSFVPISCLYQGNLEKTSLGSKLAVPAGDKEQDRELLQKYTILMRKRMEIERRLVEKIGRS

SEQ ID NO: 1935 - protein, 561 aa, Pseudoroegneria spicata
  misc_feature (43)..(43): Xaa can be any naturally occurring amino acid
  misc_feature (121)..(121): Xaa can be any naturally occurring amino acid
  misc_feature (522)..(522): Xaa can be any naturally occurring amino acid
  misc_feature (548)..(548): Xaa can be any naturally occurring amino acid
MVGRSSLPDGALFLGLDSSTQSVKATVLSNELIIVASETVNFXSELPHYKTEGGVYRDPTDDGRIYSPTIMWVEALELLLEKLKPKINFSKVVAVSGSGQQHGSVYWKKGSQAVLSSLDPXKSLVSQLKDAFSTMDSPIWMDGSTTKQCREIENAVGGALELSKLTGSRAYERFTGPQIRKIYQTAPHIYENTERISLVSSFMASILVGCYASIDETDGAGMNLMDINKRTWSKAVLEATAPDLEQKLGNLAPAYAAAGRISSYFVERHQFDKNCLVIQWSGDNPNSLAGLTLNTPGDLAISLGTSDTVFGITAEANPSLEGHVFPNPVEPDGYMVMLCYKNGSLTREDVRNQCAEKSWDVFNNYLEKTPPLNGGKLGFYYKDHEILPPLPVGFHRYIVENFNDGSSDNLKEREVQEFDPQSEVRAIVEGQMLSMRGHAERFGMPNPPKRIIATGGASSNESILKLIAQIFGCPVFTVERPDSASLGAALRAAHGWLCKEEGGFVPISRMYMGNLEKTSLGXKLAVPAPGEEGRELLKKYTVLMKKRXEIERRLVEKIGRA

SEQ ID NO: 1936 - protein, 562 aa, Oryza sativa
MVGRSSLPEGSLFLGFDSSTQSLKATVLNNELIIVASDIVNFDSDLPHYKTEGGVYRDPADDGHIFSPTIMWVEAFELLLEKLKPKINFSKVVAISGSGQQHGSVYWKKGSHAVLSSLDPTKSLLSQLKDAFSTMDSPIWMDSSTTKQCREIESVVGGALELSKLTGSRAYERFTGPQIRKIYRTVPQVYDDTERISLVSSFMASILVGNYASIDETDGAGMNLMDINQRTWSKTVLEATAPGLEEKLGKLAPAYAVAGRIAPYFVERLQFDKNCLVIQWSGDNPNSLAGLTLNTPGDLAISLGTSDTVFGITAEAKPSLEGHVFPNPVEPDGYMVMLCYKNGSLTREDVRNSCAEKSWDVFNSYLEKTPPLNGGKLGFYYKDHEILPPLPVGFHRYIVENLNDVTSNNLVEREVEEFDPPSEVRAIIEGQLLSMRGHAERFGMPNPPKRIIATGGASSNERILHSIAQIFGCPVFTVQRPDSASLGAALRAAHGWLCNEEGSFVPISCMYQGNLEKTSLGAKLAVSTGEGVEDKELLEKYTVLMRKRMEIERRLVEKIGRA

SEQ ID NO: 1937 - protein, 562 aa, Sorghum bicolor
MSGRGSLPEGSLFLGLDSSTQSLKATVLNNELTIVASEIVNFDSELPHYKTEGGVYRDPADDGHIFSPTIMWVEALELLLEKLKPKINFGKVVAVSGSGQQHGSVYWKKGSHAVLSSLDASKSLLSQLKDAFSTMNSPIWMDSSTTKQCREIENAVGGALELAKLTGSRAYERFTGPQIRKIYQTEPDVYEDTERISLVSSFMASILVGSYASIDETDGAGMNLMDINQRIWSKSVLEATAPGLEAKLGNLAPAYSAAGRIAPYFVERFQFDKNCLVIQWSGDNPNSLAGLTLNTPGDLAISLGTSDTVFGITAEAKPSIEGHVFPNPVEPDGYMVMLCYKNGSLTREDVRNRCADKSWDVFNNYLEKTPPLNGGKLGFYYKDHEILPPLPVGFHRYAVENLNDVTSDTLLEREVEEFDPPSEVRAIIEGQMLSMRGHAERFGMPNPPKRIIATGGASSNESILKSIAQIFGCPVFTVQRPDSASLGAALRAAHGWLCNAQGSFVPISCLYQGNLEKTSLGSKLAVPAGDKEEDRELLQKYTLLMRKRMEIERRLVEKIGRS

SEQ ID NO: 1938 - protein, 562 aa, Panicum virgatum
MAGRGSLPEGSLFLGFDSSTQSLKATVLNNELTIVASEIVNFDSELPHYKTEGGVYRDSTDDGHIFSPTIMWVEALELLLEKLKPKINFSKVLAVSGSGQQHGSVYWKKGSKAVLSSLDSSKSLLLQLKDAFSTMNSPIWMDSSTTKQCREIENAVGGALELAKLTGSRAYERFTGPQIRKIYQTEPNVYEDTERISLVSSFMASILVGSYASIDETDGAGMNLMDINQRTWSKTVLEATAPELEAKLGTLAPAYSAAGQIAPYFVERFQFDKNCLVIQWSGDNPNSLAGLTLNTPGDLAISLGTSDTVFGITAEAKPSLEGHVFPNPVEPDGYMVMLCYKNGSLTREHVRNEFAEKSWDVFNGYLEKTPPLNGGKLGFYYKDHEILPPLPVGFHRYIVENLDDASSDNLIEREVAEFNPPSEVRAIIEGQMLSMRGHAERFGMPNPPKRIIATGGASSNESILKSIVEIFGCPVFTVQRPDSASLGAALRAAHGWLCNTKGSFVPISCLYEGNLEKTSLGSKLAVPAGEKEEDRELLKKYTLLMSKRMEIERRLVEKIGRA

SEQ ID NO: 1939 - protein, 193 aa, Brachypodium distachyon
MAAATAKKSGSEMGVVLGLDVPRYMGRWYEIASFPNFFQPRDGRDTRATYELMEDGATVHVLNETWSKGKRDYIEGTAYKADPSSEEAKLKVKFYVPPILPIIPVVGDYWVLYVDPDYQYALVGEPRRKNLWILCRKTQIEEEVYEQLLEKAKEEGYDVAKLHKTPQSDPPPESDAAPADTKGSWWFKSLFGK

SEQ ID NO: 1940 - protein, 191 aa, Festuca arundinacea
  misc_feature (42)..(42): Xaa can be any naturally occurring amino acid
MAAKVKSGSEMGVVLGLDVARYMGRWYEIASFPNFFQPRDGXDTRATYELMEDGATVHVLNETWSKGKRDYIEGTAYKADPASDEAKLKVKFYVPPFLPIIPVVGDYWVLYVDDDYQYALVGEPRRKSLWILCRKTHIEDEVYSQLLEKAKEEGYDVSKLHKTPQSDPPPESDAAPTDSKGTWWFKSLFGK

SEQ ID NO: 1941 - protein, 190 aa, Leymus cinereus x Leymus triticoides
MATKKSGSEMSVVLGLDVARYMGRWYEIASFPNFFQPRDGRDTRATYELMEDGATVHVLNETWSKGKRDYIEGTAYKADPASDEAKLKVKFYVPPFLPIIPVVGDYWVLYVDDDYQYALVGEPRRKNLWILCRKTHIEEEVYNQLLEKAKEEGYDVAKPHKTPQSDPPPESDAAPTDSKGTWWFKSLFGK

SEQ ID NO: 1942 - protein, 198 aa, Zea mays
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRKNLWILCRKTSIDEDVYNQLVERAKEEGYDVSKLHRTPQDDPPPESDAAPTDTKGVWWFKSLFGK

SEQ ID NO: 1943 - protein, 193 aa, Saccharum officinarum
MAAAEGKKSGGQMTVVRGLDVARYMGRWYEIASFPSFFQPRDGRDTRATYRLLEDGATVHVLNETWSKGKRDYIEGTAYKADASSDEAKLKVKFYLPPFLPIIPVVGDYWVLYVDDDYQYALVGEPRRKNLWILCRKTSIDEEVYNQLVERAKEEGYDVSKLHRTPQDDPPPESDAAPTDTKGVWWFKSLFGK

SEQ ID NO: 1944 - protein, 197 aa, Panicum virgatum
MAAAAEGTTAKKSGGEMTVVRGLDVARYMGRWYEIASVPSFFQPRDGRNTRATYALQEDGATVDVLNETWSKGKRDYIEGTAYKADPASDEAKLKVKFYLPPFLPIIPVVGDYWVLYVDDDYQYAIVGEPRRKNLWILCRKTSIDEEVYNQLVERAREEGYDVSKLHRTPQDDPPPESDAAPTDTKGVWWFKSLFGK

SEQ ID NO: 1945 - protein, 199 aa, Panicum virgatum
MAAAAAAEGTTTKKSGGEMTVVRGLDVARYMGRWYEIASVPSFFQPRDGRNTRATYALLEDGATVHVLNETWSKGKRDYIEGTAYKADPGSDEAKLKVKFYLPPFLPIIPVVGDYWVLYVDADYQYALVGEPRRKNLWILCRKTSIDEEVYSQLLERAREEGYDVSKLHRTPQDDPPPESDAAPTDTKGVWWFKSLFGK

SEQ ID NO: 1946 - protein, 190 aa, Triticum aestivum
MAAKKSGSEMGVVLGLDVARYMGRWYEIASFPNFFQPRDGRDTRATYELMEDGATVHVLNETWSKGKRDFIEGTAYKADPASEEAKLKVKFYVPPFLPIIPVVGDYWVLYVDDDYQYALVGEPRRKSLWILCRKTHIEEEVYNQLLEKAKEEGYDVAKLHKTPQSDPPPESDAAPTDSKGTWWFKSLFGK

SEQ ID NO: 1947 - protein, 190 aa, Triticum aestivum
MAAKKSGSEMGVVLGLDVARYMGRWYEIASFPNFFQPRDGRDTRATYELMEDGATVHVLNETWSKGKRDYIEGTAYKADPASEEAKLKVKFYVPPFLPIIPVVGDYWVLYVDDDYQYALVGEPRRKSLWILCRKTHIEDEVYNQLLEKAKEEGYDVAKLHKTPQSDPPPESDAAPTDSKGTWWFKSLFGK

SEQ ID NO: 1948 - protein, 218 aa, Hordeum vulgare
MAVTFSDLHSADGLKALEAHLAGKTYISGDAITKDDVKVFAAVPVKPSAEFPNAARWYDAVAAAVSPRFPGQASGVSASSAPAAAAPAASKDEDDDDDMDLFGDETEEDKKAAAEREAAKPAKKKESGKSSVLMDIKPWDDETDMKKLEEAVRGVQMEGLTWGASKLMPVGYGIKKLQIMLTIIDDLVSVDTLIEEVLCEAPINEYVQSCDIVAFNKI

SEQ ID NO: 1949 - protein, 219 aa, Brachypodium distachyon
MAVSFSELHTADGLKALEAHLAGKTYISGEQISKDDVKVFAAVPSKPSAEFPNAARWYDTVAAALASRFPGKASGVNLSAAGSSSGPADASKDAEDDDDLDLFGDETEDDKKAAEERVAAKPAKKKESGKSSVLMDVKPWDDETDMKKLEEAVRSVQMEGLTWGASKLVAVGYGIKKLQIMLTIVDDLVSVDTLIEEVLCEEPINEYVQSCDIVAFNKI

SEQ ID NO: 1950 - protein, 220 aa, Cenchrus ciliaris
MAVTFSDLHTADGLKALEAHLAGKTYVSGDVISKDDVKVFAAVPSKPGAEFPNAARWYETVSAALASRFPGKAVGVNLPGAGAAAAPAAEAAKEEDDDDLDLFGDETEEDKKAADERAAAKASAKKKESGKSSVLMDVKPWDDETDMKKLEEAVRSVQMEGLTWGASKLVPVGYGIKKMTIMLTIVDDLVSVDSLIEDHLTAEPINEYVQSCDIVAFNKI

SEQ ID NO: 1951 - protein, 219 aa, Gossypium hirsutum
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDDLDLFGDETEEDKKAADERAAAAKASSKKKESGKSSVLMDVKPWDDETDMKKLEEAVRSVQMEGLTWGASKLVPVGYGIKKMTIMLTIVDDLVSIDTLIEDHLTQEPINEYVQSCDIVAFNKI

SEQ ID NO: 1952 - protein, 219 aa, Leymus cinereus x Leymus triticoides
  misc_feature (113)..(113): Xaa can be any naturally occurring amino acid
MAVTFSDLHTADGLKALEAHLAGKTYISGDGITKDDVKVFAAVPVKPSAEFPNAARWYDAIAATVSSRFPGQASGVSASSAPAAAAPAASKDEDDDDDDMDLFGDETEEDKKXAAERAAAKPAKKKESGKSSVLMDIKPWDDETDMKKLEEAVRGVQMEGLTWGASKLMPVGYGIKKLQIMLMIIDDLVSVDTLIEEVLCEAPINEYVQSCDIVAFNKI

SEQ ID NO: 1953 - protein, 219 aa, Zea mays; identical to SEQ ID NO: 1951

SEQ ID NO: 1954 - protein, 219 aa, Zea mays; identical to SEQ ID NO: 1951

SEQ ID NO: 1955 - protein, 218 aa, Pseudoroegneria spicata
MAVTFSDLHTADGLKALEAHLAGKTYISGDGITKDDVKVFAAVPVKPSAEFPNAARWYDTVAAAVASRFPGQASGVSASSAPAAAAPAASKDEDDDDDMDLFGDETEEDKKAAAERAAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 1956 - protein, 224 aa, Oryza sativa
MAVTFTDLHTADGLKALEQHLSGKTYVSGNAISKDDIKVFAAVPSKPGAEFPNAARWYDTVAAALASRFPGKAVGVNLPGGGAASSAAAAAPAAKDADEDDDDLDLFGDETEEDKKAADERAASKASSKKKESGKSSVLLDVKPWDDETDMKKLEEAVRSVQMEGLTWGASKLVPVGYGIKKLQIMLTIVDDLVSVDSLIEEHLTEEPINEFVQSCDIVAFNKI

SEQ ID NO: 1957 - protein, 219 aa, Saccharum officinarum
MAVFCDLHTTDGLKSLEAHLAGKTYVSGDAISKDDIKVFAAVPSKPGAEFPNAARWYETISAAVASRFPGKAVGVNLPAGSAPAAAAPAAEAEDDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLTEEPINEYVQSCDIVAFNKI

SEQ ID NO: 1958 - protein, 208 aa, Saccharum officinarum
MAVFSDLHTADGLKTLEAHLAGKTYVSGDAITKDDIKVFAAVPSKPGAEFPNAARWYETISVAVASRFPGKAVGVNLPAGSAPAAAAPAAEAEDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLMEEPINEYVQ

SEQ ID NO: 1959 - protein, 85 aa, Saccharum officinarum
MDVKPWDDETDMKKLEEAVRSVQMEGLTWGASKLVPVGYGIKKMTIMLTIVDDLVSVDSLIEDHLTEEPINEYVQSCDIVAFNKI

SEQ ID NO: 1960 - protein, 223 aa, Saccharum officinarum
MAVFCDLHTTDGLKSLEAHLAGKTYVSGDAISKDDIKVFAAVPSKPGAEFPNAARWYETISAAVASRFPGKAVGVNLPAGSAPAAAAPAAEAEDDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLNEEAINEYVQSCDIVAFTRSKFKF

SEQ ID NO: 1961 - protein, 218 aa, Saccharum officinarum
MAVFSDLHTADGLKTLEAHLAGKTYVSGDAITKDDIKVFAALPSKPGAEFPNAARWYETISVAVASRFPGKTVGVNLPAGSAPAAAAPAAEAEDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLTEEPINEYVQSCDIVAFNKI

SEQ ID NO: 1962 - protein, 223 aa, Panicum virgatum
MAVTFSDLHTADGLKALEAHLAGKTYVSGDAISKDDIKVFAAVPSKPGGEFPNAARWYETVAAALAARFPGKGVGVNLPGAGSAPAAAAPAAEVAKDDDDDDLDLFGDETEEDKKAADERAAAKASAKKKESGKSSVLMDVKPWDDETDMKKLEEAVRSVQMEGLTWGASKLVPVGYGIKKMTIMLTIVDDLVSIDSLIEDHLMEAPINEYVQSCDIVAFNKI

SEQ ID NO: 1963 - protein, 225 aa, Panicum virgatum
MAVTFSELHTADGLKALEAHLAGKTYVSGDAISKDDIKVFAAVPSKPGAEFPNAARWYETVAAAVASRFPGKGVGVNLPGAGSAPAAAAPAAEVAKDDDDDDDDLDLFGDETEEDKKAADERAAAKASAKKKESGKSSVLMDVKPWDDETDMKKLEEAVRSVQMEGLTWGASKLVPVGYGIKKMTIMLTIVDDLVSVDSLIEDHLTEAPINEYVQSCDIVAFNKI

SEQ ID NO: 1964 - protein, 218 aa, Triticum aestivum
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 1965 - protein, 218 aa, Triticum aestivum
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 1966 - protein, 218 aa, Triticum aestivum
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCETPINEYVQSCDIVAFNKI

SEQ ID NO: 1967 - protein, 214 aa, Triticum aestivum
  misc_feature (181)..(181): Xaa can be any naturally occurring amino acid
MAVFSDLHTADGLKTLEAHLAGKTYVSGDAITKDDIKVFAAVPSKPGAEFPNAARWYETISAAVASRFPGKPVGVNLPAGSAPAAAAPAAEAEDDDDLDLFGDETEEDKKAADERAAAKASSKKKESGKSSVLMDVKPWDDETDMKKLEEAVRSVQMEGLTWGASKLVPVGYGIKKMTIMXTIVDDLVSVDSLIEDHLTEEPINEYVQSCDIVA

SEQ ID NO: 1968 - protein, 334 aa, Hordeum vulgare
MESSTSRTRLNCISLADPDTQRSVALLKQACLDSGFFYVLDHGISQEFMDEVFAESKKFFELPNSEKMKLLRNEKNRGYTPMLDEILDPENQVNGDYKEGYYIGVEVPTDDPQSNRPFYGPNQWPSEEVLPKWREVMEQYHREALRVAKSVARIIALALNLDADFFDRPEMLGDSIATLRLLHYEGGQKTGQVSNPSKGVYGAGAHSDYGLITLLATDDVVGLQICKDRNAQPQVWEYVAPVKGGFIVNLGDMLERWSNSLFRSTLHRVVLDGRERYSIAFFVEPSHDCVVECLPTCKSETNPPKFPPITCSAYLSQRYKDTHADLSTYGNGKA

SEQ ID NO: 1969 - protein, 334 aa, Brachypodium distachyon
MESSTSSTSLNCISLSDPDIQRSVALLKQACLDSGFFYVLDHGISQELMDEVFAQSKKFFELPNSEKMKLLRNEKNRGYTPMLDEILDPENQVNGDYKEGYYIGVEVPADDPQSNRPFYGPNQWPSEEVLPKWREVMEEYHREALRVAKSVARIIALALNLDEDFFDTPEMLGDPIATLRLLHYEGGRETGQVSNPSKGVYGAGAHSDYGLITLLATDDVVGLQICKDSNAQPHVWEYVAPVKGGFIVNLGDMLERWSNCIFRSTLHRVVLSGQERYSIAYFVEPSHDCIVECLPTCKSETNPPKFPPITCSAYLSQRYKDTHADLSAYSDGKA

SEQ ID NO: 1970 - protein, 334 aa, Leymus cinereus x Leymus triticoides
MESSTSRTSLNCISLADPDIQRSVALLKQACLDSGFFYVLDHGISQEFMDEVFAESKKFFELPNSEKMKLLRNEKNRGYTPMLDEILDPENQVNGDYKEGYYIGVEVPADDPQSNRPFYGPNQWPSEEVLPKWREVMEQYHREALRVAKSVARIIALALNLDADFFDRPEMLGDSIATLRLLHYEGGQKTGQVSNPSKGVYGAGAHSDFGLITLLATDDVVGLQICKDRNAQPQVWEYVAPVKGGFIVNLGDMLERWSNSIFRSTLHRVVLDGRERYSIAFFVEPSHDCVVECLPTCKSETNPPKFPPITCSAYLSQRYKDTHADLSTYGDGKA

SEQ ID NO: 1971 - protein, 334 aa, Zea mays
MESPISRTNLNCISLADPNVQKSVALLKQACLDSGFFYVVDHGISQEFMDEVFAQSKKFFDLPHSEKMKLLRDEKNRGYTPMLDEILDPENQVNGDYKEGYYIGVEVPADDPEANRPFYGPNQWPSKEVLPKWREVMEQYHREALRVAKSVARIIALALDLDVDFFDRPEMLGESIATLRLLHYEGGQETGKVSDPAKGVYGAGAHSDYGLITLLATDDVVGLQICKDKNAQPQLWEYVAPLKGGFIVNLGDMLERWSNGVFRSTLHRVVLDGRERYSIAYFVEPSHDCVVECLPTCKSESNPPKFPPITCSAYLSQRYKDTHADLKSYDDSKA

SEQ ID NO: 1972 - protein, 329 aa, Sorghum bicolor
MESPISRTNLNCISLADPDVQKSVALLKQACLDSGFFYVVDHGISQEFMDEVFSQSKKFFDLPHSEKMKLLRDEKNRGYTPMLDEILDPENQVNGDYKEGYYIGVEVPADDPEANRPFYGPNQWPSKEVLPKWREVMEQYHREALRVAKSVARIIALALDLDVDFFDRPEMLGEPIATLRLLHYEGKVSNPAKGVYGAGAHSDYGLITLLATDDVVGLQICKDKNAQPQVWEYVAPVKGGFIVNLGDMLERWSNSIFRSTLHRVVLDGRERYSIAYFVEPSHDCVVECLPTCKSESNPPKFPPITCSAYLSQRYKDTHTDLNSYNNSKA

SEQ ID NO: 1973 - protein, 329 aa, Saccharum officinarum
MESPISRTNLNCISLADPDVQKSVALLKQACLDSGFFYVVDHGISQEFMDEVFAQSKKFFDLPHSEKMKLLRDEKNRGYTPMLDEILDPENQVNGDYKEGYYIGVEVPADDPGANRPFYGPNQWPSKEVLPKWREVMEQYHREALRVAKSVARIIALALDLDVDFFDRPEMLGEPIATLRLLHYEGKVSNPAKGVYGAGAHSDYGLITLLATDDVVGLQICKDKNAQPQVWEYVAPVKGGFIVNLGDMLERWSNSIFRSTLHRVVLDGRERYSIAYFVEPSHDCVVECLPTCKSESNPPKFPPITCSAYLSQRYKDTHADLNSYNDSKA

SEQ ID NO: 1974 - protein, 329 aa, Panicum virgatum
MESSISSTELNCISLADPDIQKSVALLKQACLDSGFFYVVDHGISEEFMDEVFAQSKKFFDLPHIEKMKLLRDKKNRGYTPMLDEILDPENQVNGDYKEGYYIGVEVPADSPEANKPFCGPNQWPAEEVLPKWREVMEQYHREALRVAKSVARIIALALDLDVDFFDRPEMLAKPIATLRLLHYEGRVSNPAKGVYGAGAHSDYGLITLLATDDVVGLQICKDRNAQPQVWEYVAPVKGGFIVNLGDMLERWSNCIFRSTLHRVVLDGRERYSIAYFVEPSHDCVVECLPTCKSETNPPKFPPITCSAYLTQRYKDTHADLSSYSDGKA

SEQ ID NO: 1975 - protein, 334 aa, Panicum virgatum
MESSISRTELNCISLADPDIQKSVALLKQACLDSGFFYVVDHGISQEFMDEVFAQSKKFFDLPHSEKMKLLRDEKNRGYTPMLDEILDPENQVNGDYKEGYYIGVEVPEDNPEANKPFYGPNQWPNEEVLPKWRKVMEQYHREALRVAKSVARIIALALDLDVDFFDRPEMLAKPIATLRLLHYEGGQKTGRVSNPAKGVYGAGTHSDYGLITLLATDDVVGLQICKDRNAQPQIWEYVAPLKGGFIVNLGDMLERWSNCIFRSTLHRVVLDGQERYSIAYFVEPSHDCVVECLPTCKSETNPPKFPPITCSAYLSQRYKDTHADLSSYSDGKA

SEQ ID NO: 1976 - protein, 105 aa, Triticum aestivum
MESSTSRTSLNCISLADPDIQRSVALLKQACLDSGFFYVLDHGISQEFMDEVFAESKKFFELPNSEKMKLLRNEKNRGYTPVLDEILDPENQVNGDYKGRVLYWC

SEQ ID NO: 1977 - protein, 334 aa, Triticum aestivum
MESSTSRTSLNCISLVDPDIQRSVALLKQACLDSGFFYVLDHGISQEFMDEVFAESKKFFELPNSEKMKLLRNEKNRGYTPMLDEILDPENQVNGDHKEGYYIGVEVPADDPQSNRPFYGPNQWPSEEILPKWREVMEQYHREALRVAKSVARIIALALNLDEDFFDRPEMLGDSIATLRLLHYEGGQKTGQVSNPSKGVYGAGAHSDYGLITLLATDDVVGLQICKDRNAQPQVWEYVAPVKGGFIVNLGDMLERWSNSIFRSTLHRVVLDGQERYSIAFFVEPSHDCVVECLPTCKSETNPPKFPPITCSAYLSQRYKDTHADLSTYSDGKA

SEQ ID NO: 1978 - protein, 334 aa, Triticum aestivum
MESSTSRTSLNCISLADPDTQRSVALLKQACLDSGFFYVLDHGISQEFMDEVFAESKKFFELPNSEKMKLLRNEKNRGYTPMLDEILDPENQVNGDYKEGYYIGVEVPAEDPQSNRPFYGPNQWPPEEVLPKWREVMEQYHREALRVAKSVARIIALALNLDEDFFDRPEMLGDSIATLRLLHYEGGQKTGQVSNPSKGVYGAGAHSDYGLITLLATDDVVGLQICKDRNAQPQVWEYVAPVKGGFIVNLGDMLERWSNSIFRSTLHRVVLDGQERYSIAFFVEPSHDCVVECLPTCKSETNPPKFPPITCSAYLSQRYKDTHADLSTYSDGKA

SEQ ID NO: 1979 - protein, 151 aa, Amborella trichopoda
MSGRKKTREPKEENVTLGPTVREGEHVFGVAHVFASFNDTFVHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 1980 - protein, 151 aa, Amborella trichopoda
MSGRKKTREPKEENVTLGPTVREGEYVFGVAHIFASFNDTFVHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 1981 - protein, 150 aa, Antirrhinum majus
MSKRRTREPKEDNVTLGPATRDGELVFGVAHIFASFNDTFIHVTDLSGRETMVRITGGMKVKADRDESSPYAAMLAAQDISQRCKELGLNALHIKLRATGGNKTKTPGPGAQSALRALARSGMKIGRIEDVTPIPTDSTRRKGGRRGRRL

SEQ ID NO: 1982 - protein, 150 aa, Antirrhinum majus
MSRRKTREPKEDNVTLGPATRDGELVFGVAHIFASFNDTFIHVTDLSGRETMVRITGGMKVKADRDESSPYAAMLAAQDIAQRCKELGINALHIKLRATGGNKTKTPGPGAQSALRALARTGMKIGRIEDVTPIPTDSTRRKGGRRGRRL

SEQ ID NO: 1983 - protein, 150 aa, Antirrhinum majus; identical to SEQ ID NO: 1982

SEQ ID NO: 1984 - protein, 150 aa, Antirrhinum majus
MSRRKTREPKEDNVTLGPATRDGELVFGVAHIFASFNDTFIHVTDLSGRETMVRITGGMKVKADRDESSPYAAMLAAQDISQRCKELGINALHIKLRATGGNKTKTPGPGAQSALRALARSGMKIGRIEDVTPIPTDSTRRKGGRRGRRL

SEQ ID NO: 1985 - protein, 150 aa, Malus domestica
MSKKKVREPKEDNVTLGPILKDGEHAFGVAHIYASFNDTFIHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 1986 - protein, 150 aa, Malus domestica
MSRKKTREPKEDNVTLGPVLRDGEHAFGVAHIFASFNDTFIHVTDLSGRETLVRITGGMKVKADRDESSPYAAMLAAQDVSQRCKELGITALHIKLRATGGNKTKTPGPGAQSALRALARSGMRIGRIEDVTPIPTDSTRKKGGRRGRKL

SEQ ID NO: 1987 - protein, 150 aa, Malus domestica; identical to SEQ ID NO: 1985

SEQ ID NO: 1988 - protein, 150 aa, Prunus armeniaca
MSRRKTREPKEENVTLGPALRDGEHAFGVAHIFASFNDTFIHVTDLSGRETLVRITGGMKVKADRDESSPYAAMLAAQDVSQRCKELGITALHIKLRATGGNKTKTPGPGAQSALRALARSGMRIGRIEDVTPIPTDSTRRKGGRRGRRL

SEQ ID NO: 1989 - protein, 150 aa, Prunus armeniaca
MSRRKVREPKEENVTLGPTLKDGEYAFGVAHIFASFNDTFIHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 1990 - protein, 151 aa, Aquilegia formosa
MSKKKTREPKTENVTNLGPAVREGEHVFGVAHIFASFNDTFIHVTDLSGRETMVRITGGMKVKADRDESSPYAAMLASQDVAQRCKELGITALHIKLRATGGNKTKTPGPGAQSALRALARSGMKIGRIEDVTPIPTDSTRRKGGRRGRRL

SEQ ID NO: 1991 - protein, 150 aa, Arabidopsis thaliana
MSKRKTKEPKVDVVTLGPSVREGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 1992 - protein, 150 aa, Arabidopsis thaliana [sequence omitted]

SEQ ID NO: 1993 - protein, 150 aa, Arabidopsis thaliana
MSKRKTKEPKVENVTLGPAVREGEQVFGVVHVFASFNDTFIHVTDLSGRETLVRITGGMKVKADRDESSPYAAMLAAQDVAQRCKELGITAIHVKLRATGGNKTKTPGPGAQSALRALARSGMKIGRIEDVTPIPTDSTRRKGGRRGRRL

SEQ ID NO: 1994 - protein, 150 aa, Artemisia annua
MSKRKVREPKEDNVTLGPATREGELVFGVAHIFASFNDTFIHVTDISGRETMVRITGGMKVKADRDESSPYAAMLAAQDVSTRCKELGVNALHIKLRATGGNKTKTPGPGAQSALRALARSGMKIGRIEDVTPIPTDSTRRKGGRRGRRL

SEQ ID NO: 1995 - protein, 149 aa, Artemisia annua
MSKRKNREPKEDVTLGPATREGELVFGVAHIFASFNDTFIHVTDISGRETMVRITGGMKVKADRDESSPYAAMLAAQDVSTRCKELGVTALHIKLRATGGNKTKTPGPGAQAALRALARSGMKIGRIEDVTPIPTDSTRRKSGRRGRRL

SEQ ID NO: 1996 - protein, 150 aa, Artemisia annua; identical to SEQ ID NO: 1994

SEQ ID NO: 1997 - protein, 150 aa, Persea americana
MSKRKTREVKEDNVTLGPTVREGEHVFGVAHIFASFNDTFIHVTDLSGRETMVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 1998 - protein, 150 aa, Brassica juncea
MSRRKTREPKEETVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 1999 - protein, 150 aa, Brassica juncea; identical to SEQ ID NO: 1998

SEQ ID NO: 2000 - protein, 136 aa, Brassica juncea
TLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2001 - protein, 150 aa, Brassica juncea
MSRRKTREPKEETVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPVPTDSTRRKGGRRGRRL

SEQ ID NO: 2002 - protein, 150 aa, Brassica juncea
MSRRKTREPKEETVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKSGRRGRRL

SEQ ID NO: 2003 - protein, 150 aa, Brassica juncea
  misc_feature (83)..(83): Xaa can be any naturally occurring amino acid
MSRRKTREPKEETVTLGPAVRDGEQVFGVVHIFASFNDTFIHVTDLSGRETLVRITGGMKVKADRDESSPYAAMLAAQDVAQXCKELGITAMHVKLRATGGNKTKTPGPGAQSALRALARSGMKIGRIEDVTPIPTDSTRRKGGRRGRRL

SEQ ID NO: 2004 - protein, 150 aa, Brassica juncea; identical to SEQ ID NO: 1998

SEQ ID NO: 2005 - protein, 150 aa, Brassica oleracea; identical to SEQ ID NO: 2001

SEQ ID NO: 2006 - protein, 150 aa, Brassica oleracea; identical to SEQ ID NO: 1998

SEQ ID NO: 2007 - protein, 150 aa, Brassica oleracea; identical to SEQ ID NO: 2001

SEQ ID NO: 2008 - protein, 150 aa, Brassica oleracea; identical to SEQ ID NO: 1998

SEQ ID NO: 2009 - protein, 150 aa, Brassica oleracea; identical to SEQ ID NO: 1998

SEQ ID NO: 2010 - protein, 150 aa, Brassica oleracea; identical to SEQ ID NO: 1998

SEQ ID NO: 2011 - protein, 150 aa, Brassica rapa; identical to SEQ ID NO: 1998

SEQ ID NO: 2012 - protein, 150 aa, Brassica rapa; identical to SEQ ID NO: 1998

SEQ ID NO: 2013 - protein, 150 aa, Brassica rapa; identical to SEQ ID NO: 1998

SEQ ID NO: 2014 - protein, 150 aa, Brassica rapa; identical to SEQ ID NO: 2001

SEQ ID NO: 2015 - protein, 150 aa, Brassica rapa; identical to SEQ ID NO: 2001

SEQ ID NO: 2016 - protein, 150 aa, Brassica rapa; identical to SEQ ID NO: 1998

SEQ ID NO: 2017 - protein, 150 aa, Brassica rapa; identical to SEQ ID NO: 2001

SEQ ID NO: 2018 - protein, 150 aa, Brassica rapa; identical to SEQ ID NO: 2001

SEQ ID NO: 2019 - protein, 150 aa, Brassica rapa; identical to SEQ ID NO: 1998

SEQ ID NO: 2020 - protein, 150 aa, Brassica rapa; identical to SEQ ID NO: 2001

SEQ ID NO: 2021 - protein, 151 aa, Musa acuminata
MSGRKKTREPKEDNVTLGPAVREGEQVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2022 - protein, 151 aa, Musa acuminata; identical to SEQ ID NO: 2021

SEQ ID NO: 2023 - protein, 151 aa, Musa acuminata; identical to SEQ ID NO: 2021

SEQ ID NO: 2024 - protein, 151 aa, Musa acuminata
MSGRKKTREPKEENVTLGPAVREGEQVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2025 - protein, 143 aa, Musa acuminata
EPKEENVTLGPAVREGEQVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2026 - protein, 151 aa, Hordeum vulgare
MSSKRKTREPKEENVTLGPAVREGEHVFGVAHIFASFNDTFIHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 2027 - protein, 151 aa, Hordeum vulgare
MSGRKKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQAALRALARSGMKIGRIEDVTPVPTDSTRRKGGRRGRRL

SEQ ID NO: 2028 - protein, 150 aa, Hordeum vulgare
MAPKKAPRAPQENISLGPQAREGELIFGVARIFASFNDTFVHVTDLSGRETICRVTGGMKVKADRDESSPYAAMLAAQDVAIRCKELGINALHIKIRATGGNGTKTPGPGAQSALRALARSGMKIGRIEDVTPTPSDSTRRKGGRRGRRL

SEQ ID NO: 2029 - protein, 151 aa, Hordeum vulgare
MPPKKAARPAQENISLGPQLREGESNVFATARIFASFNDTFVHITDLSGRETITRVTGGMKVKADRDESSPYAAMLAAQDVATRCKELGINALHIKIRATGGNGTKTPGPGAQSALRALARSGMKIGRIEDVTPTPSDSTRRKGGRRGRRL

SEQ ID NO: 2030 - protein, 150 aa, Ocimum basilicum
MSKRRTREPKEENVTLGPATRDGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2031 - protein, 150 aa, Ocimum basilicum
MSKRRTTVPKEENVTLGPATRDGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2032 - protein, 150 aa, Phaseolus coccineus
MSRRKVREPKEENVTLGPAVRDGEHVFGVARIFASFNDTFIHVTDLSGRETLVRITGGMKVKADRDESSPYAAMLAAQDVAARCKELGITALHIRLRATGGNKTKTPGPGAQSALRALARSGMKIGRIEDVTPIPSDSTRRKSGRRGRRL

SEQ ID NO: 2033 - protein, 150 aa, Phaseolus coccineus; identical to SEQ ID NO: 2032

SEQ ID NO: 2034 - protein, 150 aa, Beta vulgaris
MSRRKTKEPKEETVTLGPTVKEGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2035 - protein, 87 aa, Brachypodium distachyon
SGRKKMREPKEENVTLGPAVREGEHVFGVAHVFASFNDTFIHVTDLSGRETLVRVTGGMKVKADRDESSPYAAMLASPDFAQRCKEL

SEQ ID NO: 2036 - protein, 92 aa, Brachypodium distachyon
MKVKADRDESSPYAAMLASQDVAARCKELGITALHIKLRATGGNKTKTPGPGAQSALRALARSGMKIGRIEDVTPVPTDSTRRKGGRRGRRL

SEQ ID NO: 2037 - protein, 150 aa, Brachypodium distachyon
MSKRKTREPKEENVTLGPAVREGEFVFGVAHIFASFNDTFIHVTDLSGRETLVRITGGMKVKADRDESSPYAAMLASQDVAARCKELGITALHIKLRATGGNKTKTPGPGAQAALRALARSGMKIGRIEDVTPVPTDSTRRKGGRRGRRL

SEQ ID NO: 2038 - protein, 150 aa, Brachypodium distachyon
MSKRKTREPKEENVTLGPTVREGEHVFGVAHIFASFNDTFIHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 2039 - protein, 205 aa, Bruguiera gymnorhiza
MSKRKTRAPKEETVTLGPQVREGEYVFGVAHIFASFNDTFIHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRGCESWLQLGQICFCPGYSHGCTPTWWNSARIHQNNLIVSIGLPCPSNNLRLNTCCNS

SEQ ID NO: 2040 - protein, 150 aa, Theobroma cacao
MSRRKVREPKEENTNLGPAVREGEHVFGVAHIFASFNDTFIHVTDLSGRETMVRITGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2041 - protein, 150 aa, Theobroma cacao
MSRRKVREPKEDNLNLGPAVREGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2042 - protein, 150 aa, Brassica napus; identical to SEQ ID NO: 2001

SEQ ID NO: 2043 - protein, 150 aa, Brassica napus; identical to SEQ ID NO: 2001

SEQ ID NO: 2044 - protein, 150 aa, Brassica napus; identical to SEQ ID NO: 1998

SEQ ID NO: 2045 - protein, 150 aa, Brassica napus; identical to SEQ ID NO: 2001

SEQ ID NO: 2046 - protein, 150 aa, Brassica napus; identical to SEQ ID NO: 1998

SEQ ID NO: 2047 - protein, 150 aa, Brassica napus; identical to SEQ ID NO: 1998

SEQ ID NO: 2048 - protein, 150 aa, Brassica napus; identical to SEQ ID NO: 1998

SEQ ID NO: 2049 - protein, 150 aa, Brassica napus; identical to SEQ ID NO: 1998

SEQ ID NO: 2050 - protein, 150 aa, Brassica napus; identical to SEQ ID NO: 1998

SEQ ID NO: 2051 - protein, 150 aa, Brassica napus; identical to SEQ ID NO: 2001

SEQ ID NO: 2052 - protein, 150 aa, Brassica napus; identical to SEQ ID NO: 1998

SEQ ID NO: 2053 - protein, 150 aa, Brassica napus; identical to SEQ ID NO: 1998

SEQ ID NO: 2054 - protein, 150 aa, Brassica napus; identical to SEQ ID NO: 1998

SEQ ID NO: 2055 - protein, 150 aa, Brassica napus; identical to SEQ ID NO: 1998

SEQ ID NO: 2056 - protein, 150 aa, Brassica napus; identical to SEQ ID NO: 1998

SEQ ID NO: 2057 - protein, 150 aa, Manihot esculenta
MSKKKTREPKEENVTLGPAVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2058 - protein, 150 aa, Manihot esculenta; identical to SEQ ID NO: 2057

SEQ ID NO: 2059 - protein, 150 aa, Manihot esculenta; identical to SEQ ID NO: 2057

SEQ ID NO: 2060 - protein, 149 aa, Ricinus communis
SKKKTREPKEENVTLGPAVREGEHVFGVAHIFASFNDTFIHVTDLSGRETLVRITGGMKVKADRDESSPYAAMLAAQDVTQRCKELGITALHIKLRATGGNKTKTPGPGAQSALRALARSGMRIGRIEDVTPIPTDSTRRKGGRRGRRL

SEQ ID NO: 2061 - protein, 150 aa, Ricinus communis
MSKKKTREPKEENVTLGPAIREGEHVFGVAHIYASFNDTFIHVTDLSGRETMVRITGGMKVKADRDESSPYAAMLAAQDVTQRCKELGITALHIKLRATGGNKTKTPGPGAQSALRALARSGMKIGRIEDVTPIPTDSTRRKGGRRGRRL

SEQ ID NO: 2062 - protein, 150 aa, Catharanthus roseus
  misc_feature (12)..(12): Xaa can be any naturally occurring amino acid
  misc_feature (49)..(49): Xaa can be any naturally occurring amino acid
  misc_feature (51)..(51): Xaa can be any naturally occurring amino acid
  misc_feature (141)..(141): Xaa can be any naturally occurring amino acid
  misc_feature (145)..(145): Xaa can be any naturally occurring amino acid
  misc_feature (148)..(149): Xaa can be any naturally occurring amino acid
MSRRKTREPKEXNVTLGPSVRDGEIVFGVAHIFASFNDTFIHVTDLSGXEXMVRITGGMKVKADRDESSPYAAMLAAQDIAQRCKELGINALHIKLRATGGNKTKTPGPGAQSALRALARSGMKIGRIEDVTPIPTDSTRXKGGXRGXXL

SEQ ID NO: 2063 - protein, 150 aa, Catharanthus roseus
MSRRKTREPKEENVTLGPSTREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2064 - protein, 151 aa, Cenchrus ciliaris
  misc_feature (69)..(69): Xaa can be any naturally occurring amino acid
  misc_feature (73)..(73): Xaa can be any naturally occurring amino acid
  misc_feature (122)..(122): Xaa can be any naturally occurring amino acid
  misc_feature (128)..(128): Xaa can be any naturally occurring amino acid
  misc_feature (146)..(146): Xaa can be any naturally occurring amino acid
MSGRKKTREPKEENVTLGPAVREGEYVFGVAHIFASFNDTFIHVTDLSGRETLVRITGGMKVKADRDEXSPYXAMLASQDVAQRCKELGITALHIKLRATGGNKTKTPGPGAQFAFRALARXGMKIGXIEDVTPVPTDSTRRKGGXRGRRL

SEQ ID NO: 2065 - protein, 150 aa, Cenchrus ciliaris
MSRRKTREPKEENVTLGPTVREGEFVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 2066 - protein, 150 aa, Centaurea maculosa
MSKRKVREPKEENVTLGPATREGELVFGVAHIFASFNDTFIHVTDISGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2067 - protein, 150 aa, Centaurea maculosa; identical to SEQ ID NO: 2066

SEQ ID NO: 2068 - protein, 151 aa, Centaurea maculosa
MSKSRKVREPKEDNVTLGPATREGELVFGVAHIFASFNDTFIHVTDISGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2069 - protein, 150 aa, Centaurea maculosa; identical to SEQ ID NO: 2066

SEQ ID NO: 2070 - protein, 150 aa, Centaurea maculosa; identical to SEQ ID NO: 2066

SEQ ID NO: 2071 - protein, 135 aa, Prunus cerasus
MSRRKTREPKEENVTLGPALRDGEHAFGVAHIFASFNDTFIHVTDLSGRETLVRITGGMKVKADRDESSPYAAMLAAQDVSQRCKELGITALHIKLRATGGNKTKTPGPGAQSALRALARSGMRIGRIGCDSNSH

SEQ ID NO: 2072 - protein, 150 aa, Castanea mollissima
MSRRKTREPKEENVTLGPATREGEQVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPSDSTRRKGGRRGRRL

SEQ ID NO: 2073 - protein, 150 aa, Castanea mollissima
MSRRKQREPKEENVTLGPATREGEQVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPSDSTRRKGGRRGRRL

SEQ ID NO: 2074 - protein, 150 aa, Castanea mollissima
MSKRKTREPKEENVTLGPAVREGEQVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPSDSTRRKGGRRGRRL

SEQ ID NO: 2075 - protein, 153 aa, Chlamydomonas reinhardtii
MAPKKAAKGDEAPKEVVSLGPTVREGEHVFGVAHIFASFNDTFVHVTDLSGRETISRVTGGMKVKADRDESSPYAAMLAAQDVAQKCKELGITALHIKLRATGGNRTKTPGPGAQSALRALARAGMKIGRIEDVTPIPTDSTRRKGGRRGRRL

SEQ ID NO: 2076 - protein, 150 aa, Cichorium intybus
  misc_feature (7)..(7): Xaa can be any naturally occurring amino acid
  misc_feature (140)..(140): Xaa can be any naturally occurring amino acid
  misc_feature (149)..(149): Xaa can be any naturally occurring amino acid
MSKRKVXEPKEENVTLGPATREGELVFGVAHIFASFNDTFIHVTDISGRETMVRITGGMKVKADRDESSPYAAMLAAQDVSQRCKELGINALHIKLRATGGNKTKTPGPGAQSALRALARSGMKIGRIEDVTPIPTDSTXRKGGRRGRXL

SEQ ID NO: 2077 - protein, 150 aa, Cichorium intybus; identical to SEQ ID NO: 2066

SEQ ID NO: 2078 - protein, 150 aa, Cichorium intybus; identical to SEQ ID NO: 2066

SEQ ID NO: 2079 - protein, 150 aa, Cichorium intybus; identical to SEQ ID NO: 2066

SEQ ID NO: 2080 - protein, 150 aa, Citrus sinensis
MSRRKTREPKEENVTLGPAVRDGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2081 - protein, 150 aa, Citrus sinensis
MSRRKNREPKEENVTLGPAVRDGEHVFGVAHIFASFNDTFIHVTDLSGRETLVRITGGMKVKADRDESSPYAAMLAAQDVSTRCKELGITALHIKLRATGGNKTKTPGPGAQSALRALARSGMKIGRIEDVTPIPTDSTRRKGGRRGRRL

SEQ ID NO: 2082 - protein, 150 aa, Coffea canephora
MSKRRTREPKEENVTLGPAVRDGEQVFGVAHIFASFNDTFIHVTDLSGRETLVRITGGMKVKADRDESSPYAAMLAAQDIAQRCKELGITALHIKLRATGGNKTKTPGPGAQSALRALARSGMKIGRIEDVTPIPTDSTRRKGGRRGRRL

SEQ ID NO: 2083 - protein, 150 aa, Coffea canephora
MSKRRQREPKEENVTLGPATRDGEQVFGVAHIFASFNDTFIHVTDLSGRETLVRITGGMKVKADRDESSPYAAMLAAQDIAQRCKELGITALHIKLRATGGNKTKTPGPGAQSALRALARSGMKIGRIEDVTPIPTDSTRRKGGRRGRRL

SEQ ID NO: 2084 - protein, 150 aa, Gossypium hirsutum
MSRRKVREPKEENTNLGPAVREGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2085 - protein, 150 aa, Gossypium hirsutum
MSRRKVREPKEENTNLGPAVPEGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2086 - protein, 150 aa, Gossypium hirsutum
MSRRKVREPKEENTTLGPAVRDGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2087 - protein, 150 aa, Gossypium hirsutum
MSRRKVREPKEETTTLGPAVRDGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2088 - protein, 158 aa, Gossypium hirsutum
TRPHPFKICPKKTTTRAPQENISLGPSVRDGELVFGVARIFASFNDTFVHVTDLSGRETITRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 2089 - protein, 150 aa, Gossypium hirsutum
MSRRKVRDPKEENTTLGPAVRDGEHVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2090 - protein, 150 aa, Gossypium hirsutum; identical to SEQ ID NO: 2087

SEQ ID NO: 2091 - protein, 150 aa, Vigna unguiculata; identical to SEQ ID NO: 2032

SEQ ID NO: 2092 - protein, 152 aa, Vigna unguiculata
MSKSKKVKQEKVEEVVSLGPQVAPGTNVFGVAHIYASFNDTFVHVTDLSGRETIAKVTGGMKVKADRDESSPYAAMLAAQDVAEKCKSLGINSLHIKLRATGGNRTKTPGPGAQSALRALARSGMKIGRIEDVTPIPTDSTRRKGGRRGRRL

SEQ ID NO: 2093 - protein, 150 aa, Vigna unguiculata; identical to SEQ ID NO: 2032

SEQ ID NO: 2094 - protein, 151 aa, Vigna unguiculata
MAPRKNKVQKEEVQVSLGPQVREGENVFGVAHIFASFNDTFVHVTDLSGRETIARVTGGMKVKADRDEASPYAAMLAAQDVAERCKVLGITALHIKLRATGGNKTKTPGPGAQSALRALARSSMKIGRIEDVTPIPSDATRRKGGRRGRRL

SEQ ID NO: 2095 - protein, 150 aa, Vigna unguiculata
MSRRKVREPKEENVTLGPAVRDGEHAFGVARIFASFNDTFIHVTDLSGRETLVRITGGMKVKADRDESSPYAAMLAAQDVATRCKELGITALHIKLRATGGNKTKTPGPGAQSALRALSRSGMKIGRIEDVTPIPSDSTRRKSGRRGRRL

SEQ ID NO: 2096 - protein, 151 aa, Cryptomeria japonica
MSGKKKTREVKEENVTLGPAVREGEHVFGVAHIFASFNDTFVHVTDLSGKETLARVTGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 2097 - protein, 151 aa, Cryptomeria japonica; identical to SEQ ID NO: 2096

SEQ ID NO: 2098 - protein, 151 aa, Cycas rumphii
MSGKKKVREVKEENVTLGPTVRDGEHVFGVAHIFASFNDTFVHVTDLSGKETLARVTGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 2099 - protein, 62 aa, Cycas rumphii
MSGKKKVREVKEENVTLGPTVREGEHVFGVAHIFASFNDTFVHVTDLSGKETLARVTGGYEG

SEQ ID NO: 2100 - protein, 151 aa, Cynara scolymus
MSSKRKVREPKEENVTLGPATREGELVFGVAHIFASFNDTFIHVTDISGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2101 - protein, 151 aa, Cynara scolymus; identical to SEQ ID NO: 2100

SEQ ID NO: 2102 - protein, 151 aa, Cynara scolymus
  misc_feature (21)..(21): Xaa can be any naturally occurring amino acid
  misc_feature (52)..(52): Xaa can be any naturally occurring amino acid
  misc_feature (74)..(74): Xaa can be any naturally occurring amino acid
MSKSRKVREPKEENVTLGPAXREGELVFGVAHIFASFNDTFIHVTDISGREXMVRITGGMKVKADRDESSPYAXMLAAQDVSQRCKELGINALHIKLRATGGNKTKTPGPGAQSALRALARSGMKIGRIEDVTPIPTDSTRRKGGRRGRRL

SEQ ID NO: 2103 - protein, 150 aa, Taraxacum officinale; identical to SEQ ID NO: 2066

SEQ ID NO: 2104 - protein, 150 aa, Taraxacum officinale; identical to SEQ ID NO: 2066

SEQ ID NO: 2105 - protein, 150 aa, Eucalyptus gunnii
MSKRKVREPKEENVTLGPAVREGEYVFGVAHIFASFNDTFIHVTDLSGRETLVRITGGMKVKADRDESSPYAAMLAAQDVAQRCKELGVTALHIKLRATGGNKTKTPGPGAQSALRALARSGMKIGRIEDVTPIPTDSTRRKGGRRGRRL

SEQ ID NO: 2106 - protein, 150 aa, Eucalyptus gunnii; identical to SEQ ID NO: 2105

SEQ ID NO: 2107 - protein, 151 aa, Festuca arundinacea
MSGRKKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQSALRALARSGMKIGRIEDVTPVPTDSTRRKGGRRGRRL

SEQ ID NO: 2108 - protein, 150 aa, Festuca arundinacea
MSKRKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQSALRALARSGMKIGRIEDVTPVPTDSTRRKGGRRGRRL

SEQ ID NO: 2109 - protein, 151 aa, Festuca arundinacea; identical to SEQ ID NO: 2107

SEQ ID NO: 2110 - protein, 177 aa, Linum usitatissimum
SSKTASEKLSRDLQLARSLPASLPAKLCRSERSGSPRRRPVTLGPNVPDGTIVFGVAHIFASFNDTFIHVTDISGRETLVRITGGMKVKADRDESSPYAAMLAAQDVSTRCKELGINALHIKLRATGGNKTKTPGPGAQSALRALARSGMKIGRIEDVTPIPTDSTRRKGGRRGRRL

SEQ ID NO: 2111 - protein, 151 aa, Zingiber officinale
MSGRKKTREPKEENVTLGPTVREGEQVFGVAHIFASFNDTFIHVTDLSGRETLVRITGGMKVKADRDESSPYAAMLAAQDVAQRCKELGITALHIKLRATGGNKTKTPGPGAQSALRALARAGMKIGRIEDVTPIPTDSTRRKGGRRGRRL

SEQ ID NO: 2112 - protein, 150 aa, Vitis vinifera
MSRRKVREPKEENVTLGPTVRDGEHVFGVAHIFASFNDTFIHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 2113 - protein, 150 aa, Vitis vinifera
MSRRKVREPKEENVTLGPTVRDGEHVFGVAHIFASFNDTFIHVTDLSGRETLVRITGGMKVKADRDESSPYAAMLAAQDVSQRCKELGVTALHIKLRATGGNKTKTPGPGAQSALRALARSGMRIGRIEDVTPIPTDSTRRKGGRRGRRL

SEQ ID NO: 2114 - protein, 150 aa, Vitis vinifera
MSRRKVREPKEENVTLGPTVRDGEHAFGVAHIFASFNDTFIHVTDLSGRETLVRITGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 2115 - protein, 150 aa, Mesembryanthemum crystallinum
MSRRKTREPKEENVTLGPALREGEHAFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKSGRRGRRL

SEQ ID NO: 2116 - protein, 150 aa, Mesembryanthemum crystallinum
MSKRRTREPKEENVTLGPAVREGEHVFGVARIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKSGRRGRRL

SEQ ID NO: 2117 - protein, 150 aa, Ipomoea nil
MSRRKTREPKEENVTLGPAIREGELVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2118 - protein, 49 aa, Ipomoea nil
MSKRKTREPKEENVTLGPAIREGELVFGVPHIFASFNDTFIHVTDLSGR

SEQ ID NO: 2119 - protein, 150 aa, Ipomoea nil; identical to SEQ ID NO: 2117

SEQ ID NO: 2120 - protein, 150 aa, Ipomoea nil
MSRRKNREPKEENVTLGPAIREGELVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2121 - protein, 150 aa, Actinidia deliciosa
MSRRKVREPKEETVTLGPSVRDGENVFGVAHIFASFNDTFIHVTDLSGRETLVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2122 - protein, 150 aa, Actinidia deliciosa
MSKRKVREPKEETVTLGPKVRDGENVFGVAHIFASFNDTFIHVTDLSGRETLVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2123 - protein, 150 aa, Actinidia deliciosa
MSRRKVREPKEETVTLGPTVREGENVFGVAHIFASFNDTFIHVTDLSGRETLVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2124 - protein, 150 aa, Lactuca sativa; identical to SEQ ID NO: 2066

SEQ ID NO: 2125 - protein, 151 aa, Leymus cinereus x Leymus triticoides; identical to SEQ ID NO: 2026

SEQ ID NO: 2126 - protein, 150 aa, Liriodendron tulipifera
MSRRKTREPKEENVTLGPTVREGENVFGVAHIFASFNDTFIHVTDLSGRETMVRVTGGMKVKADRDESSPYAAMLAAQDVAQRCKELGITALHIKLRATGGNKTKTPGPGAQSALRALARSGMKIGRIEDVTPIPHDSTRRKGGRRGRRL

SEQ ID NO: 2127 - protein, 150 aa, Liriodendron tulipifera
MSRRKTREPKEENVTLGPTVREGENVFGVAHVYASFNDTFIHVTDLSGRETLVRVTGGMKVKADRDESSPYAAMLAAQDVAQRCKELGITALHIKLRATGGNKTKTPGPGAQSALRALARSGMKIGRIEDKTPIPHDSTRRKGGRRGRRL

SEQ ID NO: 2128 - protein, 150 aa, Lotus japonicus
MSKRKVREPKEDNVTLGPAVRDGEHVFGVARIFASFNDTFIHVTDLSGRETLVRITGGMKVKADRDESSPYAAMLAAQDVATRCKELGITALHIKLRATGGNKTKTPGPGAQAALRALARSGMKIGRIEDVTPIPSDSTRRKSGRRGRRL

SEQ ID NO: 2129 - protein, 150 aa, Lotus japonicus
MSKRKVREPKEDNVTLGPAVRDGEHVFGVARIFASFNDTFIHVTDLSGRETLVRITGGMKVKADRDESSPYAAMLAAQDVATRCKELGITALHIRLRATGGNKTKTPGPGAQAALRALARSGMKIGRIEDVTPIPSDSTRRKSGRRGRRL

SEQ ID NO: 2130 - protein, 151 aa, Eragrostis curvula
MSGRRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2131 - protein, 150 aa, Eragrostis curvula
MSRRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2132 - protein, 150 aa, Zea mays
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 2133 - protein, 151 aa, Zea mays
MSGRKKTREPKEENVTLGPAVREGEHVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2134 - protein, 160 aa, Zea mays
MSRRKTREPKEENVTLGPTVREGEYVFGVAHIFASFNDTFIEGNTGSDHWYYRAMKVKADRDESLPYAAMLAAQDAAQRCKELGITALNIKLRAIGGNKIKTPGPGAQSALRALARSGMKIGRIENVTPVPTDSIRRKGGRKGKEAVGVFDISWRWPSSS

SEQ ID NO: 2135 - protein, 150 aa, Zea mays; identical to SEQ ID NO: 2065

SEQ ID NO: 2136 - protein, 150 aa, Zea mays; identical to SEQ ID NO: 2132

SEQ ID NO: 2137 - protein, 191 aa, Zea mays
MSRRKTREPKEENVTLGPTVREGEFVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVPLTALPKRAVGGEGSCKPLLRAICWLLSGGHHEASPLWVVLLFSVFVKTSFNFALCG

SEQ ID NO: 2138 - protein, 150 aa, Zea mays; identical to SEQ ID NO: 1998

SEQ ID NO: 2139 - protein, 150 aa, Zea mays
MSRRKTREPKEETVTLGPAVRDGEQVFGVVHIFASFNDTFIHVIDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2140 - protein, 150 aa, Zea mays; identical to SEQ ID NO: 2132

SEQ ID NO: 2141 - protein, 151 aa, Marchantia polymorpha
MSGKKKVREVKEDNVTLGPSVREGEHVFGVAHIFASFNDTFVHVSDLSGKETICRVTGGMKVKADRDESSPYAAMLAAQDVAVRCKELGITALHIKLRATGGNKTKTPGPGAQSALRALARSGMRIGRIEDVTPIPTDSTRRKGGRRGRRL

SEQ ID NO: 2142 - protein, 151 aa, Marchantia polymorpha
MSGKKKVREVKEENVTLGPTVREGEHVFGVAHIFASFNDTFVHVTDLSGKETICRVTGGMKVKADRDESSPYAAMLAAQDVAQRCKELGITALHIKLRATGGNKTKTPGPGAQSALRALARSGMRIGRIEDVTPIPTDSTRRKGGRRGRRL

SEQ ID NO: 2143 - protein, 151 aa, Medicago truncatula
MSSKRKVREPKEETVTLGPAVKDGEQVFGVARIFASFNDTFIHVTDLSGRETLVRITGGMKVKADRDESSPYAAMLAAQDVATRCKELGITALHIKLRATGGNKTKTPGPGAQAALRALARSGMKIGRIEDVTPIPSDSTRRKSGRRGRRL

SEQ ID NO: 2144 - protein, 151 aa, Medicago truncatula
MSSKRKVREPKEETVTLGPAVKDGEHVFGVARIFASFNDTFIHVTDLSGRETLVRITGGMKVKADRDESSPYAAMLAAQDVATRCKELGITALHIKLRATGGNKTKTPGPGAQAALRALARSGMKVGRIEDVTPIPSDSTRRKSGRRGRRL

SEQ ID NO: 2145 - protein, 150 aa, Cucumis melo
MSRRKTREPKEETVTLGPAVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMRIGRIEDVTPIPTDSTRRKGGRRGRRL

SEQ ID NO: 2146 - protein, 151 aa, Cucumis melo
MAPKGKKVERKEENISLGPQIREGELVFGVARIFASFNDTFVHVTDLSGRETITRVTGGMKVKADRDESSPYAAMLAAQDVAVRCKEVGITALHIKIRATGGNGTKTPGPGAQSALRALARSGMKIGRIEDVTPTPSDSTRRKGGRRGRRL

SEQ ID NO: 2147 - protein, 60 aa, Cucumis melo
MSGSRRKTREPKEETVTLGPAVREGEHVFGVAHIFASFNDTFIHVTDLSGRETLVALQVV

SEQ ID NO: 2148 - protein, 150 aa, Cucumis melo; identical to SEQ ID NO: 2145

SEQ ID NO: 2149 - protein, 152 aa, Mesostigma viride
MASKKVKQPKADGEATTSGPQVREGEHVFGVAHIFASFNDTFVHVTDLSGKETLVRITGGMKVKADRDEASPYAAMLAAQDVAVRCKELGITALHIKLRATGGNKTKTPGPGAQSALRALARSGMKIGRIEDVTPIPTDSTRRKGGRRGRRL

SEQ ID NO: 2150 - protein, 150 aa, Pennisetum glaucum
MSKRKTREPKEETVTLGPTVREGEHVFGVAHVFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2151 - protein, 152 aa, Pennisetum glaucum
TRGGVGSSGVLVISTARRARLRSPVAPRNHVEEKDQEPKEENVTLGPTVREGEFVFGVAHIFASFNDTFIHVTDLSGRETLVRITGGMKVKADRDESSPYAAMLAAQDVAVRCKELGITALHIKLRATGGNKTKTPGPGAQSALRALARSGM

SEQ ID NO: 2152 - protein, 151 aa, Nuphar advena
MSGRKKTREVKEENVTLGPNVREGEHVFGVAHIFASFNDTFVHITDLSGRETLVRITGGMKVKADRDESSPYAAMLAAQDVAQRCKELGITALHIKLRATGGNKTRTPGPGAQSALRALARSGMRIGRIEDVTPIPTDSTRRKGGRRGRRL

SEQ ID NO: 2153 - protein, 151 aa, Nuphar advena; identical to SEQ ID NO: 2152

SEQ ID NO: 2154 - protein, 151 aa, Nuphar advena
MSGRKKTREVKEENVTLGPNVREGEHVFGVAHIFASFNDTFVHVTDLSGRETLVRITGGMKVKADRDESSPYAAMLAAQDVAQRCKELGITALHIKLRATGGNKTRAPGPGAQSALRALSRSGMRIGRIEDVTPIPTDSTRRKGGRRGRRL

SEQ ID NO: 2155 - protein, 150 aa, Quercus rubra; identical to SEQ ID NO: 2073

SEQ ID NO: 2156 - protein, 150 aa, Quercus rubra; identical to SEQ ID NO: 2072

SEQ ID NO: 2157 - protein, 150 aa, Quercus rubra; identical to SEQ ID NO: 2074

SEQ ID NO: 2158 - protein, 150 aa, Elaeis guineensis
MSRRKTREPKEENVTLGPTVREGEHVFGVAHIFASFNDTFIHVTDLSGRETMVRITGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2159 - protein, 150 aa, Elaeis guineensis; identical to SEQ ID NO: 2158

SEQ ID NO: 2160 - protein, 150 aa, Elaeis guineensis; identical to SEQ ID NO: 2158

SEQ ID NO: 2161 - protein, 150 aa, Allium cepa
MSRKKVREPKEENVTLGPAVREGEHVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2162 - protein, 150 aa, Carica papaya
MSKRKTREPKEENVTLGPAVREGEHVFGVVHIYASFNDTFIHVTDLSGRETLVRITGGMKVKADRDESSPYAAMLAAQDVAQRCKELGITALHVKLRATGGNKTKTPGPGAQSALRALARSGMRIGRIEDVTPIPTDSTRRKGGRRGRRL

SEQ ID NO: 2163 - protein, 150 aa, Carica papaya; identical to SEQ ID NO: 2162

SEQ ID NO: 2164 - protein, 150 aa, Prunus persica; identical to SEQ ID NO: 1989

SEQ ID NO: 2165 - protein, 150 aa, Arachis hypogaea
MSRRKVREPKEETVTLGPAVREGEHVFGVARIFASFNDTFIHVTDLSGRETLVRITGGMKVKADRDESSPYAAMLAAQDVAARCKELGITALHIKLRATGGNKTKTPGPGAQSALRALARSGMKIGRIEDVTPIPSDSTRRKSGRRGRRL

SEQ ID NO: 2166 - protein, 150 aa, Arachis hypogaea; identical to SEQ ID NO: 2165

SEQ ID NO: 2167 - protein, 150 aa, Capsicum annuum
MSKRRTREPKEETVTLGPSVREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2168 - protein, 150 aa, Capsicum annuum
MSRRKTREPKEETVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2169 - protein, 150 aa, Capsicum annuum; identical to SEQ ID NO: 2168

SEQ ID NO: 2170 - protein, 150 aa, Catharanthus roseus; identical to SEQ ID NO: 2062
  misc_feature (12)..(12): Xaa can be any naturally occurring amino acid
  misc_feature (49)..(49): Xaa can be any naturally occurring amino acid
  misc_feature (51)..(51): Xaa can be any naturally occurring amino acid
  misc_feature (141)..(141): Xaa can be any naturally occurring amino acid
  misc_feature (145)..(145): Xaa can be any naturally occurring amino acid
  misc_feature (148)..(149): Xaa can be any naturally occurring amino acid

SEQ ID NO: 2171 - protein, 150 aa, Catharanthus roseus; identical to SEQ ID NO: 2063

SEQ ID NO: 2172 - protein, 187 aa, Physcomitrella patens
LYQRPPLLFALFRALSLSLSLSLSPSSASGVSTAYTMSGKKKVRAEKEENVTLGPSVRDGEHVFGVAHIFASFNDTFVHVTDLSGKETIARVTGGMKVKADRDEASPYAAMLAAQDVAQRCKELGITALHIKLRATGGNKTKTPGPGAQSALRALARSGMRIGRIEDVTPIPTDSTRRKGGRRGRRL

SEQ ID NO: 2173 - protein, 151 aa, Physcomitrella patens
MSGKKKVRAEKEENVTLGPSVRDGEHVFGVAHIFASFNDTFVHVTDLSGKETIARVTGGMKVKADRDEASPYAAMLAAQDVAQRCKELGITALHIKLRATGGNKTKTPGPGAQSALRALARSNMRIGRIEDVTPIPTDSTRRKGGRRGRRL

SEQ ID NO: 2174 - protein, 151 aa, Pinus taeda
MSGKKKVREPKEDNVTLGPTVREGEQVFGVAHIFASFNDTFVHVTDLSGKETMARVTGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2175 - protein, 151 aa, Pinus taeda
MSGRKKVREPKEETVTLGPSVREGEQVFGVAHIFASFNDTFVHVTDLSGKETLARVTGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2176 - protein, 151 aa, Pinus taeda
MSGKKKVREPKEDNVTLGPTVREGEHVFGVAHIFASFNDTFVHVTDLSGKETMARVTGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2177 - protein, 151 aa, Pinus taeda
MAPKKTTTRAPQENISLGPSVRDGELVFGVARIFASFNDTFVHVTDLSGRETITRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 2178 - protein, 151 aa, Pinus taeda
MSGRKKVREPKEETVTLGPSVRDGEQVFGVAHIFASFNDTFVHVTDLSGKETLARVTGGMKVKADRDESSPYAAMLAAQDVAQRCKELGITALHIKLRATGGNKTKTPGPGAQSALRALARSGMKIGRIEDVTPIPTDSTRRKGGRRGRRL

SEQ ID NO: 2179 - protein, 150 aa, Populus trichocarpa
MSRRKTREPKEENVTLGPTVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2180 - protein, 150 aa, Populus trichocarpa
MSKRRTREPKEENVTLGPTVREGEHAFGVAHIFASFNDTFIHVTDLSGRETLVRITGGMKVKADRDESSPYAAMLAAQDVSQRCKELGITALHIKLRATGGNKTKTPGPGAQSALRALARSGMRIGRIEDVTPIPTDSTRRKGGRRGRRL

SEQ ID NO: 2181 - protein, 151 aa, Populus trichocarpa
MSSRRKTREPKEENVTLGPTVREGEHAFGVAHIFASFNDTFIHVTDLSGRETLVRITGGMKVKADRDESSPYAAMLAAQDVSQRCKELGITALHIKLRATGGNKTKTPGPGAQSALRALSRSGMRIGRIEDVTPIPTDSTRRKGGRRGRRL

SEQ ID NO: 2182 - protein, 150 aa, Populus trichocarpa
MSKRRTREPKEENVTLGPTVREGEHVFGVAHIFASFNDTFIHVTDLSGRETLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2183 - protein, 150 aa, Papaver somniferum
MSRRKVREPPEENVTLGPAVRDGEFVFGVAHIFASFNDTFIHVTDLSGRETLVRITGGMKVKADRDESSPYAAMLAAQDVAARCKELGVTALHIKLRATGGNKTKTPGPGAQSALRALARSGMRIGRIEDVTPIPTDSTRRKGGRRGRRL

SEQ ID NO: 2184 - protein, 150 aa, Papaver somniferum
MSRRKVREPKEETVTLGPSVRDGEHVFGVAHIFASFNDTFIHVTDLSGRETLVRITGGMKVKADRDESSPYAAMLAAQDVAARCKELGVTALHIKLRATGGNKTKTPGPGAQSALRALARSGMRVGRIEDVTPIPTDSTRRKGGRRGRRL

SEQ ID NO: 2185 - protein, 150 aa, Solanum tuberosum; identical to SEQ ID NO: 2168

SEQ ID NO: 2186 - protein, 150 aa, Solanum tuberosum
MSKRKTREPKEETVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2187 - protein, 150 aa, Solanum tuberosum; identical to SEQ ID NO: 2186

SEQ ID NO: 2188 - protein, 150 aa, Solanum tuberosum; identical to SEQ ID NO: 2167

SEQ ID NO: 2189 - protein, 92 aa, Solanum tuberosum
MKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2190 - protein, 150 aa, Prunus persica; identical to SEQ ID NO: 1988

SEQ ID NO: 2191 - protein, 150 aa, Prunus persica; identical to SEQ ID NO: 1989

SEQ ID NO: 2192 - protein, 151 aa, Pseudoroegneria spicata; identical to SEQ ID NO: 2027

SEQ ID NO: 2193 - protein, 151 aa, Pseudoroegneria spicata; identical to SEQ ID NO: 2026

SEQ ID NO: 2194 - protein, 150 aa, Raphanus sativus; identical to SEQ ID NO: 1998

SEQ ID NO: 2195 - protein, 150 aa, Raphanus sativus
MSRRKTREPKEETVTLGPAVRDGEQVFGVVHIFASFNDTFIHVTDLSGRETLVRITGGMKVKADRDESSPYAAMLAAQDVAQRCKELGITAMHVKLGATGGNKTKTPGPGAQSALRALARSGMKIGRIEDVTPIPTDSTRRKGGRRGRRL

SEQ ID NO: 2196 - protein, 150 aa, Raphanus sativus; identical to SEQ ID NO: 1998

SEQ ID NO: 2197 - protein, 150 aa, Raphanus sativus; identical to SEQ ID NO: 1998

SEQ ID NO: 2198 - protein, 150 aa, Raphanus sativus; identical to SEQ ID NO: 1998

SEQ ID NO: 2199 - protein, 150 aa, Raphanus sativus; identical to SEQ ID NO: 1998

SEQ ID NO: 2200 - protein, 150 aa, Raphanus sativus; identical to SEQ ID NO: 1998

SEQ ID NO: 2201 - protein, 150 aa, Raphanus sativus; identical to SEQ ID NO: 1998

SEQ ID NO: 2202 - protein, 127 aa, Raphanus sativus
MSRRKTREPKEETVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARWHEDWPH

SEQ ID NO: 2203 - protein, 150 aa, Raphanus sativus; identical to SEQ ID NO: 1998

SEQ ID NO: 2204 - protein, 150 aa, Raphanus sativus; identical to SEQ ID NO: 1998

SEQ ID NO: 2205 - protein, 150 aa, Raphanus sativus; identical to SEQ ID NO: 1998

SEQ ID NO: 2206 - protein, 150 aa, Raphanus sativus; identical to SEQ ID NO: 1998

SEQ ID NO: 2207 - protein, 150 aa, Raphanus sativus; identical to SEQ ID NO: 1998

SEQ ID NO: 2208 - protein, 150 aa, Raphanus sativus; identical to SEQ ID NO: 1998

SEQ ID NO: 2209 - protein, 150 aa, Raphanus sativus; identical to SEQ ID NO: 1998

SEQ ID NO: 2210 - protein, 150 aa, Raphanus sativus
  misc_feature (49)..(49): Xaa can be any naturally occurring amino acid
MSRRKTREPKEETVTLGPAVRDGEQVFGVVHIFASFNDTFIHVTDLSGXETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2211 - protein, 150 aa, Raphanus sativus; identical to SEQ ID NO: 1998

SEQ ID NO: 2212 - protein, 150 aa, Raphanus sativus
MSRRKTREPKEVTVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2213 - protein, 150 aa, Raphanus sativus; identical to SEQ ID NO: 1998

SEQ ID NO: 2214 - protein, 150 aa, Raphanus sativus
  misc_feature (115)..(115): Xaa can be any naturally occurring amino acid
MSRRKTREPKEETVTLGPAVRDGEQVFGVVHIFASFNDTFIHVTDLSGRETLVRITGGMKVKADRDESSPYAAMLAAQDVAQRCKELGITAMHVKLRATGGNKTKTPGPGAQSAXRALARSGMKIGRIEDVTPIPTDSTRRKGGRRGRRL

SEQ ID NO: 2215 - protein, 150 aa, Raphanus sativus; identical to SEQ ID NO: 1998

SEQ ID NO: 2216 - protein, 150 aa, Raphanus sativus; identical to SEQ ID NO: 1998

SEQ ID NO: 2217 - protein, 150 aa, Oryza sativa
MSKRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2218 - protein, 150 aa, Rosa hybrid cultivar
MSKRKVREPKEENVTLGPAVRDGEHVFGVAHIFASFNDTFIHVTDLSGRETLVRITGGMKVKADRDESSPYAAMLAAQDVSTRCKELGITALHIKLRATGGNKTKTPGPGAQSALRALARSGMRIGRIEDVTPIPTDSTRRKGGRRGRRL

SEQ ID NO: 2219 - protein, 190 aa, Secale cereale
MSGRKKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQAALRALARSGMKIGRIEDVTPVPTDSTRRKGGRKEGGCNSMLVQDGTIPSYRYSVSCNLVCTTPFMMLSQILWIYRF

SEQ ID NO: 2220 - protein, 151 aa, Carthamus tinctorius; identical to SEQ ID NO: 2068

SEQ ID NO: 2221 - protein, 150 aa, Carthamus tinctorius
  misc_feature (7)..(7): Xaa can be any naturally occurring amino acid
  misc_feature (17)..(17): Xaa can be any naturally occurring amino acid
MSKRKVXEPKEENVTLXPATREGELVFGVAHIFASFNDTFIHVTDISGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2222 - protein, 99 aa, Carthamus tinctorius
  misc_feature (15)..(15): Xaa can be any naturally occurring amino acid
  misc_feature (28)..(28): Xaa can be any naturally occurring amino acid
  misc_feature (38)..(38): Xaa can be any naturally occurring amino acid
  misc_feature (54)..(54): Xaa can be any naturally occurring amino acid
  misc_feature (61)..(61): Xaa can be any naturally occurring amino acid
  misc_feature (86)..(86): Xaa can be any naturally occurring amino acid
MVRITGGMKVKADRXESSPYAAMLAAQXVSQRCKELGXNALHIKLRATGGNKTXTPGPGAXSALRALARSGMKIGRIEDVTPIPTXSTRRKGGRRGRRL

SEQ ID NO: 2223 - protein, 150 aa, Senecio madagascariensis
MSKRKVREPKEDNVTLGPATREGELVFGVAHIFASFNDTFIHVTDISGRETMVRITGGMKVKADRDESSPYAAMLAAQDVSTRCKELGINALHIKLRATGGNKTKSPGPGAQSALRALARSGMKIGRIEDVTPIPTDSTRRKSGRRGRRL

SEQ ID NO: 2224 - protein, 150 aa, Sorghum bicolor; identical to SEQ ID NO: 2131

SEQ ID NO: 2225 - protein, 150 aa, Sorghum bicolor; identical to SEQ ID NO: 2131

SEQ ID NO: 2226 - protein, 150 aa, Sorghum bicolor; identical to SEQ ID NO: 2131

SEQ ID NO: 2227 - protein, 150 aa, Glycine max
MSRRKVREPKEENVTLGPAVRDGEHVFGVARIFASFNDTFIHVTDLSGRETLVRITGGMKVKADRDESSPYAAMLAAQDVAARCKELGITALHIKLRATGGNKTKTPGPGAQSALRALARSGMKIGRIEDVTPIPSDSTRRKSGRRGRRL

SEQ ID NO: 2228 - protein, 150 aa, Glycine max; identical to SEQ ID NO: 2227

SEQ ID NO: 2229 - protein, 150 aa, Glycine max; identical to SEQ ID NO: 2032

SEQ ID NO: 2230 - protein, 151 aa, Selaginella moellendorffii
MSGKKRTKEVKEENVTLGPSVRDGEQVFGVAHIFASFNDTFVHVTDLSGKETLARVTGGMKVKADRDEASPYAAMLAAQDVAAKCKDLGINALHIKLRATGGNKTKQPGPGAQSALRALARSGMKIGRIEDVTPIPTDSTRRKGGRRGRRL

SEQ ID NO: 2231 - protein, 151 aa, Selaginella moellendorffii; identical to SEQ ID NO: 2230

SEQ ID NO: 2232 - protein, 151 aa, Picea glauca
MSGKKKVREPKEDNVTLGPTVREGEQVFGVAHIFASFNDTFVHVTDLSGKETIARVTGGMKVKADRDESSPYAAMLAAQDVAQRCKELGLTALHIKLRATGGNKTKTPGPGAQSALRALARSGMKIGRIEDVTPIPTDSTRRKGGRRGRRL

SEQ ID NO: 2233 - protein, 151 aa, Picea glauca
MSGRKKVREPKEETVTLGPTVRENEQVFGVAHIFASFNDTFVHVTDLSGKETMARVTGGMKVKADRDESSPYAAMLAAQDVAQRCKELGITALHIKLRATGGNKTKTPGPGAQSALRALARSGLKIGRIEDVTPIPTDSTRRKGGRRGRRL

SEQ ID NO: 2234 - protein, 150 aa, Picea glauca
MPPKKAVRPAQENISLGPNVREGELVFGVARIFASFNDTFVHVTDLSGRETIVRVTGGMKVKADRDESSPYAAMLAAQDVAVRCKELGINALHIKIRATGGNGTKTPGPGAQSALRALARSGMKIGRIEDVTPTPSDSTRRKGGRRGRRL

SEQ ID NO: 2235 - protein, 150 aa, Picea glauca
MAPKAKPARVQENVQLGPQTREGELVFGVARIFASFNDTFVHVTDLSGRETISRVTGGMKVKADRDESSPYAAMLAAQDVAARCKELGITALHVKIRATGGNGTKTPGPGAQSALRALARAGMKIGRIEDVTPTPSDSTRRKGGRRGRRL

SEQ ID NO: 2236 - protein, 151 aa, Picea glauca
MPPKKKVERGAQENIQLGPQVREGELVFGVARIFASFNDTFVHITDLSGRETISRVTGGMKVKADRDESSPYAAMLAAQDVAARCKELGISALHVKIRATGGNGTKTPGPGAQSALRALARAGMRIGRIEDVTPTPSDSTRRKGGRRGRRL

SEQ ID NO: 2237 - protein, 151 aa, Picea glauca
MAPRKNKVAKEEVQVTLGPQHLVGETVFGVAHIFASFNDTFVHVTDLSGRETIARVTGGMKVKADRDEASPYAAMLAAQDVAEKCKLLGISALHIKLRATGGNKTKTPGPGAQSALRALARSSMKIGRIEDVTPVPSDSTRRKGGRRGRRL

SEQ ID NO: 2238 - protein, 151 aa, Picea glauca
MAPRKGKVQKEEPVIQLGPQVQEGELVYGVAHIFASFNDTFVHVTDLSGRETIARVTGGMKVKADRDEASPYAAMLAAQDVAEKCKLLGITALHIKLRATGGNKTKTPGPGAQSALRALARSSMKIGRIEDVTPIPSDCTRRKGGRRGRRL

SEQ ID NO: 2239 - protein, 88 aa, Euphorbia esula
MSRRKTREPKEENVTLGPALRDGEHAFGVAHIFASFNDTFIHVTDLSGRETLVRITGGMKVKADRDESSPYAAMLQHRMFPRDARNSE

SEQ ID NO: 2240 - protein, 150 aa, Euphorbia esula
MSKRRTREPKEENVTLGPALRDGEHAFGVAHIFASFNDTFIHVTDLSGRESLVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2241 - protein, 150 aa, Fragaria vesca
MSKRKVREPKEETVTLGPTVRDGEHVFGVAHIFASFNDTFIHVTDLSGRETLVRITGGMKVKADRDESSPYAAMLAAQDVSTRCKELGITALHIKLRATGGNKTKTPGPGAQSALRALARSGMRIGRIEDVTPIPTDSTRRKGGRRGRRL

SEQ ID NO: 2242 - protein, 151 aa, Fragaria vesca
MSKHKKTREPKEENVTLGPAVRDGEHVFGVAHIFASFNDTFIHVTDLSGRETLVRITGGMKVKADRDESSPYAAMLAAQDVSTRCKELGITALHIKLRATGGNKTKTPGPGAQSALRALARSGMRIGRIEDVTPIPTDSTRRKGGRRGRRL

SEQ ID NO: 2243 - protein, 151 aa, Fragaria vesca [sequence omitted]

SEQ ID NO: 2244 - protein, 189 aa, Saccharum officinarum
  misc_feature (151)..(151): Xaa can be any naturally occurring amino acid
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRLXASLLHAICHPFGHQEARPLWGSVAVSMLVKRSFNFALC

SEQ ID NO: 2245 - protein, 151 aa, Saccharum officinarum; identical to SEQ ID NO: 2133

SEQ ID NO: 2246 - protein, 150 aa, Saccharum officinarum; identical to SEQ ID NO: 2065

SEQ ID NO: 2247 - protein, 189 aa, Saccharum officinarum
  misc_feature (151)..(151): Xaa can be any naturally occurring amino acid
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRKKGGRRGKRLXASLLHAICHPFGHQETKTLWGSVAGSIAGKRSFNFALC

SEQ ID NO: 2248 - protein, 150 aa, Saccharum officinarum
  misc_feature (141)..(141): Xaa can be any naturally occurring amino acid
  misc_feature (147)..(147): Xaa can be any naturally occurring amino acid
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRXKGGRRXRRL

SEQ ID NO: 2249 - protein, 151 aa, Saccharum officinarum; identical to SEQ ID NO: 2133

SEQ ID NO: 2250 - protein, 92 aa, Saccharum officinarum
MKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 2251 - protein, 150 aa, Helianthus annuus
MSKRKVREPKEDNVTLGPATREGELVFGVAHIFASFNDTFIHVTDLSGRETMVRITGGMKVKADRDESSPYAAMLAAQDVSTRCKELGINALHIKLRATGGNKTKTPGPGAQSALRALARSGMKIGRIEDVTPIPTDSTRRKSGRRGRRL

SEQ ID NO: 2252 - protein, 150 aa, Helianthus annuus
MSKRKTREPKEDNVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKSGRRGRRL

SEQ ID NO: 2253 - protein, 150 aa, Helianthus annuus; identical to SEQ ID NO: 2251

SEQ ID NO: 2254 - protein, 151 aa, Helianthus annuus
MAPRKGKVQQEQVQVHLGPQVREGEIVFGVAHIFASFNDTFVHVTDLSGRETIARVTGGMKVKADRDEASPYAAMLAAQDVAEKCKTLGITALHIKLRATGGNKTKTPGPGAQSALRALARSSMKIGRIEDVTPIPTDATRRKGGRRGRRL

SEQ ID NO: 2255 - protein, 150 aa, Panicum virgatum
MSRRKTREPKEENVTLGPTVREGEFVFGVAHIFASFNDTFIHVTDLSGRETLVRITGGMKVKADRDESSPYAAMLAAQDVAARCKELGITALHIKLRATGGNKTKTPGPGAQSALRALARSGMKIGRIEDVTPVPTDSTRRKGGRRGRRL

SEQ ID NO: 2256 - protein, 151 aa, Panicum virgatum
MSGRKKTREPKEENVTLGPAVREGEYVFGVAHIFASFNDTFIHVTDLSGRETLVRITGGMKVKADRDESSPYAAMLASQDVAQRCKELGITALHIKLRATGGNKTKSPGPGAQSALRALARSGMKIGRIEDVTPVPTDSTRRKGGRRGRRL

SEQ ID NO: 2257 - protein, 150 aa, Panicum virgatum; identical to SEQ ID NO: 2150

SEQ ID NO: 2258 - protein, 150 aa, Panicum virgatum
MSRRKTREPKEENVTLGPTVREGEYVFGVAHVFASFNDTFIHVTDLSGRETLVRITGGMKVKADRDESSPYAAMLAAQDVAARCKELGITALHIKLRATGGNKTKTPGPGAQSALRALARSGMKIGRIEDVTPVPTDSTRRKGGRRGRRL

SEQ ID NO: 2259 - protein, 191 aa, Panicum virgatum
MGPRKGQTQPKQEQVSLGPQIAEGELNFGVAHIYASFNDTFVHVTDLSGKETIARVTGGMKVKADRDEASPYAAMLAAQDVAERCRGLGITALHVRLRATGGNKTKTPGPGAQSALRALARSGIKIGRIEDVTPVPSDSTRRKVVDVVVVYKPSTIHQHNTQIRSLYSTNCFCVYSTLFSISFFLIHLSSL

SEQ ID NO: 2260 - protein, 151 aa, Panicum virgatum
MSGRRKTREPKEENVTLGPAVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2261 - protein, 151 aa, Panicum virgatum
MSGRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSTRRKGGRRGRRL

SEQ ID NO: 2262 - protein, 151 aa, Panicum virgatum
MSGRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKSPGPGAQSALRALARSGMKIGRIEDVTPVPTDSTRRKGGRRGRRL

SEQ ID NO: 2263 - protein, 92 aa, Panicum virgatum
MKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 2264 - protein, 66 aa, Panicum virgatum
  misc_feature (41)..(41): Xaa can be any naturally occurring amino acid
MPPKQKVARAPQENIQLGPQVREGELVFGVAVSLPHSTTPXSTSPICLGRETISRVHRWHEGQGRP

SEQ ID NO: 2265 - protein, 150 aa, Tamarix hispida
  misc_feature (141)..(141): Xaa can be any naturally occurring amino acid
MSRRKTREPKEEAVTLGPAVREGEHVFGVCHIFASFNDTFIHVTDLSGRETMVRITGGMKVKADRDESSPYAAMLAAQDVAQRCKELGITALHIKLRATGGNKTKTPGPGAQSALRALARSGMKIGRIEDVTPIPTDSTRXKGGRRGRRL

SEQ ID NO: 2266 - protein, 150 aa, Tamarix hispida
MPPKKVVRAPQENISLGPSVRDGELVFGVARIFASFNDTFVHVTDLSGRETICRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 2267 - protein, 150 aa, Thellungiella halophila
MSRRKTREPKEENVTLGPAVREGEQVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2268 - protein, 150 aa, Thellungiella halophila
MSRRKTREPKEENVTLGPAVREGENVFGVVHIFASFNDTFIHVTDLSGRETLVRITGGMKVKADRDESSPYAAMLAAQDVAQRCKELGITAMHVKLRATGGNKTKTPGPGAQSALRALARSGMKIGRIEDVTPIPTDSTRRKGGRRGRRL

SEQ ID NO: 2269 - protein, 151 aa, Nicotiana tabacum
MAPRKGKVQQEQVQVHLGPQVREGEIVFGVAHIFASFNDTFVHVTDLSGRETIARVTGGMKVKADRDEASPYAAMLAAQDVAEKCKTLGITALHIKLRATGGNKTKTPGPGVQSALRALARSSMKIGRIEDVTPIPSDATRRKGGRRGRRL

SEQ ID NO: 2270 - protein, 151 aa, Nicotiana tabacum
EFLQPTKVVKEEVNVALGPQVREGELVFGVAHIFASFNDTFVHVTDLSGRETVSRVTGGMKVKADRDESSPYAAMLAAQDVAARCKEVGITALHVKLRATGGTQTKTPGPGGQAALRALARAGMRIGRIEDVTPVPTDSTRRKGGRRGRRL

SEQ ID NO: 2271 - protein, 150 aa, Nicotiana tabacum
MSKRRTREPKEETVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2272 - protein, 150 aa, Nicotiana tabacum; identical to SEQ ID NO: 2271

SEQ ID NO: 2273 - protein, 150 aa, Nicotiana tabacum; identical to SEQ ID NO: 2168

SEQ ID NO: 2274 - protein, 150 aa, Nicotiana tabacum
MSKRRTREPKEETVILGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 2275 - protein, 150 aa, Solanum lycopersicum; identical to SEQ ID NO: 2167

SEQ ID NO: 2276 - protein, 150 aa, Solanum lycopersicum; identical to SEQ ID NO: 2168

SEQ ID NO: 2277 - protein, 150 aa, Solanum lycopersicum; identical to SEQ ID NO: 2168

SEQ ID NO: 2278 - protein, 150 aa, Triphysaria pusilla
MSKRKTREPKEENVTLGPATRDGEFVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2279 - protein, 150 aa, Triphysaria pusilla
MSKRKTREPKEDNVTLGPSTKDGEFVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGRRL

SEQ ID NO: 2280 - protein, 150 aa, Triphysaria pusilla; identical to SEQ ID NO: 2279

SEQ ID NO: 2281 - protein, 148 aa, Triphysaria pusilla
MSKRKTREPKEENVTLGPATRDGEFVFGVAHIFASFNDTFIHVTDLSGRETMVRITGGMKVKADRDESSPYAAMLAAQDVSQRCKELGITALHIKLRATGGNKTKTPGPGAQSALRALARSGMKIGRIEDVTPIPTDSTRRKGGRRGR

SEQ ID NO: 2282 - protein, 153 aa, Volvox carteri
MAPKKSAKADDAPKEVVSLGPTVREGEHVFGVAHIFASFNDTFVHVTDLSGRETISRVTGGMKVKADRDESSPYAAMLAAQDVAQKCKELGITALHIKLRATGGNRTKTPGPGAQSALRALARAGMKIGRIEDVTPIPTDSTRRKGGRRGRRL

SEQ ID NO: 2283 - protein, 150 aa, Juglans hindsii x Juglans regia
MSKRKTREPKEENVTLGPATREGEQVFGVAHIYASFNDTFLHVTDLSGRETLVRITGGMKVKADRDVSSPYAAMLAAQDVAQRCKELGITALHIKLRATGGNKTKTPGPGAQSALRALARSGMKIGRIEDVTPIPSDSTRRKGGRRGRRL

SEQ ID NO: 2284 - protein, 150 aa, Juglans hindsii x Juglans regia
MSRKKTREPKEENVTLGPAVREGEQVFGVAHIYASFNDTFLHVTDLSGRETLVRITGGMKVKADRDESSPYAAMLAAQDVAQRCKELGITALHIKLRATGGNKTKTPGPGAQSALRALARSGMKIGRIEDVTPIPSDSTRRKGGRRGRRL

SEQ ID NO: 2285 - protein, 151 aa, Triticum aestivum; identical to SEQ ID NO: 2027

SEQ ID NO: 2286 - protein, 151 aa, Triticum aestivum; identical to SEQ ID NO: 2026

SEQ ID NO: 2287 - protein, 151 aa, Triticum aestivum; identical to SEQ ID NO: 2027

SEQ ID NO: 2288 - protein, 151 aa, Triticum aestivum; identical to SEQ ID NO: 2026

SEQ ID NO: 2289 - protein, 150 aa, Triticum aestivum
MSKRKTREPKEENVTLGPAVREGEHVFGVAHVFASFNDTFIHVTDLSGRETLVRITGGMKVKADRDESSPYAAMLASQDVATRCKELGITALHIKLRATGGNKTKTPGPGAQSALRALARSGMKIGRIEDVTPVPTDSTRRKGGRRGRRL

SEQ ID NO: 2290 - protein, 149 aa, Triticum aestivum
  misc_feature (13)..(13): Xaa can be any naturally occurring amino acid
MAPRKAKVEKTEXVVQLGPQVAEGENVFGVAHIYASFNDTFVHVTDLSGKETIVRITGGMKVKADRDEASPYAAMLAAQDVAARCKEIGINALHIKLRATGGTRTKTPGPGAQSALRALARSGMKIGRIEDVTPIPSDHTRRKGAAEDD

SEQ ID NO: 2291 - protein, 151 aa, Triticum aestivum
MPPKKTATRAPQENISLGPSVRDGELVFGVARIFASFNDTFVHVTDLSGRETITRVTGGMKVKADRDESSPYAAMLAAQDVAARCKELGINALHIKIRATGGNGTKTPGPGAQSALRALARAGMKIGRIEDVTPTPSDSTRRKGGRRGRRL

SEQ ID NO: 2292 - protein, 135 aa, Triticum aestivum
MSRRKTREPKEENVTLGPTVREGEYVFGVAHIFASFNDTFIHITDLSGRETLVRITGGMKVKADRDESSPYAAMLAAQDVAQRCKELGITALHIKLRATGRQQDQDPWTWCQSALKALARSGMKIGRIEDVTRSH

SEQ ID NO: 2293 - protein, 151 aa, Triticum aestivum
MSSKRKTREPKEENVTLGPAVSEGEHVFGVAHIFASFNDTFIHVIDLSGRETLVRITGGMKVKADCDESSPYAAMLASQDVATRCKELGITALHIKLRATGGNKTKTPGPGAQSALRALARSGMKIGRIEDVTLVPTDSTRRKGGRRGRRL

SEQ ID NO: 2294 - protein, 158 aa, Triticum aestivum
TRGKQAKNKEVKKERAPKEEVILGPQGVNAGENVFAVAHIYATFNDTFIHVTDLTGRETIARVTGGMKVKADRDESSPYAAMLAAQDVAARCKQIGITALHIKLRAKGGNQTKTPGPGAQSALRALARAGMKIGRIEDVTPVPHDCTRRKGGRRGRRL

SEQ ID NO: 2295 - protein, 151 aa, Zamia vazquezii
MSGKKKVREVKEENVTLGPTVREGEHVFGVAHIFASFNDTFVHVTDLSGKETIARVTGGMKVKADRDESSPYAAMLAAQDVAQRCKDLGITALHIKLRATGGNKTKTPGPGAQSALRALARSGMRIGRIEDVTPIPTDSTRRKGGRRGRRL

SEQ ID NO: 2296 - protein, 213 aa, Hordeum vulgare
MGTVVDAPAAVTEKEVVAENMLGDKKVTVVFVLGGPGSGKGTQCANIVEHFGFTHLSAGDLLRAEIKSGSENGTMIENMIKEGKIVPSEVTIKLLQQAMIKNENDKFLIDGFPRNEENRAAFENVTKISPAFVLFFNCSEEEMERRLLGRNEGRVDDNIETIRKRFKVFVESSLPVIEYYDAKDKVKKIDAAKPIPEVFEDVKAIFAPFAKAA

SEQ ID NO: 2297 - protein, 213 aa, Brachypodium distachyon
MGTVVDAPAAVTQKEEVAENMLGNKKVTVVFVLGGPGSGKGTQCSNIVEHFGFTHLSAGDLLRAEIKSGSENGTMIENMIKEGKIVPSEVTIKLLQQAMINNENDKFLIDGFPRNEENRAAFENVTKISPAFVLFFNCSEEEMERRLMGRNEGRVDDNIETIRKRFKVFVESSLPVIEYYDAKEKVKKIDAAKPIPEVFEDVKAIFAPYAKAA

SEQ ID NO: 2298 - protein, 212 aa, Cenchrus ciliaris
MGTVVDAPAAVAEEVTENMLGGKKVTVVFVLGGPGSGKGTQCANIVEHFGFTHLSAGDLLRAEIKSGSENGTMIENMIKEGKIVPSEVTIKLLQQAMIKSENDKFLIDGFPRNEENRAAFENVTKISPAFVLFFDCSEEEMERRLLGRNQGRVDDNIETIKKRFKTFVESSLPVIEHYNSKDKVKKIDAAKPIPEVFEDVKAIFAPYAPKAE

SEQ ID NO: 2299 - protein, 213 aa, Festuca arundinacea
MGTVVDAPAVVTENEEVAVNMLGDKKVTVVFVLGGPGSGKGTQCANIVEHFGFTHLSAGDLLRAELKSGSENGTMIENMIKEGKIVPSEVTIALLKEAMIKNENDKFLIDGFPRNEENRAAFEHVTKISPAFVLFFNCSEEEMQKRLLGRNEGRVDDNIETIKKRFNVFAESSLPVIEYYRAKEKVKEINAAKPIPEVFEDVKAIFAPYAKAS

SEQ ID NO: 2300 - protein, 213 aa, Leymus cinereus x Leymus triticoides
MGTVVDAPAVVTEKEVVAENMLGDKKVTVVFVLGGPGSGKGTQCANIVEHFGFTHLSAGDLLRAEIKSGSENGTMIENMIKEGKIVPSEVTIKLLQQAMIKNENDKFLIDGFPRNEENRAAFENVTKISPAFVLFFNCSEEEMERRLLGRNEGRVDDNIETIRKRFKVFVESSLPVIEYYDAKDKVKKIDAAKPIPEVFEDVKAIFAPYAKAA

SEQ ID NO: 2301 - protein, 211 aa, Eragrostis curvula
MGTVMDAPAAEVEITENMLGGKKVTVVFVLGGPGSGKGTQCANIVEHFGFTHLSAGDLLRAEIKSGSENGTMIENMIKEGKIVPSEVTIKLLQEAMIKSENDKFLIDGFPRNEENRAAFENVTKISPDFVLFFDCSEEEMERRLLGRNQGRVDDNIETIRKRFKVFVESSLPVIEYYSSKDKVKKIDAAKPIPEVFEDVKAIFAPYAPKAE

SEQ ID NO: 2302 - protein, 212 aa, Zea mays
MGTVVDAPAVVAEEVTENMLGGKKVTAVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEKEMEKRLLGRNQGRVDDNIETIKKRFKTFVESSLPVIEHYNSRDKVKKIDAAKPIPEVFEDVKTIFAPYAPKAE

SEQ ID NO: 2303 - protein, 139 aa, Avena sativa
MIENMIKEGKIVPSEVTIKLLKQAMIKDENDRFLIDGFPRNEENRAAFELVTKISPAFVLFFNCSEEEMEKRLLGRNEGRVDDNIETIRKRFKVFVESSLPVIEYYRAKDKVKEIDAAKPIPEVFEDVKAIFAPYAKAA

SEQ ID NO: 2304 - protein, 213 aa, Pseudoroegneria spicata
MGTVVDAPAVVTEKEVVAENMLGDKKVTVVFVLGGPGSGKGTQCSNIVEHFGFTHLSAGDLLRAEIKSGSENGTMIENMIKEGKIVPSEVTIKLLQQAMIKNENDKFLIDGFPRNEENRAAFENVTKISPAFVLFFNCSEEEMERRLLGRNEGRVDDNIETIRKRFKVFVESSLPVIEYYDAKDKVKKIDAAKPIPEVFEDVKAIFAPYAKAA

SEQ ID NO: 2305 - protein, 214 aa, Oryza sativa
MGSVVDAPTVVAGQEEVTDNMLGDKKVTVVFVLGGPGSGKGTQCANIVEHFGFIHLSAGDLLRAEIKSGSENGTMIENMIKEGKIVPSEVTIKLLQEAMIKSGNDKFLIDGFPRNEENRAAFENVTKITPAFVLFFDCSEEEMERRLLGRNQGRVDDNIETIRKRFKVFVESSLPVIEYYNAKDKVKKIDAAKPIPEVFEDVKAIFAPYAPNAA

SEQ ID NO: 2306 - protein, 210 aa, Oryza sativa
MGSVVDAPVVVEGVAENMLGDKKVTVVFVLGGPGSGKGTQCANIVEHFGFTHLSAGDLLRAEIKSGSENGTMIENMIKEGKIVPSEVTIKLLQDAMIKNENDKFLIDGFPRNEENRAAFENVTKISPAFVLFFDCSEEEMERRLLGRNQGRVDDNIETIRKRFKVFVESSLPVIEHYNAKNKVKKIDAAKPISEVFEDVKAIFAPYAKVE

SEQ ID NO: 2307 - protein, 213 aa, Sorghum bicolor
MGTVVDAAPAVVAEEVTENMLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEHYNSRDKVKKIDAAKPIPEVFEDVKAIFAPFSSKAE

SEQ ID NO: 2308 - protein, 212 aa, Sorghum bicolor
MGTAVDASAAVAEEVTENMLGGKKVTVVFVLGGPGSGKGTQCTNIVEHFGFTHLSAGDLLRAEIKSGSENGTMIDNMIKEGKIVPSEVTIKLLKEAMIKSENDKFLIDGFPRNEENRAAFENVTKISPAFVLFFDCAEEEMERRLLGRNQGRVDDNIETIRKRFKVFVESSLPVIEYYSSKDKVKKIDAAKPIPEVFEDVKAIFAPYAPKVE

SEQ ID NO: 2309 - protein, 213 aa, Saccharum officinarum
MGTVVDAAPAVVAEEVTEHMLGGKKVTVVFVLGGPGSGKGTQCANIVEHFGFTHLSAGDLLRAEIKSGSENGTMIENMIKEGKIVPSEVTIKLLQEAMIKNENEKFLIDGFPRNEENRAAFENVTKISPAFVLFFDCSEEEMERRLLGRNQGRVDDNIETIKKRFKTFVESSLPVIEHYNSRDKVKKIDAAKPIPEVFEDVKAIFAPYSPKAE

SEQ ID NO: 2310 - protein, 213 aa, Saccharum officinarum
MGTVVDAAPAVVAEEVTENMLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEHYNSRNKVKKIDAAKPIPEVFEDVKAIFAPYSPKAE

SEQ ID NO: 2311 - protein, 212 aa, Panicum virgatum
MGTVVDAPAVVTEEVAENTLGGKKVTVVFVLGGPGSGKGTQCANIVEYFGFTHLSAGDLLRAEIKSGSENGTMIENMIKEGKIVPSEVTIKLLQEAMIKNENDKFLIDGFPRNEENRAAFENVTKISPAFVLFFDCSEKEMERRLLGRNQGRVDDNIETIKKRFKTFVESSLPVIEYYNSKDKVKKIDAAKPIPEVFEDVKTIFAPYAPKAE

SEQ ID NO: 2312 - protein, 212 aa, Panicum virgatum
MGTVVDAPAVVTEEVAENTLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEYYNSKDKVKKIDAAKPIPEVFEDVKTIFAPYAPKAE

SEQ ID NO: 2313 - protein, 490 aa, Arabidopsis thaliana
MGFDSVKVMENWQSKTSNENEKKKKKRRRKKNNNVRNSEHYEEEANGCWVKFRYIVCCASSTSDVETSLTLSTSTVGSQSAIVQSNDQPVGPVSSTTTTSNAESSLSTPIISEELNIYSHLKKFSFIDLKLATRNFRPESLLGEGGFGCVFKGWVEENGTAPVKPGTGLTVAVKTLNPDGLQGHKEWLAEINYLGNLLHPNLVKLVGYCIEDDQRLLVYEFMPRGSLENHLFRRSLPLPWSIRMKIALGAAKGLSFLHEEALKPVIYRDFKTSNILLDGEYNAKLSDFGLAKDAPDEGKTHVSTRVMGTYGYAAPEYVMTGHLTSKSDVYSFGVVLLEMLTGRRSMDKNRPNGEHNLVEWARPHLLDKRRFYRLLDPRLEGHFSVKGAQKVTQLAAQCLSRDSKIRPKMSEVVEVLKPLPHLKDMASASYYFQTMQAERLKAGSGSGSGRGFGSRNGQPVFRTLSSPHGQAGSSPYRHQIPSPKPKGATT

SEQ ID NO: 2314 - protein, 470 aa, Brassica rapa
  misc_feature (320)..(320): Xaa can be any naturally occurring amino acid
  misc_feature (349)..(349): Xaa can be any naturally occurring amino acid
  misc_feature (368)..(368): Xaa can be any naturally occurring amino acid
KKKKNNGGGDEEEEASGCWLNLRFMFGCVPSKPDVDGASSSPSLYATTSPIVESKQANEKPNDQPVSSTTTTTTTSNAGSSSSTPMISEELKVYSNLTKFTFNDLKLATRNFRPESLLGEGGFGCVFKGWIQEHGTAPVKPGTGLTVAVKTLNPDGLQGHKEWLAEINFLGNLLHPNLVKLVGYCIEDDQRLLVYEFMPRGSLENHLFRRSLPLPWCIRMKIAVGAAKGLSFLHEEALKPVIYRDFKTSNILLDSDYNAKLSDFGLAKDAPDEGKTHVSTRVMGTYGYAAPEYVMTGHLTSKSDVYSFGVVLLEMLTGRXSMDKNRPNGEHNLVEWARPHLLDKRRFYXLLDPRLEGHFSIKGAQKVXQLAAQCLSRDPKVRPKMSDVVEALKPLPHLKDMASSSYYFQTMQAERLKNGSSRSQGGGNGFGSRNGQPQPVFRTLSSPHGQHGSSPYRHQVPSPKPKGATT

SEQ ID NO: 2315 - protein, 488 aa, Brassica napus
  misc_feature (79)..(80): Xaa can be any naturally occurring amino acid
  misc_feature (123)..(123): Xaa can be any naturally occurring amino acid
  misc_feature (131)..(131): Xaa can be any naturally occurring amino acid
MSLDSVKVMEQSNKPNESEKKKKRKKQKKNNVRNNEEEEEEANGCWVKFRVMVCCLPSTTDVDSSSPTLSTTTLGSKSXXTVKSNEQPAGPVSSSTTATSNAESSLSTPMISEELKIYSHLKXFSFLDLKXATRNFRPESLLGEGGFGCVFKGWVEENGTAPVKPGTGLTVAVKTLNLDGLQGHKEWLAEINYLGNLLHPNLVKLVGYCIEDDQRLLVYEFMPRGSLENHLFRRSLPLPWSIRMRIALGAAKGLSFLHEEALKPVIYRDFKTSNILLDSDYNAKLSDFGLAKDAPDEGKTHVSTRVMGTYGYAAPEYVMTGHLTSMSDVYSFGVVLLEMLTGRRSMDKNRPSGEQNLVEWARPHLLDRRRFYRLLDPRLEGHFSIKGAQKVTQLAAQCLSRDSKIRPKMSEVVEVLKPLPLLKDMASSSYYFQTMQAERLKAGSGSGRGLGSRNGQPVLRTLSSPHGQAGSSPYRHQIPSPMPKGATT

SEQ ID NO: 2316 - protein, 345 aa, Arabidopsis thaliana
MAESCRVRRIKLGSQGLEVSAQGLGCMGLTGHYGASKPETEAIALIHHAIHSGVTFLDTSDMYGPETNEILLGKALKDGVREKVELATKFGISYAEGNREIKGDPAYVRAACEASLKRLDVTCIDLYYQHRIDTRVPIEITMGELKKLIEEGKIKYIGLSEASASTIRRAHTVHPITAVQLEWSLWTRDVEEEIVPTCRELGIGIVSYSPLGRGFFASGPKLVENLDNNDFRKALPRFQQENLDHNKILYEKVSAMSEKKGCTPAQLALAWVHHQGDDVCPIPGTTKIENLNQNIRALSVKLTPEEMSELETIAQPESVKGERYMATVPTFKNSDTPPLSSWNAV

SEQ ID NO: 2317 - protein, 345 aa, Arabidopsis thaliana
MAEACGVRRMKLGSQGLEVSAQGLGCMGLSAFYGAPKPENEAIALIHHAIHSGVTLLDTSDIYGPETNEVLLGKALKDGVREKVELATKFGISYAEGKREVRGDPEYVRAACEASLKRLDIACIDLYYQHRVDTRVPIEITMGELKKLVEEGKIKYIGLSEASASTIRRAHAVHPITAVQIEWSLWTRDVEEEIIPTCRELGIGIVAYSPLGRGFFASGPKLVENLEKDDFRKALPRFQEENLDHNKIVYEKVCAISEKKGCTPGQLALAWVHHQGDDVCPIPGTTKIENLKQNIGALSVKLTPEEMTELEAIAQPGFVKGDRYSNMIPTFKNAETPPLSAWKAA

SEQ ID NO: 2318 - protein, 251 aa, Arabidopsis thaliana
MAEACGVRRIKLGSQGLEVSAQGLGCMGLSAFYGTPKPETEAIALIHHAIHSGVTFLDTSDIYGPETNELLLSKALKDGVREKVELATKYGIRYAEGKVEFKGDPAYVRAACEASLMRVDVACIDLYYQHRIDTRVPIEITIGELKKLVEEGKIKYIGLSEASASTIRRAHAVHPITALQIEWSLWSRDVEEDIIPTCRELGIGIVAYSPLGRGFFASGPKLVENLDNNDVRKANSTKIPTGKLRPQQDSL

SEQ ID NO: 2319 - protein, 345 aa, Brassica rapa
MAEASGVKRMKLGSQGLEVSAQGLGCMGLSSFYGAPKPETDAIALLHHAIESGVTFLDTSDIYGPQTNELLLGKALKNGLREKIELASKFGISYGEGKREIKGDPLYVRAACEASLKRLDVDCIDLYYQHRIDTRVPIEITMGELKKLVEEGKIKYIGLSEASASTIRRAHAVHPITAVQLEWSLWSRDVEEDIIPTCRELGIGIVAYSPLGRGFFASGPKLVEKLDQNDFRKTLPRFQQENLDHNKIMYEKVCAMSEKKGCTPGQLALAWVHHQGDDVCPIPGTTKIENLNQNIGALSVKLTPDEMLELENIVQAESVKGERYGNMLATFKNSDTPPLSSWKPA

SEQ ID NO: 2320 - protein, 345 aa, Brassica napus
MAEASGVKRMKLGSQGLEVSAQGLGCMGLSSFYGTPKPESDAMALLHHAIESGVTFLDTSDIYGPQTNELLLGKALKNGFREKVELASKFGISYGEGKREIKGDPFYVRAACEASLKRLDVDCIDLYYQHRIDTRVPIEITMGELKKLVEEGKIKYIGLSEASASTIRRAHAVHPITAVQLEWSLWSRDVEEEITPTCRELGIGIVAYSPLGRGFFASGPKLVEKLDQNDFRKTLPRFQQENLDHNKILYEKVCAMSEKKGCTPGQLALAWVHHQGDDVCPIPGTTKIQNLNLNIGALSVKLTPDEMLELETIVQAESVKGERYGNMLATFKNSDTPPLSSWKPA

SEQ ID NO: 2321 - protein, 345 aa, Brassica napus
  misc_feature (5)..(5): Xaa can be any naturally occurring amino acid
  misc_feature (82)..(82): Xaa can be any naturally occurring amino acid
  misc_feature (116)..(116): Xaa can be any naturally occurring amino acid
  misc_feature (251)..(251): Xaa can be any naturally occurring amino acid
  misc_feature (255)..(255): Xaa can be any naturally occurring amino acid
  misc_feature (265)..(265): Xaa can be any naturally occurring amino acid
  misc_feature (272)..(272): Xaa can be any naturally occurring amino acid
MAEAXGVKRMKLGSQGVEVSAQGLGCMGLSTLYGAPKPETDAITLLHHAIDTGVTFLDTSDIYGPETNELLLGKALKNGFRXKIELATKFGIIYGEGEREIKGDPAYVRAACEASXKRLDVDCIDLYYQHRIDTRVPIEITMGELKKLVEEGKIKYIGLSEASASTIRRAHAVHPITAVQLEWSLWTRDGEEDIIPTCRELGIGIVAYSPLGRGFFAAGPKLLEKLDNDDFRKRLPRFKQENLDHNKILYXKVCXMSEKKGCTPXQLALAWXHHQGDDVCPIPGTTKIENLNQNIGALSVKLTPEEMSELETIGHPESVKGERFSNMVPNFKNSDTPPLSSWKAA

SEQ ID NO: 2322 - protein, 346 aa, Brassica napus
MAEACGVRRMKLGSQGLEVSAQGLGCMGLSAFYGAPTPETNAVALLRHAIKAGVTFLDTSDIYGPETNELLLGKALKDGLREKVELATKFGIIASEDGKFGFRADPEYVRSACEASLRRLGVTSIDLYYQHRIDTTVPIEVTMGELKKLVEEGKIKYIGLSEASASTIRRAHAVHPITAVQIEWSLWSRDVEEDIIPTCRELGIGIVAYSPLGRGFLAAGPKLAENLEDDDYRKGLPRFQEENLNHNKILYEKVQAMATKKGCTPAQLALAWVHHQGDDVCPIPGTSKIENLNQNIGALSVKLTPEEMAELEAIARPDFVKGERYDSNMATYKDSETPLLSSWKAA

SEQ ID NO: 2323 - protein, 346 aa, Raphanus sativus
  misc_feature (255)..(255): Xaa can be any naturally occurring amino acid
  misc_feature (306)..(307): Xaa can be any naturally occurring amino acid
MAEACGVRRMKLGSQGLEVSAQGLGCMGLSAFYGAPTPETNAVALLRHAINAGVTFLDTSDIYGPETNELLLGKALKDGLREKVELATKFGIIASEDGKFGFRADPEYVRSACEASLRRLGVTSIDLYYQHRIDTTVPIEVTMGELKKLVEEGKIKYIGLSEASASTIRRAHAVHPITAVQIEWSLWSRDVEEDIIPTCRELGIGIVAYSPLGRGFLAAGPKLAENLEDDDYRKGLPRFQEENLKHNKILYEKVXAMATKKSCTPAQLALAWVHHQGDDVCPIPGTSKIENLNQNIGALSVKLTPXXMAELEAIARPDFVKGERYDSDMTTYKDSETPPLSSWKAA

SEQ ID NO: 2324 - protein, 346 aa, Raphanus sativus
MAETCGVKRMKLGSQGLEVSAQGLGCMGLSSFYGAPQPETDAIALLHHAINSGVTFLDTSDIYGPQTNELLLGKALKNNGLREKIELATKFGISYAEGKREIKGDPLYVRAACEASLKRLDVDCIDLYYQHRIDTRVPIEITMGELKKLVEEGKIKYIGLSEASASTIRRAHAIHPITAVQLEWSLWSRDVEEEIIPTCRELGIGIVAYSPLGRGFFASGPKLVEKLDKNDFRKTLPRFQQENLDHNKILYEKVCAMSEKKGCTPGQLALAWVHHQGDDVCPIPGTTKIENLNQNIGALSVKLTPEDMTELETIVQSESVKGDRYGNMMATFKNSDTPPLSSWKTA

SEQ ID NO: 2325 - protein, 426 aa, Brassica rapa
MATLYNQVPSVSAIFSLYTSFSAITMLFRTILNEIVPKRIREYVALKAMDLFSSYFQSNFTFVIEQRWEFVENQTFRAAEVYLPTRLAGLSTGKLLVGSSNLKNPAAEPKLGIPVNTKIIDEFEGIHLEWTLHSVETKKYLPEKRYFHLTCKKEFREKIMTDYFTYLAKSAEKIMSHRENLKIYTYNQDRSKWESAIFEHHTTFETLAVEPQLKNTLIEDLDAFSKGKDFFKSVGRAWKRGYLLYGPPGTGKSSMVAAIANHMKYHIYDLQIQSVRDDGELREILTSTKNRSILLIEDIDCGADASRRRQIKKKKDDGGEDDGEPQKGKKKFEVGISLSGLLNFVDGLWSSCGEEKIIIFTTNHKEKLDPALLRPGRMDVHILMDNCTPFVFKKLVAMYLKTDDHALFDPIEKLVLEVSATPAEVT

SEQ ID NO: 2326 - protein, 481 aa, Brassica napus
MATLYNQVPSVSAIFSLYTSFSAITMLFRTILNEIVPKRIREYVALKAMDLFSSYFQSNFTFVIEQRWEFVENQTFRAAEVYLPTRLAGLSTGKLLVGSSNLKNPAAEPKLGIPVNTKIIDEFEGIHLEWTLHSVETKKYLPEKRYFHLTCKKEFREKIMTDYFTYLAKSAEKIMSHRENLKIYTYNQDRSKWESAIFEHHTTFETLAVEPQLKNTLIEDLDAFSKGKDFFKSVGRAWKRGYLLYGPPGTGKSSMVAAIANHMKYHIYDLQIQSVRDDGELREILTSTKNRSILLIEDIDCGADASRRRQTKKKKDDGDEGDGDGEPHKGKKKFEVGISLSGLLNFVDGLWSSCGEEKIIIFTTNHKEKLDPALLRPGRMDVHILMDNCTPFVFKKLVAMYLKTDDHALFDPIEKLVLEVSATPAEVTQQLMASKVADIALKVLLEFLKTKKTKKEEDTKVEEDGEIEDAETKEAEPEEET

SEQ ID NO: 2327 - protein, 235 aa, Raphanus sativus
MGKDKTLPLLDTREPPELTETKPASRVWAKEFRQESKRLWELAGPAIFTAISQYSLGALTQTFSGRIGELELAAVSVENSVISGLAFGVMLGMGSALETLCGQAYGAGQLRMLGIYMQRSWVILFTTALCLLPVYIWAPPILSFFGEAPHISKAAGKFALWMIPQLFAYSANFPIQKFLQSQGKVLVMAWISGVVLIIHAVFSWLFIIYFKWGLVVQPSPSIPHGGLLYRSALYI

SEQ ID NO: 2328 - protein, 441 aa, Arabidopsis thaliana
MGLSNDRIKFNVGGRIFETTATTLANAGRDSFFGALFDENWNLSQPGDLFIDRNPDCFAVLLDLLRTGDLNIPPNIPERLLHKEAMFYGLIDHLRTAKWGPFDGNRLHLSRSVTGIAPGDGTAIRAGPDGGCCIAHGSVVHVFDWMLEEHPTINLDYQRVNDVGWIDSGNIVLSACERLGRGDGGMGLFSSSSGELRYKFQVSHDNQVKSYSAGALSFSPDSKIFTSCKGRSNEYGIGVWDQSTGKQVDFFYESPGWSLGDADKLQWLSGKNCLLVATLFPRKDNCYISLLDFREKNMVWSWSDIGFLTMAEEKRVRDAIAMEESNSICVVNEFEDLGFIDLRMDGGGSSVRWSSRSRLMKSKMPDEPCYPKLALHEGQLFSSMNDSISVFCGSDWVLTSRLKRSYGGSICDFSIGGDRLFALHSEENVFDVWETLPPPII

SEQ ID NO: 2329 - protein, 444 aa, Ricinus communis
MKIPKDRIRFNVGGRIFETTSTTLANAGRNSFFGALFDDNWSFIINDTNPNSEFFIDRNPDCFSILLDLLRTGDLHIPSHVPERMLHKEAAFYGLLDHVRSAKWGPFDGNRLRHSRSVTGRAPGDGTAIRAGPDGGCCVAHGSMVHVYDWMMEEHPPINLDYQRVNDVGWIDSENVIVSACERLGRGDGGMGLFSKSTGELRYKFQVCHENQFKSYTAGALSTSSDYRIFTSCKGRSNEYGIGVWDQITGKQIDFFYESPGWSLGDADKLQWLNGSNCLLVATLFPRKDNCYISLLDFREKRMVWSWSDIGAPITVDEKRVRDAIAMEDCNSICVVNEYEDLGFMDLRISGGSVRWSSRSRLMKGKMPDEPCYPKLALHEGQLFSSMDDCISMFCGPDWVLTSRLRRSYGGSICDFSIGGDRLFALHSEENVFDVWETTPPPII

SEQ ID NO: 2330 - protein, 443 aa, Gossypium hirsutum
MGVQKDVVKFNVGGRIFQTTATTLANAGRDSFFGALFDDNWDLQQPPNNRQEFFIDRNPDCFAVLLDLLRTGDLYIPSNVPERLLYREAMFYGLIDHVRSAKWGPFDGNRLKLSRSVTGRAPGDGTAIRAGPDGGCCVAHGSMVHIFDWMLEEHPPINLDYQRVNDIGWVNSEHVLISACERLGKGDGGMGLFSSSTGDLRYKFNVVHDNQIKSYTAGALSFSPDYKIFASCKGRSNEYGIGVWDQVTGKQMDFFYESPGWSLGDADKLQWLNESNCLLVATLFPRKDNCYISLLDFREKRMVWSWSDIGAPFTVDEKRVRDAIAMEECNSVCVVNEYDDLGFIDLRINGGSVRWSSRSRLLKGKMPDEPCYPKLALHNGQLFSSMNDSISVFCGPDWVLTSRLRRSYGGSICDFSIGGDRLFALQSEENVFDVWETPPPPVI

SEQ ID NO: 2331 - protein, 432 aa, Nicotiana benthamiana
MGIQKDRVKFNVGGRIFETTTTTLANAGRNSLFGAMFDNDWNLNSDATTTEHFIDRNPDCFSVLLDLLRTGELYLPQNLPEKLLYRESMYYGLLDHVRSAKWGPFDGNRLGLAKSVTGRAPGDGTAIRAGPDGGCCVAHGSMVHVYDWMLEEHPAINLDYQRVNDAGWVDSENIVLSACERLGKGDGGMGLFSASNGELRYKFHVKHENQVKSYTAGALSFSSDYKLFSSCKGRSNEYGIGVWDQVTGKQIDFFYEPPGWSLGDADKLQWLHGTNCLLVATLFPRKDNCYISLLDFRDKSMVWSWSDVGAPITDERRVRDAIAMEETSSICVVNEYEDLGFMDLRSAGSVRWSSRSRLMKGKMPDEPCYPKLALHEGQLFSSMNDCISVFCGPDYVLTSRLRRNYGGSICDFSIGGDRLFALHSEENVFDIW

SEQ ID NO: 2332 - protein, 446 aa, Populus trichocarpa
MKIPKDRVRFNVGGRIFETTSTTLANAGRNSFFGALFSENWTLKQPNTDSFSNCEFFIDRNPDCFSVLLDLLRTGDLNIPPNVSERHIYREASFYGLLDHVRSAKWGQFDGNRLRHSRSVTGRAPGDGTAIRAGPDGGCCVAHGSVVHVYDWIMEEHPPLNLDYQRVNDVAWVDSENIIISACERLGRGDGGMGLFSKSTGELRYKFQVCHENQVKSFTAGALSTSSDYKIFSSCKGRSNEYGVGVWDQVTGKQIDFLYESPGWSLGDADKLQWLNGSNCLLVATLFPRKDNCYISMLDFRDKRMVWSWSDFGAPITVDEKRVRDAIAMEDSNAICVVNEYEDLGFMDLRMNGGSVRWSSRSRMMKGKLSDEPCYPKLALHGGQLFSSMDDCISVFCGPDWVLTSRLRQGYGGSICDFSIGGDRLFALHSEENVFDVWETPPPPIS

SEQ ID NO: 2333 - protein, 446 aa, Populus trichocarpa
MKIPKDRVRFNVGGRVFETTSTTLANAGRNSFFGALFNENWTLKQPNNDSFSHCEFFIDRNPDCFSVLLDLLRTGDLNISPNIPERQLYREASFYGLLDHVRSAKWGQFDGNRLRHSRSVTGQAPGDGTAIRAGPDGGCCVAHGSVVHVYDWIMEEYPPLNLDYQRVNDVGWVDGESIIISACEKLGRGDGGMGLFSKTTGELRYKFQVCHENQVKSFTAGALSTSSDYKIFSSCKGRSNEYGIGVWDQVTGKQIDFFYESPGWSLGDADKLQWLNGSNCLLVATLFPRKDNCYISMLDFRDKRMVWSWSDFGAPITVDEKRVRDAIAMEDNNAICVVNEYEDLGFMDLRMNGGSVRWSSRSRMMKGKLSDEPCYPKLALHEGQLFSSMDDCISVFCGPDWVLTSRLRQSYGGSICDFSIGGDRLFALHSEENVFDVWETPPPPIS

SEQ ID NO: 2334 - protein, 441 aa, Solanum tuberosum
MGIQKDRVKFNVGGRIFETTATTLANAGRNSLFGAMFDDEWNLNSDATIIEHFIDRNPNCFSVLLDLLRTGELYLPQNLPEKLLYREALFYGLLDHVRSAKWGPFDGNRLRLARSVTGQAPGDGTAIRAGPDGGCCVAHGSMVHVYDWMMEEHPPINLDYQRVNDAGWIDSENIVLSACERLGKGDGGMGLFSASTGELRYKFNVKHENQVKSYTAGALSFSSDYKLFSSCKGRSNEYGIGVWDQVTGKQIDFFYEPPGWSLGDADKLQWLHGTNCLLVATLFPRKDNCYISLLDFRDKSMVWSWSDIGTPITDERRVRDAIAMEETSSICVVNEYEDLGFMDLRRNAGSVRWSSRSRLMKGKMPDEPCYPKLALHDGQLFSSMNDCISVFCGPDWVLTSRLRRSYGGSICDFSIGGDRLFALHSEENVFDIWETSPPPII

SEQ ID NO: 2335 - protein, 446 aa, Glycine max
MGVQKDRVKFNVGGRVMETTSTTLANAGRNSMFGAMFDDNWNLIPNNDDNNNNERFIDRNPDCFAILLDLLRTGELYVPPDIPEKLLYREALYYGLLDHVRAAKWGPFDGNRLRLSRSLQGQAPGDGTAIRAGPDGGCCVAHGSMVHVYDWMLDEHPPLNLDYQRVNDVGWVDSDNIVIGVSERLGRGDGGMGLFSSHTGELRYKFHVCHDNQVKSYTAGALSFSSDYKIFSSCKGRSNEYGVGVWDQVTGKQIDFFYEPLGWSLGDADKLQWMEGSNCLLVATMFPRKDNCYISLLDFRDKKMVWCWSDVGAPFAVDEKRVRDAIAMEDNNSICVVNEFEDLGFMDLRSSAANSIRWSSRSRLMKGKMPEEPCYPKLALHGGQLFSSMNDCISVFCGPEWVLTSRLRRSYGGSICDFSIGGDRLFALHSEENVVDIWETPTPPII

SEQ ID NO: 2336 - protein, 445 aa, Glycine max
MGVQKDRVKFNVGGRVMETTSTTLANAGRNSMFGAMFDDNWNLIPNNDNNKNERFIDRNPDCFAILLDLLRTGELHVPPNIPEKLLYREALYYGLLDHVRAAKWGPFDGNRLRLSRSLQGQAPGDGTAVRAGPDGGCCVAHGSMVHVYDWMLEEHRPLNLDYQRVNDVGWVDSDNVVIGVSERLGRGDGGMGLFSSHTGELRYKFHVCHDNQVKSYTAGALSFSSDYKIFSSCKGRSNEYGVGVWDQVTGKQIDFFYEPLGWSLGDADKLQWMEGSNCLLVATMFPRKDNCYISLLDFRDKKMVWCWSDVGAPFAVDEKRVRDAIAMEDNNSICVVNEFEDLGFMDLRSSAANSIRWSSRSRLMKGKMPEEPCYPKLALHGGQLFSSMNDCISVFCGPEWVLTSRLRRSYGGSICDFSIGGDRLFALHSEENVVDIWETPTPPII

SEQ ID NO: 2337 - protein, 233 aa, Hordeum vulgare
MGRNSGFIAMYATLASRDVDCCLIPESPFYLEGKGGLLEFVEKRLKDSGHMVIVVAEGAGQDLIAQSMNFVDTQDASGNKLLLDVGLWLSQKIKDHFKKKTNFPITLKYIDPTYMIRAVRSNASDNVYCTLLAHSALHGAMAGYSGFTVAPVNGRHAYIPFYRITEKQNKVVITDRMWARVLCSTNQPCFLSHEDVENMKHDDDERHHLHNTQLLDGAPAKCSPNCNGSAGAE

SEQ ID NO: 2338 - protein, 542 aa, Brachypodium distachyon
MESVVVAPAAAAQGAVAVAEQQQQKKKLLDQKMELPLVAALKAPAPASPCKWAMKKKLVGGDAGYVLEDVPHLTDYMPELPTYPNPLQDNPAYSVVKQYFVNTDDTVTQKIVVHKTSARGTHFRRAGPRQRVYFQSDEVNAAIVTCGGLCPGLNTVIRELVCGLCDMYGVTSVVGIEGGYKGFYSRNTVPLTPKSVNDIHKRGGTILGTSRGGHDTAKIVDSLQDRGINQVYIIGGDGTQQGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDSGHMVIVVAEGAGQDLIAQSMNFVDTQDASGNKLLLDVGLWLSQKIKDHFKKKTNFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEQHHLHNTQLLDGSPAKCSPKCNGFAAPL

SEQ ID NO: 2339 - protein, 528 aa, Zea mays
MESFGVPPAPVAAPEKRKKPLDLKDPVPAAAAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIAKSMNSVDTQDASGNKLLLDVGLWLSQKIKDHFKKKPRFPITLKYIDPTYMIRAVSSNASDNVYCTLLAHSALHGAMAGYTGFIVAPVNGRHAYIPFYRITEKQNKVVITDRMWARVLCSTNQPCFLSHEDVENMKHDDDEHHLHNTLLLDSPENSSK

SEQ ID NO: 2340 - protein, 538 aa, Zea mays
METVTVVVAPAPVAVTQQPPQHKLAELKPSSFAGVPKSSPATKAKPAKTKKLAGGCGGYVLEDVPHLTDYLPELKSYPNPLQDHPAYSVVKQYFVNPDDTVAKKIVVHKSGARGTHFRRAGPRQRVYFQPDEVTAAIVTCGGLCPGLNTVIRELVCGLHDMYGVATVYGIEGGYKGFYARNTVELTPRSVNDIHKRGGTVLGTSRGGQDTAKIVDSIQDRGVNQVYIIGGDGTQKGAASIHEEVQRRGLKCAVVGVPKTIDNDIAVIDKSFGFDTAVEEAQRAINAAHVEAESAENGVGVVKLMGRNSGFIAMYATLASRDVDCCLIPESPFYLDGRGGLLEFVEKRLRDNGHMVIVVAEGAGQDLIAKSMNFADTHDASGNKVLLDVGLWLSHKIKEHFKKKPSFPITLKYIDPTYMIRAVPSNASDNVYCTLLAHSALHGAMAGYTGFTVAPVNGRHAYIPFYRITEKQNKVVITDRMWARVLCSTNQPCFLTHQDVEGAGLDEEEPQMPLVEGENALVRNPSMCNGNGHLCSGAA

SEQ ID NO: 2341 - protein, 525 aa, Zea mays
MESFGVPPAPVAAPEKRKKPLDLKDPVPAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRQRVYFQPDEVNAAIVTCGGLCPGLNTVIRELVCGLYDMYGVTSVVGIEGGYKGFYSKNTVALTPRSVNGIHKRGGTVLGTSRGGHDTAKIVDCLQDRGINQVYIIGGDGTQKGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFAERRLKDNGHMVIVVAEGAGQDLIAKSMNSVDTQDASGNKLLLDVGLWLSQKIKDHFKKKPRFPITLKYIDPTYMIRAVSSNASDNVYCTLLAHSALHGAMAGYTGFTVAPVNGRHAYIPFYRITEKQNKVVITDRMWARVLCSTNQPCFLSHEDVENMKHDDDEHHLHNTLLLDSPENSSK

SEQ ID NO: 2342 - protein, 531 aa, Zea mays
MEAVGVTPAPVAAPEKKKLLDLKDPFPAAANGGAKASPASKWAMKKKLVGGDAGYVLEDVPHLTDYMPQLPTYPNPLQDNPAYSVVKQYFVNPDDTVTQKIVVHKTSARGTHFRRAGPRQRVYFQSDEVNAAIVTCGGLCPGLNTVIRELVCGLYDMYGVSSVVGIEGGYKGFYSKNTVALTPKSVNDIHKRGGTVLGTSRGGHDTAKIVDCLQDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIARSMNFVDTQDASGNKLLLDVGLWLSQKIKDHFKKKPSFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEHHHMHNTQLLEGGSSPVSKCNGSAAAV

SEQ ID NO: 2343 - protein, 530 aa, Sorghum bicolor
MEAVGVAPAPVAAPEKKKLLDLKDPFPAAANGSAKASPAGKWAMKKKLVGGDAGYVLEDVPHLTDYMPHLPTYPNPLQDNPAYSVVKQYFVNPDDTVTQKIVVHKTSARGTHFRRAGPRQRVYFQSDEVNAAIVTCGGLCPGLNTVIRELVCGLYDMYGVTSVVGIEGGYKGFYSKNTVPLTPKSVNDIHKRGGTVLGTSRGGHDTAKIVDCLQDRGINQVYIIGGDGTQKGASVIYEEVRRRGLKCSVVGIPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKPSFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEHHLHNTQLLEGESSPVKDASKCNGTV

SEQ ID NO: 2344 - protein, 536 aa, Sorghum bicolor
METATVVVAPAPVSITQPPQHKLMELKPAFAAVAKPSPARKAKPAKKKLAGGCGGYVLEDVPHLTDYLPELKSYPNPLQDHPAYSVVKQYFVNPDDTVAKKIVVHKSSARGTHFRRAGPRQRVYFQPDEVTAAIVTCGGLCPGLNTVIRELVCGLHDMYGVSSIYGIEGGYKGFYARNTVELTPRSVNDIHKRGGTVLGTSRGGQDTAKIVDSIQDRGVNQVYIIGGDGTQKGAASIHEEVQRRGLKCAVVGVPKTIDNDIAVIDKSFGFDTAVEEAQRAINAAHVEAESAENGIGVVKLMGRNSGFIAMYATLASRDVDCCLIPESPFFLDGKGGLLEFVEKRLRDNGHMVIVVAEGAGQDLIAKSMNFADTHDASGNKVLLDVGLWLSHKIKEHFKKKPSFPITLKYIDPTYMIRAVPSNASDNVYCTLLAHSALHGAMAGYTGFTVAPVNGRHAYIPFYRITEKQNKVVITDRMWARVLCSTNQPCFLTHEDVEGAAGLDEEEPHMPLVEGEYALVRSPSMCNGNGHLCSGAA

SEQ ID NO: 2345 - protein, 90 aa, Saccharum officinarum
MEAVGVAPAPVAAPEKKKLLDLKDPFPAAANGSAKASPAGKWAMKKKLVGGDAGYVLEDVPHLTDYMPQLPVRARVPHLLGVSRWGQPVS

SEQ ID NO: 2346 - protein, 534 aa, Panicum virgatum
MEAVGVAPAPVAAPVKKKLLDLEKPFPAAAAANGAKASPAGKWAMKKKLVGGDADYVLEDVPHLTDYLPELPTFPNPLQDNSAYSVVKQYFVNLDDTVTQKIVVHKTSARGTHFRRAGPRQRVYFQSDEVNAAIVTCGGLCPGLNTVVRELVCGLYDMYGVTSVVGIEGGYKGFYSKNTIPLTPKSVNDIHKRGGTVLGTSRGGHDTAKIVDCLQDRGINQVYIIGGDGTQKGASVIYEEVRRRGLKCSVVGIPKTIDNDIAVIDKSFGFDTAVEEAQRAINAAHVEAESAENGIGVVKLMGRNSGFIAMYATLASRDVDCCLIPESPFYLEGKGGLLEFIERRLKDNGHMVIVVAEGAGQDLIAKSMNFVDTQDASGNKLLLDVGLWLSQKIKDHFKKKPHFPITLKYIDPTYMIRAVKSNASDNVYCTLLAHSALHGAMAGYTGFTVAPVNGRHAYIPFYRITEKQNKVVITDRMWARVLCSTNQPCFLSHEDVENMKHDDDEHHLHNTQLLEGESSPMKNSAKCNGSAAGV

SEQ ID NO: 2347 - protein, 534 aa, Triticum aestivum
MESVGVAPAPAAVAVAEQKMKLLEPRKEPLASAAAAAAKAPCKWAMKKKLVGGDAGYVLEDVPHLTDYMPELPTYPNPLQDNPAYSVVKQYFVNTDDTVTQKIVVRKNSARGTHFRRAGPRQRVYFQPDDVNAAIVTCGGLCPGLNTVIRELVCGLYDMYGVTSVVGIEGGYKGFYSRNTVTLTPKSVNDIHKRGGTILGTSRGGHDTAKIVDSLQDRGINQVYIIGGDGTQQGASVIYEEVRRRGLKCAVVGVPKTIDNDIAVIDKSFGFDTAVEEAQRAINAAHVEAESAENGIGVVKLMGRNSGFIAMYATLASRDVDCCLIPESPFYLEGKGGLLEFVEKRLKDSGHMVIVVAEGAGQDLIAQSMNFVDTQDASGNKLLLDVGLWLSQKIKDHFKKKTNFPITLKYIDPTYMIRAVRSNASDNVYCTLLAHSALHGAMAGYSGFTVAPVNGRHAYIPFYRITEKQNKVVITDRMWARVLCSTNQPCFLSHEDVENMKHDDDERHHLHNTQLLDGSRAKCSPNCNGSAGAE

SEQ ID NO: 2348 - protein, 545 aa, Oryza sativa
MRIPTTETETGTGTRIPSHRRRKGSSDGSRARADASRRGPTPTKETEIPGRPLKRSSSTLSLDDAAGASNPTSTWAILNRYGARRDSFRRDDRDRTTSAVSYTSGGDQISVSFELVKPPETSLLTLDWPQGPRPSLGTTSYPYVIAAHGNVVLFQIVSPDKHARPSAIDYFVYNASRSSSSNHHPSLTRLPVSYWRRGDTIRPRIMSREGTCILSCGSKNSSSFVVAELERRSCQSSETNVYLFASGSDDWRVFRNVPIRHGDALAHLCCWTTDAVLSCHDRYMIWVDYLVAGMIVANVEHPGRVDPPEPVLWYVPLPVDPVADIDRGRGCPQASRSLCATHHGIKFVNVNQHGGSSSRSFSITLWSWHEDQTWREDATLDAAQLWELDSENRLPNVRPEFPVVDMENPYAVCFLLNERYHTADPNATTWMIKVHMKKKVLLDCTGYSNKGSSSTARRMSEGLSFISSEMPSYLSGKTIKRFLEGPLWPATHDAIEIEENGKMGFPKKQKKYTGKLAIDADYTDAEDERHLENAMTSNSSAGGLR

SEQ ID NO: 2349 - protein, 350 aa, Brachypodium distachyon
MEVTPNHTQTVSGWAATDESGKVAPFIFKRRENGVDDVTIKVEYCGMCHTDLHFVNNDWGITMYPVVPGHEITGVVTKVGTNVSTFKAGDRVGVGCISGSCLDCEHCARSEENYCDKVTLTYNGVFWDGSVTYGGYSGMFVANKRFLVRIPDSLPLDAAAPLLCAGITVYSPMKQHGMLDQRGAGRRLGVVGLGGLGHVAVKFGKAFGLRVTVISTSPAKEREARENLMADDFVLSTDQKQMQAMARSLDYVIDTVSASHSLGPILELLKVNGKLVLVAAPDKPVELPSFPLIFGKRTVSGSMTGGMKETQEMMDLCGEHGITCDIELVFTDRINDALARLARNDVRYRF

SEQ ID NO: 2350 - protein, 361 aa, Zea mays
MEVTPNHTLTVTGWAAMNESAGKVEPFVFKRRENGPDDVTIKVQYCGMCHTDLHFINNDWGITTYPLVPGHEITGVVTKAGRNVTGFRVGDRVGVGCIAASCLDCDHCRRSEENYCDRVALTYNGVFWDGSVTYGGYSRALVADKRFVVRVPDALPLDAAAPLLCAGVTVYSPMKHHGMLGHPGASLGVVGLGGLGHVAVKLAKAFGLRVTVVSTSPAKEAEARARLGADRFVVSTDDAQMRDAARSLDYVIDTVSAKHSLGPILDLLKVSGKLVLVAAPDQPVELPSFPLIFGKRTVSGSMTGGIRETQEMLDLCARHNITCDIELVSTDGINAALARLARNDVRYRFVIDIAGDSTSKL

SEQ ID NO: 2351 - protein, 338 aa, Sorghum bicolor
MEVTPNHTQTVAGWAAMNESGKLEPFIFKRRENGVDDVTIKVEYCGMCHTDLHFIQNDWGITMYPLVPGHEITGVVTKVGSNVTGFGVGDRVGVGCIAASCLDCDHCRRSEENYCDKVTLTYNGVFPDGSVTYGGYSKMLVAHKRFVVRVPDTLPLDAAAPLLCAGITVYSPMKHHGMLRSAGASLGVVGLGGLGHVAVKFAKAFGLRVTVVSTSPAKEKEARERLGADDFVVSSDQKQMQAMARSLDYVIDTVSAKHSLGPILELLKVNGKLVLVAAPDQPVELPSFPLIFGKRTVSGSMTGGMKETQEMLDLCGQHGITCDIELVSTDGINDALQR

SEQ ID NO: 2352 - protein, 354 aa, Saccharum officinarum
  misc_feature (331)..(331): Xaa can be any naturally occurring amino acid
HTQTVAGWAVMNESGKVEPFVFKRRENGVDDVTIKVQYCGMCHTDLHFIQNDWGITMYPLVPGHEITGVVTRVGSNVSGFRVGDRVGVGCIAASCLDCDHCRRSEENYCDKVTLTYNGVFWDGSVTYGGYSRMLVAHKRFVVRVPDTLPLDAAAPLLCAGITVYSPMKHHGMLRSPGGSLGVVGLGGLGHVAVKFAKAFGLRVTVISTSPAKEREARERLGADHFVVSTDQKQMQAMARSLDYVIDTVSAKHSLGPILELLKVNGKLVLVAAPDQPVELPSFPLIFGKRTVSGSMTGGMKETQEMLDLCGQHNITCDIELVSTDGINEALXRLARNDVRYRFVIDIAGDSNSKL

SEQ ID NO: 2353 - protein, 357 aa, Panicum virgatum
MEVTPNHTQTVTGWAAMDESGKVEPFIFKRRENGVDDVTIKVQYCGMCHTDLHFIQNDWGITMYPVVPGHEITGVVTKVGSNVSGFKVGDRVGVGCISASCLDCEHCHRSEENYCDKVTLTYNGIFWDGTVTYGGYSNMLVANKRFVVRIPDNLPLDAAAPLLCAGITVYSPMKQHGMLQSGGNLGVIGLGGLGHVAVKFGKAFGLRVTVISTSPAKEREARERLKADDFIVSTNQKQMQAMTRSLDYIIDTVSAKHSLGPILELLKVNGKLVLVAAPDQPVELPSFPLIFGKRTVSGSMTGGLKETQEMLDLCGEHNITCDIELVSTDRINEALARLARNDVRYRFVINIGGNSKL

SEQ ID NO: 2354 - protein, 121 aa, Hordeum vulgare
MTASVSYGLRALPTWSSSVSGDDHCSALAMSVSARPRSARPLRTPARMGNVNEGKGIFAPLVVVVRNIVGRKRFNQLRGKAIALHSQVITEFCKTIGADPKQRQGLIRLAKKNGEKLGFLA

SEQ ID NO: 2355 - protein, 122 aa, Brachypodium distachyon
MAASVSSGLRALPTWSSSVSGDDRCSPLVMSVSVRQPRSARPLRTPARMGNVNEGKGIFAPLVVVVRNIVGRKRFNQLRGKAIALHSQVITEFCKTIGADPKQRQGLIRLAKKNGEKLGFLA

SEQ ID NO: 2356 - protein, 119 aa, Festuca arundinacea
  misc_feature (31)..(31): Xaa can be any naturally occurring amino acid
MAASVSSGLRALPTWSSSVSGDDHLAMSSVXMRPRSARPLRTPARMGNVNEGKGIFAPLVVVTRNIVGRKRFNQLRGKAIALHSQVITEFCKTIGADPKQRQGLIRLAKKNGEKLGFLA

SEQ ID NO: 2357 - protein, 123 aa, Leymus cinereus x Leymus triticoides
MTAASVSYGLRALPTWSSSVSGDDHCSALAMSVSARGPRSARPLRAPARMGNVNEGKGIFAPLVVVVRNIVGRKRFNQLRGKAIALHSQVITEFCKTIGADPKQRQGLIRLAKKNGEKLGFLA

SEQ ID NO: 2358 - protein, 122 aa, Pseudoroegneria spicata
MTASVSYGLRALPTWSSSVSGDDHCSALAMSVSARGPRSARPLRTPARMGNVNEGKGIFAPLVVVVRNIVGRKRFNQLRGKAIALHSQVITEFCKTIGADPKQRQGLIRLAKKNGEKLGFLA

SEQ ID NO: 2359 - protein, 125 aa, Oryza sativa
MAAAAASSVSLPGARALPTWSSSVSGDSHSLALSSWAARPRSARPLRAPARMGNVNEGKGIFAPVVVVVRNIVGRKRFNQLRGKAIALHSQVITEFCKTIGADAKQRQGLIRLAKKNGEKLGFLA

SEQ ID NO: 2360 - protein, 128 aa, Sorghum bicolor
MAAAVSFSRVRALPTWSSSVSGDDHHAYSSVLAMSVSARPRSTGARPLRSPARMMGNVNEGKGLFAPLVVVTRNIVGRKRFNQLRGKAIALHSQVINEFCKAIGADNKQRQGLIRLAKKNGEKLGFLA

SEQ ID NO: 2361 - protein, 122 aa, Triticum aestivum
MTASVSYGLRALPTWSSSVSGDDHCSALAMSVSARGPRWTRPLRTPARMGNVNEGKGIFAPLVVVVRNIVGRKRFNQLRGKAIALHSQVITEFCKTIGADPKQRQGLIRLAKKNGEKLGFLA

SEQ ID NO: 2362 - protein, 335 aa, Arabidopsis thaliana
MADVATKHPMEDEVKKTEASSLVGKLETDVEIKASADKFHHMFAGKPHHVSKASPGNIQGCDLHEGDWGTVGSIVFWNYVHDGEAKVAKERIEAVEPDKNLITFRVIEGDLMKEYKSFLLTIQVTPKPGGPGSIVHWHLEYEKISEEVAHPETLLQFCVEVSKEIDEHLLAEEEEVKTPETPSLVGKLETDVEIKASAEKFHHMFAGKPHHVSKASPGNIQGCDLHEGDWGQVGSIVFWNYVHDREAKVAKERIEAVEPNKNLITFRVIDGDLMKEYKSFLLTIQVTPKLGGPGSIVHWHLEYEKISEEVAHPETLLQFCVEVSKEIDEHLLAEE

SEQ ID NO: 2363 - protein, 288 aa, Arabidopsis thaliana
MSPKQVQATFRDVICTKATGAQSALSSSGITYMANGEAKVAKERIEAVEPDKNLITFRVIEGDLMKEYKSFLLTIQVTPKPGGPGSIVHWHLEYEKISEEVAHPETLLQFCVEVSKEIDEHLLAEEEEVKTPETPSLVGKLETDVEIKASAEKFHHMFAGKPHHVSKASPGNIQGCDLHEGDWGQVGSIVFWNYVHDREAKVAKERIEAVEPNKNLITFRVIDGDLMKEYKSFLLTIQVTPKLGGPGSIVHWHLEYEKISEEVAHPETLLQFCVEVSKEIDEHLLAEE

SEQ ID NO: 2364 - protein, 275 aa, Hordeum vulgare
MGGPGLYSGIGKKAKDLLYRDYQTDHKFTLTTYTANGAAITATSTKKADLILGEIQSQIKNKNITVDVKANSASNVITTITADDLAAPGLKTILSFAVPDQKSGKVELQYLHDYAGINASIGLTANPVVNLSAAFGTSALAVGGDVSLDTSTKNFTKYNAAFSYTNQDLIASLNLNNKGDSLTASYYHFVEKSSTAVGAELTHSFSSNENSLTFGTQHTLDPLTLVKARINNSGKASALIQHEFRPKSLCTISAEVDTKAIEKSSKVGIAIALKP

SEQ ID NO: 2365 - protein, 276 aa, Brachypodium distachyon
MVGPGLYTEIGKKTRDLLYRDYQTDHKFTLTTYTANGVAITATSSKKADLIFGEIQSQIKNKGVTVDVKANSASNVITTVTVDELAAPGLKTIFSFAIPDQRSGKLELQYLHDYAGINASIGLTANPVVNLSGSFGTNALAVGADVSLDTATKNFTKYNAGLSFTNDDLTASLNLNNKGDSLTASYYHFVEKSTKTAVGAELTHSFSSNENTLIFGTQHTLDPLTLVKARINNSGKASALIQHEFRPRSLCTISAEVDTKAIEKSSKVGIAVALKP

SEQ ID NO: 2366 - protein, 276 aa, Cenchrus ciliaris
  misc_feature (223)..(223): Xaa can be any naturally occurring amino acid
MVGPGLYTEIGKKTRDLLYRDYQTDHKFTLTTYTSNGVAVTATSTKKADLIIGEIQSQIKNKNITVDVKANSDSNVITTFTMDEVATPGLKAILSFAVPDQRSGKFELQYLHDYAGVNTSIGLTANPIVNLSGSFGTKALAVGADISLDTATGNFTKYNAGLSFTHEDLIASLNLNNKGDSLTAAYYHSVSQLTSTAVGAELTHSFSTNENTLTFGTQHALDXLTVLKARFNNSGKASALIQHEWRPKSLVTISAEVDTKTIEKSSKVGIAVALKP

SEQ ID NO: 2367 - protein, 275 aa, Festuca arundinacea
MGGPGLYTGIGKKAKDLLYKDYQTDQKFTLTTYAANGAAITATSTKKGDLILGEIQSQIKNKGITVDVKANSASNVITTITADEYAAPGLKTIFSFAVPDQKSGKVELQYLHDYAGINASIGLTANPVVNLSAAFGNSALAVGADVSLDTATKNLTKYNAGLSYTNKDLIASLNLNNKGDSLTASYYHIVEKSNAAVGAELTHSFSSNENSLTIGTQHILDPLTLVKARFNNSGKVSTLIQHEFRPKSLITISAEVDTKAIEKSSKVGIALALKP

SEQ ID NO: 2368 - protein, 275 aa, Leymus cinereus x Leymus triticoides
  misc_feature (163)..(163): Xaa can be any naturally occurring amino acid
MGGPGLYTGIGKKAKDLLYRDYQTDHKFTLTTYTANGVAITATSTKKADLILGEIQSQIKNKNITVDVKANSASNVITTITADDLAAPGLKTILSFAVPDQKSGKVELQYLHDYAGINASIGLTANPVVNLSAAFGTSALAVGGDVSLDTATKNFTKYNAGLXYTNQDLIASLNLNNKGDSLTASYYHIVEKSGTAVGAELTHSFSSNENSLTFGTQHTLDPLTLVKARMNNSGKASALIQHEFRPKSLCTISAEVDTKAIEKSSKVGIAIALKP

SEQ ID NO: 2369 - protein, 276 aa, Zea mays
MVGPGLYTEIGKKTRDLLYKDYQTDHKFTLTTYSSNGVAVTATSTKKADLIFSEIHSQIKNKNMTVDVKANSESNIITTVTVNEIATPGLKTILSFAVPDQRSGKVELQYLHDYAGVNASVSLTANPVANLSAAFGTKALAVGAEISFDSATGNFTKYNAGLMFTHEDLIASLNMNNKGDNLTGAYYHKVSELTNTAVGAELTHSFSTNENTLTFGGQHTLDPLTVLKARINNSGKASALIQHEWRPKSLVTISAEVDTKTIEKSSKVGIAVALKP

SEQ ID NO: 2370 - protein, 276 aa, Zea mays
MVGPGLYTEIGKKTRDLLYKDYQTDHKFTLTTYTSNGVAVTASSTKKADLILGEIQSQIKNKNMTIDVKANSESNIITTITVDEIATPGLKTILSFAVPDQRSGKVELQYLHDYAGVNASIGLTANPVVNLSAAFGTKAVAVGADISLDTATGNLTKYNAALRFTHEDLVASLNLNNKGDSLTGAYYHKVSELTNTAVGAELTHSFSTNENTLTFGGQHALDPLTVLKARINNSGKASALIQHEWRPKSLVTISAEVDTKTIEKSSKVGIAVALKP

SEQ ID NO: 2371 - protein, 275 aa, Pseudoroegneria spicata
  misc_feature (39)..(39): Xaa can be any naturally occurring amino acid
MGGPGLYSGIGKKAKDLLYRDYQTDHKFTLTTYTANGAXITATSTKKADLILGEIQSQIKNKNITVDVKANSASNVITTITADDLAAPGLKTILSFAVPDQKSGKVELQYLHDYAGINASIGLTANPVVNLSAAFGTSALAVGGDVSLDTATKNFAKYNAALSYTNQDLIASLNLNNKGDSLTASYYHIVEKSGTAVGAELTHSFSSNENSLTFGTQHTLDPLTLVKARINNSGKASALIQHEFRPKSLCTISAEVDTKAIEKSSKVGIAIALKP

SEQ ID NO: 2372 - protein, 274 aa, Oryza sativa
MVGPGLYPEIGKKARDLLYRDYQTDHKFTLTTYTSNGVAITATSTKKADLIFGEIQSQIKNKNITVDVKANSDSNVVTTVTVDELTPGLKSILSFAVPDQRSGKFELQYSHDYAGVSASIGLTASPVVNLSSVFGTKALAVGADVSLDTATGNLTKYNAGLSFSNDDLIASLNLNNKGDSLTASYYHIVNHSATAVGAELTHSFSSNENSLTFGTQHTLDPLTVVKARFNNSGKASALLQHEWRPKSVWTISAEVDTKAIDKSSKVGIAVALKP

SEQ ID NO: 2373 - protein, 276 aa, Saccharum officinarum
MVGPGLYTEIGKKTKDLLYKDYQTDHKFTLTTYTSHGVAVTASSTKKADLIFGEIQSQIKNKNITVDVKANSESNIITTVTVDEIATPGLKTILSFAVPDQRSGKVELQYLHDYAGVNASIGLTANPVVNLSAAFGAKALAVGADVSLDTATGNLTKYNAGLRFTHEDLIASLTLNNRGDSLTGAYYHKVSELSNTAVGAELTHSFSTNENTLTFGGQHALDPLTVLKARINNSGKASALIQHEWRPKSLVTISAEVDTKTIEKSSKVGIAVALKP

SEQ ID NO: 2374 - protein, 276 aa, Panicum virgatum
MVGPGLYTEIGKKTRDLLYRDYQTDHKFTLTTYTSNGVAVTATSTKKADLIFGEIQSQIKNKNVTIDVKANSGSNVITTVTVDEIATPGLKTILSFAVPDQRSGKFELQYLHDHAGVNASIGLTANPVVNLSGSFGTKAVAVGADISLDTASGSLTKYNAGLSITHEDLIASLNLNNKGDSLTAAYYHNVNLLTSTAVGAELTHSFSTNENTLTFGTQHALDPLTVVKARFNNSGKASALIQHEWRPKSLVTISAEVDTKTIEKSSKVGIAVALKP

SEQ ID NO: 2375 - protein, 276 aa, Panicum virgatum
MVGPGLYTEIGKKTRDLLYKDYQTDHKFTLTTYTSNGVAVTATSTKKADLIFGEIQSQIKNKNVTVDVKANSGSNVITTVTVDEIATPGLKTILSFAVPDQRSGKFELQYLHDHAGVNTSIGLTANPVVNLSGSFGTKALAVGADFSLDTASGNLIKYNAGLSITHEDLIASLNLNNKGDSLTAAYYHNVNQLTSTAVGAELTHCFSTNENTLTFGTQHALDPLTVVKARFNNSGKASALIQHEWRPKSLVTISAEVDTKTIEKSSKVGIAVALKP

SEQ ID NO: 2376 - protein, 275 aa, Triticum aestivum
MGGPGLYSGIGKKAKDLLYRDYQTDHKFTLTTYTANGAAITATSTKKADLILGEIQSQIKNKNITVDVKANSASNVITTITADDLAAPGLKTILSFAVPDQKSGKVELQYLHDYAGINASIGLTANPVVNLSGAFGTSALAVGADVSLDTATKNFTKYNAALSYTNQDLIASLNLNNKGDSLTASYYHIVEKSGTAVGAELTHSFSSNENSLTFGTQHTLDPLTLVKARINNSGKASALIQHEFMPKSLCTISAEVDTKAIEKSSKVGIAIALKP

SEQ ID NO: 2377 - protein, 275 aa, Triticum aestivum
MGGPGLYSGIGKKAKDLLYRDYQTDHKFTLTTYTANGAAITATSTKKADLILGEIQSQIKNKNITVDVKANSASNVITTITADDLAAPGLKTILSFAVPDQKSGKVELQYLHDYAGINASIGLTANPVVNLSGAFGTSALAVGADVSLDTATKNFTKYNAALSYTNQDLIASLNLNNKGDSLTASYYHIVEKSGTAVGAELTHSFSSNENSLTFGTQHTLDPLTLVKARINNSGKASALIQHEFRPKSLCTISAEVDTKAIEKSSKVGIAIALKP

SEQ ID NO: 2378 - protein, 275 aa, Triticum aestivum
MGGPGLYSGIGKKAKDLLYRDYQTDHKFTLTTYTANGAAITATSTKKADLILGEIQSQIKNKNITVDVKANSASNVITTITADDLAAPGLKTILSFAVPDQKSGKVELQYLHDYAGINASIGLTANPVVNLSGAFGTSALALGADVSLDTATKNFTKYNAALSYTNQDLIASLNLNNKGDSLTASYYHIVEKSGTAVGAELTHSFSSNENSLTFGTQHTLDPLTLVKARINNSGKASALIQHEFMPKSLCTISAEVDTKAIEKSSKVGIAIALKP

SEQ ID NO: 2379 - protein, 351 aa, Zea mays
MAPPARPPRVGEDLEEGTGESSPPPRSPRASNPDCHEVQRKICERLRQTGRHDRTLADPTFNARFARHLERLPRRYLLDLDLDDKLEDVLLHWGILDECADPNKRPVFRARFIKYKTVPREDDGIGHDQDHEEPCQKLLEDLSLERRKIADRNDSLSISSRGDLKTVLLHEIIFSSIDKPKLLSRLTALLSEVGLNIQEAHVYSTKDGFCLDVFVVDGWKTEETDELIAAIKETLTQKNASPSNSTNSSTPEKIVDLQQQVGDYEIDLSMLTRGDKIASGSSADLYRGTYKGHDVAIKCLRSLYLNNPSEVEFLQEVLILRQDFAIHNLVLIMKIFCNFMGHAQNIQTIAL

SEQ ID NO: 2380 - protein, 345 aa, Aquilegia formosa
MATAEAHQSWTLAYKGMSSDNIKGLVLALSSSFFIGGSFIVKKKGLKKAGASGIRAGSGGYSYLYEPLWWAGMITMIVGEIANFAAYAFAPAILVTPLGALSIIISAVLAHIILRERLHIFGILGCVLCVVGSTTIVLHAPQERMIESVAEVWDLATEPAFLLYAALVITAVFILIIRFIPHYGQTHIMVYIGVCSLVGSLSVMSVKALGIALKLTFSGTNQLIYPQTWAFALVVLTCVLTQMNYLNKALDTFNTAVVSPIYYVMFTTLTILASVIMFKDWDRQNPTQIVTEMCGFVTILSGTFLLHKTKDMSDGMSSRLPKHIDEEDGFASEGIPLRCQESLRS

SEQ ID NO: 2381 - protein, 368 aa, Arabidopsis thaliana
MASLSGSWRDAYKGMSSDNIKGLVLALSSSLFIGASFIVKKKGLKRAGASGLRAGSGGYSYLLEPLWWVGMITMIVGEIANFAAYAFAPAILVTPLGALSIIISAALAHVILHEKLHTFGLLGCVLCVVGSITIVLHAPQEQEIDSVLQVWNLATEPAFLLYAAAVVGAAIILIVQFVPQYGQSHVMVYIGVCSLVGSLSVMSVKALGIALKLTFSGMNQLIYPQTWVFTLIVLTCVITQMNYLNKALDTFNTAVVSPIYYVMFTSLTILASVIMFKDWDRQDGTQIVTELCGFVTILSGTFLLHKTKDMVDGSSSLGNLALRLPKQLEDSNGFEQEGIPLTLRRHECTKSPRPMRQFILPQDGPEAV

SEQ ID NO: 2382 - protein, 345 aa, Ricinus communis
MATQSWRDSYKGMSSDNIKGLVLALSSSFFIGASFIVKKKGLKKAGASGLRAGSGGYSYLYEPLWWVGMITMIVGEIANFAAYAFAPAILVTPLGALSIIISAVLAHIILNEKLHIFGILGCVLCVVGSTTIVLHAPQEREIESVKEVWDLATEPAFLFYAALVITAVFILIFHYIPDYGQTHIMVYIGVCSLVGSLSVMSVKALGIALKLTLSGMNQLIYPQTWAFALVVITCVVTQMNYLNKALDTFNTAVVSPIYYVMFTSLTIVASVIMFKDWDRQSPTQIVTEMCGFVTILSGTFLLHKTKDMVDGPTSLPVRLPKHTEEDSFGAEGIPLRRQESLRSQS

SEQ ID NO: 2383 - protein, 333 aa, Ricinus communis
MSSDNIKGLVLALSSSFFIGASFIVKKKGLKKAASSGLRAGAGGYSYLYEPLWWIGMITMIVGEIANFAAYAFAPAILVTPLGALSIIISSVLAHVILRERLHMFGILGCALCVVGSTAIVLHAPQEREIESVKEVWELATEPAFLLYAAFVIGAVFIIIIRVIPQYGQSHVLVYIAVCSLVGSLSVMSVKALSIALKLTFSGMNQLVYPQTWVFTLVVITCVITQMNYLNKALDTFNTAVVSPIYYVMFTSLTILASVIMFKDWDRQNPTQIVTEMCGFVTILSGTFLLHKTKDMVEGSSPSLPLSIPKHSEEDGFQPEGIPLRRQASLRQA

SEQ ID NO: 2384 - protein, 347 aa, Vitis vinifera
MAAAGEEGAYSYKGMSADNIKGLVLALSSSFFIGASFIVKKKGLKKAGASGIRAGVGGYSYLYEPLWWVGMITMIVGEIANFAAYAFAPAILVTPLGALSIIISAVLAHIILREKLHIFGILGCVLCVVGSTTIVLHAPQEREIQSVIEVWDLATEPAFLFYAALVITAVFVLIIHFIPQYGQTHIMVYIGVCSLVGSLSVMSVKALGIALKLTLSGMNQLTYPQTWAFTIVVITCVITQMNYLNKALDTFNTAVVSPIYYVMFTSLTILASVIMFKDWDRQNPTQIVTEMCGFVTILSGTFLLHKTKDLSDGLSTSLSMRLSKHIEEDGFGQEGIPLRRQESLRLP

SEQ ID NO: 2385 - protein, 110 aa, Raphanus sativus
MAGSGGGGGGGWRDSYKGMSSDNIKGLVLAISSSLFIGASFIVKKKGLKKAGATGTRAGVGGYSYLYEPLWWIGVTTMLLGEIANFAAMLLLRLYLSHLLAHSVSLSVLS

SEQ ID NO: 2386 - protein, 372 aa, Zea mays
MDEHMGRRTVGGLLFTKGGSILLFREDGSRPKAKNCCTRHGCSGQHPADRAKGKEVHRAAAVGSESTPATPRRSQAFRKPNRRPPHEGSASGSIVRDVGGPCSETGSGSRDAPGRDLLARLKERVNTSRKRSLNRENSPQSPSGLSVCASSPSNSRSVSRPSHRTASRIREADEGANAGADSVVRRNAARRGSERSDDDLLLVEQVTRNQAPSEGFLSGFMARYRSDLQGELSSLDDSMEDPNGYLRFDVGGIEELENYFIFNDRHRGMRMDIDGMSYEELLALGERIGTVNTGLSDDALSACLNRRLYMPTASGSHEDCERKCSVCQEEYLAGEEVGEMACKHYYHLSCIDHWLRQKNWCPICKSVALKIN

SEQ ID NO: 2387 - protein, 380 aa, Zea mays
MEEHMGRRTVGGLLLTKGGSILLFREDGSRPRAKNCCSRHGCSGHHSVGKAKGKEVHRAAVANESTPATPRRPKICRNPDRMPPHGTSAPGSISKDAGGSCSETGNRSRDTPGPGRDLLARLKERVNTSRKRSLNRENSPQSPSGFTASSPSNSRSVSLSRPSHRAASRVRRADEGANAGADSVHRNGAGGARRSSQRGDAGLLLVEQQVARNHVPSEGFLSGFMARYRSGLQEGLSSLDDSVEDSNGYLRFDTGGIEELQNYLIFSDRHRGMRMDIDGMSYEELLALGERIGTVKTGLSDDALSTCLNRSLYMPTAPGSHEDCETKCSICQASSFEEYLSGEDVGKMACKHYYHLSCIEHWLRQKNRCPICKSVALKTK

SEQ ID NO: 2388 - protein, 373 aa, Panicum virgatum
MDEHMGRRTVGGLLFTKGGSILLFREDGSRPKAKNCCSRHGCSGRHSVDKAKGKEVHRTAAPNESAPATPGRSQILRKPSRKPPQQQESSASDSISRDAGGSCSETGNRSRDTPGRDLLARLKDRVNASRKRSLNRESSPPSPNGLNASSPSSSRSISRPSHRAASRIRKADDSANAGTDSGHRNGSGDARRNSERSDDDLLLVEQVARDHVPSEGFLSGFMARYRSGLQGGVSSLEDSVEDSNGYWRFDTGVTEELENYFIFNDRHRGMRMDIDGMSYEELLALGERIGTVNTGLSDDVLAKCLNRSIYMLTASGSHEDCDRKCSVCQEEYLAGEELGKMACKHYYHMSCIQRWLRQKNWCPICKSVALNTN

SEQ ID NO: 2389 - protein, 101 aa, Saccharum officinarum
MNSDSIYDMTSMISQLPAKKGLSRYYEGKSQSFACMSEVRCLEDLRKKDNPYKQKIKSCKSYVALGGMMAKKQPASSSCANLDLVAANGFRTPPIRNGYHQ

SEQ ID NO: 2390 - protein, 169 aa, Saccharum officinarum
  misc_feature (155)..(155): Xaa can be any naturally occurring amino acid
MSYRLGDAAGREEGDEELFETASSVSGGESDDGDDEGDHFPGGGGGDGGEGECDHQDRRAFVPEPLRRMNSDSIYDMTSMMSQLPAKKGLSRYYEGKSQSFACMSEVRCLEDLRKKDKPYKQKIKSCKSYVALGGMMAKKQPGSSSCANLDLVAXNGFRTPPIRNGYHQ

SEQ ID NO: 2391 - protein, 577 aa, Zea mays
MPDWRVREFEGKFTDEFAHSNNNKHESGVEAPGVTSSKKLKHTVAGEKIQGVIPGINSSDPQKCNSENIQHENRIVSQNINSAGDCIGDCKDSSNAFSSREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVMELLPTDQICSGHENIDMLQGGNQYSSEHTIQGIEDKKFSIASTSQLSSSQNLLKQRHHLDSNSPSNITYEAYEEKFGPSSGSFAQRNLKVQKKTMNMQPTQPINDNVMNRHPQTLTRSASYPCENNESERRGLGKRTLGDPQVTMGTSMVVDGSFVSSMSSDISVEESSFRQLQNAVSQLDVQTKLCIRDGLYRLARSAQHRQVIPNMMSSNEDNPDIKDLQNAETLRKFVDPRSIETQTNPIDRSIALLLFHQSSDHAAVAVDDASSLKPPAGSKHHQGPAANQNQGLIPDSSVYSPGDGAPKDVQSLDKF

SEQ ID NO: 2392 - protein, 585 aa, Sorghum bicolor
MPDWRVREFEGKFTDEFAHSNGKEHEGGVEAPGVTSSKKLKHAVANEKAQGPIPRTNSSDSQKCNLEDNQCENGIVSQNINSAADCIGDCKNGSNAFLSREENTIVETRCPTDNWNSCQFALSNGSSILNNHSAPQDSLTYGDNDLNYIDWPGIDNFEDVDTLFRSSDSTYGQQQLENADGLSWIPSSDAVYSSDVAMQQGFDSSYSDYGILDDLSAFHCAEDKSLPSVDPSSALCDNQFNDTYLFSEQKNVNAYGEQASQLFHFPSIYQEDVMELLPTDQICSGHENIDMLQVGNQYSSENAIQGIEDKKFSIASTSQLSSSQNLLNQRHHLNSSSPSNITSESYAEKFGPSSGSFAQRNSKAQKKTLNMQPRQPTNDNDINRHPQTLTRRASYPCENYETERKGLGKRTLGDPQVTMGTSMVVDGSFVSSVSSDNSVEESSFRQLQDAVSQLDVQTKLCIRDGLYRLARSAQHRQVFPNMMNNNGDSQDVKDLQNAETSHKFVDPRSIETQTNPIDRSIALLLFHQSSDQAAVAVDDASSLKSPAGNKQHPGPASNQGLMPASSVYSPGGQGTPKDVQSLDKY

SEQ ID NO: 2393 - protein, 572 aa, Saccharum officinarum
MPDWRVREFEGKFADEFAHSNSNEHEGGVEAPGVTSSKKLKHAVASEKVQGPIPRTSSSDSQKCNSEDIQRENGIVSQNINSAGDCKNGSNAFPSREENTIAETRCPTDNWNSCQFALSNGSPILNNHSAPQDSLTYGDNDLNYIDWPGIDNFEDVDTLFRSSDSTYGQQQLENADGLSWIPSSDAVYSSDVAMQQGFDSSYSDYGILDDLSAFQCAEDKSLPSVDPSSALCDNQFNDTYLFSEQKNVNAYGEQIYQEDVMELLPTDQICSEHENIDMLQVGNQYSSENAIQGIEDKKFSIASTSQLSSSQNLLNQRHHLDSSSPSNITSESYPEKFGPSSGSFAQRNSKVQKKTVNTQPRQTTNDNVMNRHPQTLTRIASYPCENYETERRGLGKRTLGDPQVTMGTSMVVDGSFVSSMSSDNSVEESSFRQLQDAVSQLDVQTKLCIRDGLYRLARSAQHRQVFPNMMNSNGDSQDVKDLQNAETSRKFVDPRSIETQTNPIDRSIALLLFHQSSDHAAVAVDDVSSLKSPAGNKQHQGPAANQGLMPASSVYSPGGQGTPKDVQSLDKY

SEQ ID NO: 2394 - protein, 570 aa, Panicum virgatum
MPDWRVGEFEGKFTDDFAQSNRNEHQSGVEAPGVTNSKKLKHAVASEKINQGVISGENNSDSQKCNSEHIQCANGIVSQNINSTGDCKDGSNAFTLREENTIAETRCPTDNWNSCQFGLSNGSSILNNHSTPHDSLAYGDNDLNYIDWPGIDNFEDVDTLFRRSDSTYGQQQLENTDSLSWIPSSSDAVYSSDVALQQGFESSYSDYGILDGLSAFQCAEDKSLPSVDPSTALCDNQFNDTYLFDEQKNVNTYDEQIYQEDVMELLPTEQISNGHGNIDMVGNQFSSENAIQSIEDKKFSIASTSQLSSSQNLLKQRHYLDSSSPSNITSESYPEKFSPSGGSFAQRNSKAQKKTVIIQPRQLATDNVVNIHPQTLTRRASYPCENYGTEEKGLGKRTLGDHQVTMGTSMVVDGSFVSSMSSDNSVEESSFRQLQDAVSQLDVQTKLCIRDGLYRLARSAQHRQVFPNTMNSNGDSQDVKDAETSHKFADPQSIETQTNPIDRSIALLLFHQSSDHAAGAVDDASSLKSPASKKQHQGPTGNQGVMPASSSIYSPRGQVGPKDAQSRDNY

SEQ ID NO: 2395 - protein, 567 aa, Panicum virgatum
MPDWRVGEFEGKFTDDFAQSNRGEHQSGVEAPGVANSKKLKHAVASEKINQGVISGTNNSDSPKCNSEHIQCANGIVSQNINSTGDCKDGSNAFTLREENTIAETRCPTDNWNSCQFGLSNGSSILNNHSTLQDSLACGDNDLNYIDWPGIDNFEDVDTLFRRSDSTYGQQQLENTDSLSWIPSSDAVYSSDVALQQGFESSYSDYGILDDLSAFQCAEDKSLPSVDPSTALCDNQFNDTYLFGEQKNVNTYGEQIYQEDVMELLPTEQISNGHGDMVGNQFPSENAIQSIEDKNFSIASTSQLSSSQNLLKQRHNLDSSSPSNITSESYPEKFSPSGGSLAQRNSKAQKKIVNIQPRQIANDNVVNRHPQTLTRRASYPCENYGTEEKGLGKRTLGDPQVTMGTSMVVDGSFVSSMSSDNSVEESSFRQLQDAVSQLDVQTKLCIRDALYRLARSAQHRQVFPNTMNSNGDSQDVKDAETLRKFADPRSIETQTNPIDRSIALLLFHQPSDHAAGAVDDASSLKSPASKKQHQGPAGNQAVMPASSSIYSPRGKVGPKDAQSRDNY

SEQ ID NO: 2396 - protein, 472 aa, Zea mays
MVASKAAPFDEVSSVEAGAYGGRDDDGRPRRTGTVWTASAHIITAVIGSGVLSLAWAIAQLGWAAGPAVMLLFAVVIYYTSTLLAECYRSGDPVAGKRNYTYMDAVRASLGGAKVRLCGAIQYANLFGVAIGYTIAASISMLAIKRADCFHAKGHKHACRSSSNPYMILFGVAEVVFSQIPDFDQIWWLSIVAAVMSFTYATIGLVLGIMQTVANGGFQGSLTGISIGAGVTPTEKVWRSLQAFGNIAFAYSYSIILIEIQDTVKAPPPSEAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPFSG

SEQ ID NO: 2397 - protein, 272 aa, Sorghum bicolor
MVAKKQAPFDELSLVEARGGGGGGGDDAEWRDDDGRPRRTGTVWTASAHIITAVIGSGVLSLAWAIAQLGWAAGPAVMILFAVVIYYTSTLLAECYRSGDPVAGKRNYTYMDAVRSSLGGAKVTLCGSIQYANLFGVAIGYTIAASISMLAIKRADCFHVKGHRNPCRSSSNPYMILFGVAEVVFSQIPDFDQIWWLSIVAAVMSFTYSTIGLVLGVMQTVANGGFQGSLTGISIGAGITPTQKVWRSLQAFGNIAFAYSYSIILIEIQARN

SEQ ID NO: 2398 - DNA, 1076 bp, Gossypium hirsutum
gatggatggttattgtagcagaagggtaatcatgtttttggtgtttgcatttgcagcaataagcagagggtatggacaagaatcaaccactcttgttcctgcaatcatcacctttggtgactctgtggtagatgtgggcaataatgactatctccctaccatcttcaaggctaactatcctccttatggacgggactttgccaacaaaaagcctactgggaggttttgcaatggaaaattagccactgacatcactgctgaaactctggggtttacaacttatccaccagcttaccttagcccagaagcatcagggaagaaccttctgcttggagccaattttgcttcagctggctctggctatgatgacaaagctgccatggtgaatcatgccatcacattgacccagcaattagagtatttcaaggaataccaggcaaagctagcaaaggtagcaggcagcaccaaatcagcatccattaccaaggatgcactgtatgtattgagtgcaggaagcggtgacttcctccagaactactatgtcaaccctctacttaaccatgcctatactccagaccagtacggctcattccttattgataccttcacaaacttcgtcaagaacctctatgggttgggagctaggaaaattggggttacctcacttccaccgttaggttgcgttccattagcaagaacattgttcggttaccacgagaaaggatgcatctccaggttcaataccgatgctcaacaattcaataaaaagctcaacgccgcagcagccaatctccagaagcagcatcctggtcttaagattgtggttttcgacatattcaaggcactttacgacattgttaaatctccctctaactatggttttgttgaagcaacaaaagggtgttgtggaactggaacagtagagacaaccgcatttttgtgcaatccaaaggcaccaggaacttgttccaatgccagccaatatgtattttgggacagtgttcatccatctcaggctgctaatcaagtccttgcagatgcattgattgttcagggcattgccctcatttgattcg

SEQ ID NO: 2399 - DNA, 704 bp, Gossypium hirsutum
gcaagtgatcaaagagaatgggaagaggaaaaatagagataaagaggatcgaaaacacaacaaatcgtcaggttaccttttgcaaacgcaggaatggcctgctgaagaaagcttacgaactgtcagtcctctgtgatgctgaagttgctctcattgtcttctccagtcgaggccgtctgtatgagtactccaacaacaacataagatcaacaatagacaggtacaagaaggcttgctcagatacttctaacacaaacactgttactgaaatcaatgctcagtattatcaacaagaatcagccaagttgagacagcagattcaaatgttacagaattctaacaggcacctaatgggagattccttgagttccttaactgtgaaagagttaaagcaggtagaaaacaggcttgaaagaggaattactaggatcaggtccaagaagcacgaaatgctactagctgaaatagagtttttgcagaaaagggaaatcgaattggaaaatgaaagtgtttgtctccgaaccaagattgcagaaattgagaggcttcagcaggcaaacatggtgactggacctgagcttaatgctattcaagctttagcttctcgcaatttctttagccccaatgtcattgagcatccatctgcttactcccatctctctgacaagaagattctccatcttgggtagaggagttggagaaag

SEQ ID NO: 2400 - DNA, 1970 bp, Gossypium hirsutum
acaagtacagaagctcaattcccaagatggaggccagcagcagcacctcccatgacccagcattgttccatgctcccttgctataccaccctcggagaaggagcagcagacccttaaagggtttcgcagtgataattgggtccgtcgttttcctactctcactggtcacattaatcgttaaccaaagcccggagccattagcaagtaaccccagtagtgtaacggaggcagggtcgtattcaatggcggcgcagccaagagggatagctgaaggtgtttcagccaagtcaaacccatcactttttgacaaagttgggtttaattggacaaacgctatgttttactggcaaagaactgcctaccactttcagcctcaaaagaattggatgaatgatcctgacggtccgttatatcacaagggatggtaccatcttttctatcaatacaaccctgattcagccatatggggaaacatcacttggggccacgctgtatcaacggacctcattcactggttctatctcccactcgccatggtccctgatcaatggtacgatatcaacggttgttggacggggtcggccactctcctgccagatggccgaatcgtaatgctttacaccggcagcaccaatgactccgtgcaagtccaaaaccttgcatatcccgccaacctatctgatcccctcctccttcagtggttaaaatacccgggtaacccggttgttgttcccccaaccgggatcgaagacgaagagttccgagacccgacaacagcttggcttggacccgatggttcctggcggattgttgttggtacaaggtttaataccaccataggaacagcccttgtttttcaaacgacaaacttttcggactatgaattattggatggggtcttacatgctgttccgggtacgggtatgtgggaatgtgtagatttttaccccgttgcaataaacgggtcggtcggactggacacgacggcacttgggcctggaattaagcatgtcctgaaggctagtttggatgatacgaaagttgatcattatgcaatagggacctacgacatgataacggataaatggacacctgataacccggaagaagatgtaggcatcgggttgaaagtggattatgggagatactatgcctccaagacattttttgatcagagtaaacaaaggaggattctttatggttgggttaatgaaactgattctgaagctgatgacctcgaaaaaggatgggcttccattcagacaattcccaggagtgtgttgtatgacaacaagaccggaacccatttactacagtggcctgtggaagaagtggagagcttgagactgaatgctacagtgtttaaggatgttgtagttgaagcaggatcagttgtgcccctcgacataggcaccgctactcagttggatatattagcagagtttgaaatagagacgttggtattgaacagcacggaggatgaagtcagtgattgcggtgatggggcggttgataggagcacttacgggccatttggggtcctggttattgctgatgattcactttctgagctcactcctatatatttccgtccacttaatacatccgatgggagtcttgaaacttacttttgcgctgacgaaacaaggtcttctaaagctcccgatgtcacaaaacgagtgtatggaggcaaaattccagtgcttgacgatgaaaactacaacatgagggtattggtggatcattcagtagtggaaagttttggaggaggagggaggacggtgataacatcaagagtgtatccaacggaagccatatatggagcagcacggctgttcttgttcaacaatgcaagtggagtgaatgtgaaggccacactcaaaatatgggagatgaattctgcctttattcgtcctttcccatttgaagaaacattatttcaggaaatggttgcttccacatgattatca

SEQ ID NO: 2401 - DNA, 964 bp, Gossypium hirsutum
gtccctattgcatgcctttcaatttgatttcatggatgtaacaagcacaccaaatagaaaagaaatggatcggatcaaaggtccatggagccccgaagaagatgacttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcatcttcttacgtgtacaagccgatcccaaggaccggcggtgttaacgttgatgtaaatgttacgccagctggagtggaagcggcatcatcttccaacgatccaccgacctcactgagtctgtctttaccgggggtggagtcatgtgaggtggtgtcaacccagccaataacggagtcaactcagaatcggagtgaagaaaggggaggtggggtgatgggtttcagtgcggagtttatggcggtgatgcaagagatgataagggttgaggtgaggaattacatgacgcagatgcagcaacagcagcagcagcaaaacggcgcagttccgggaggagcgggaatggggatgtgtttggatggggggttcaggaatcttatggctgtgaacccagtcgggatgagtaagatcgagtga

SEQ ID NO: 2402 - DNA, 1851 bp, Gossypium hirsutum
ggatagagagatgggaggtccaccgtacgattgcttggcgaatcccctaggagccgtccgattaacattcgagaaggcaatatggtcagaatcggagactcctccgatccatccctccgcctttaacggcaaagattggggtgcccttgaactcttccgccacttcctcttccaaggatcagggctttcccaggttcccatccttaatcccaaaacattaagatgggttcaacccaacagtcttgtacgttaccgtggtatgatccaagacatgttgggaaatgaattctatgccggcgcttacaaggatggaaatttatggcggaccaacaaattcatggatgtttctcaatacccaatgggttcctctcctgatatgtgtatttgggaacgccgcttgctctactgtgttcctgtcccaggacagaattcatggactgaaccttctagtgaaatggaacctaattggtcatctcaaaccagggagaagcggcgtaggatggatgacgaagataatgatcccatggatttggttcctgatgatgagattaaaagctctccaattaccaagaagatgagagaagatggacttccttccccttcacaatccagggatactaaaactacaagctcttcttctatcacaagtacatttcaatctgttgacgaagataaccttccttgcctagtcaagatatatgattctccagaatcagaattgaagctgaatgatgtttttgaatttattggggtcctcacttttgattcagagcttgcagttgagaaagatgacaatgatgagttatcaaatagtttctatgatgatgccctggtccatttgccccctaataaggtccctcgcttgcactgtcttatacataggaagcttgcagtgcaggactttctgccaggttccccaataatagagccaaagccacatttggtgaaagagacaagggaagctctgttcaggcatcttacggctgttcttggaaatgatgaggtagctgctcatttcgtgttgttgcatcttctgtccaaggttcatgctcgagtagatgatgttgcagtggggaagctgtcactcaatctaacaggtttaaacaaagaaagtgtatctgtgtttggtactcgacttagtgatacattcaaaaacctcctaccattcacgaattgcatgcctctcacactggaatatctgaacattgcctcgcttgccccgcaaaaggattatcaagccaacagattggttcctggcgttcttcagctacccgagggctcacacttgatggtagacgagacccgactagaatcaggaagcctcaattctactggaattgagaatacaaagttgctgaaaaatctcatcgagtttcaaaaagtggagtatgactttcaatactataaagtggaaatggcaacggatgtccagttacttatcttctcggaggggaaatctaatattgttcctgctgatgttattgtaccttttcaaccttcttgtcttgaatccactgaaatgccagttgctgaggcactagaagcttggagatggtacttggctactgttagatcattaccacattccattggatcagaaatacagaaggtggtagaagatgatttggttgcagcaagacaaatggatcggagcttgggaagtcgagattttagcagatggttgacgatggctcggctcatatcgtcaagtttcggagaaaccagtttgtcaaaggaacattgggaaatggccaaagaaatggagaggctaaggagggagagactgaaatagaatccaaaagtccacaagattttgaagctttggtatttggtaaatgattgttgccccag

SEQ ID NO: 2403 - DNA, 2019 bp, Gossypium hirsutum
gcatctgatctaattgttggtggacacacacacacacacacacacacacacatacatgtagcttttagctttgaaatgtctactggagttcaacatcaagagagagtaccaatgaacctgaagaaacaacttgctcttgctgtgaggaacattcaatggagttatgcaattttctggtccatatcaactagacaaccaggggtgttagaatggggagaaggttattacaatggagatataaagacaaggaaaacagttcaatctgtagaactcaacactgaccaattgagtttacagagaagtgagcaactgagacagctttatgagtctctttcagctggtgaaagcagtcctcaagctaaacgaccttcagcagcattatctcctgaagatcttactgatactgaatggtattacttggtttgtatgtcatttgtattcaacattggccaaggattacctggaagaacattgtctactggtcaacctgtttggctttgtaatgctcattgtgctgacagtaaagtgtttggtcgttcactactagctaagagtgcatcgattcagactgcagtatgctttccgttttcaggaggtgtggttgagctcggtgtgactgatttggtatttgaagatttgagcctcattcagcgcgttaaaactttgctcttggatgatccacagccgattgtttctaagagatcgattcaagtcgatgggatgaacaacgatcttgcttgtccagctcttgatcctttgatccttgccaccaaattgagtccaatattaggctgtgaacaactagaaacggtttctcctgatgatagtccggacggcttggagcctaagcaatcaagagaagattcattattgattgaagggataaatggtggagcttctcaagtacaaagttggcaattcatggatgaagagttttgcaattgtgttcaccattccttgaattcaagtgactgcatatctcaaaccattgcggatcatcgaaaggtcgttcctctttaccggggagaaaatgataatggtttgcaagatgttgaagagtgcaatcagactaaactaacatcttttgatcgccaaaacgatgatcggcacttccatgaagttctctcggccttattcaagagctcacacccgttgattttaggaccacagtttcgaaactctaacaaggaatcgagctttatcagatggcagaaaaatggcttggtgaagcctcaaaaagaaagagatgaaacccctcaaaagttactgaagaagatattgttcttggttcctcatatgcatgatagaggattgattgaatctcctgaaactaatgctgttcgagatgcagcttggagacccgaagctgatgaaatttgcggaaaccatgtgttatcggagaggaagcggagggaaaaaataaacgaacgacttatgatgttgaaatcacttgtccctgcaaataacaaggctgacaaggtttctatactagatgtcacgatagaatacttacaaaccctcgaaagaagggttgcggaattggaatcttgcagaaagtcagaagcaagaacgaaaatcgagcgaacatcagataactacggcaataataaaaccaacaacggaaagaaatcgtccctaagtaaaaggaaagcctatgatgttgttgatgaagctgatcaagagatcggctatgttgcatctaaagacggttcaacagataaagttactctcagtatgaacaacaaggagcttctaatcgagttcaagtgtccatggcgagaaggaattttgcttgaggtaatggatgcattaagcattctcaatttggattgccactcagttcagtcatctaccactgaggggattctctccctgaccataaaatccaagtacaaaggatcaagtgttgcaaaagcaggaccaatcgagcaagcattgcaaagaattgctagcaagtgttgaagctatttgttctagattttaccagtttcttttgtaagatcccatgtcataaggtgc

SEQ ID NO: 2404 - DNA, 550 bp, Gossypium hirsutum
gtgatggaactgagcattcagaaaatagaagccttgattaggctaagtacgatagtgatgttggttttaacagcttgtttaattgggttggattctcaaacaaaggtcatcttctacgttcaaaagaaagcttctttcaaggatttgcgtgctcttgttggattgctgtatatcacttcattggctgctgcttataatctacttcaactatgctgttcttcattctcagcttcttacaaaggaacctcgctgcaatcttacgcatatctggcttggcttcgttatattttggatcaggcagtagtgtacgcagtgtttgcgggaaacctagcggctttggagcattcatttttggtattaaccggagaagagaacttccaatggctcaagtggtgcaataaatatactcgattctgcacccaaatcggaggatccttgctctgcggcttcgttgcaagcttactaatgttttccatcgcttccatctccgcattcaacttgttcaggctgtattcccccaccaagttcatgcacttgaaactctaatcag

SEQ ID NO: 2405 - DNA, 388 bp, Gossypium hirsutum
gtacaaacatggctagttccggtgtccttaagttggtttccatgattctcatggtgtgcatgacgatgatgagtgcacccaaggcagccaaagccgccatcacgtgcagcgacgtggtgaaccacttgatcccgtgcttgtcctacgtacaaaacggcggtacacccgctgctgcatgctgcagtggggtaaaagcactctacggcgaggttcagacctccccggaccgccaaaacgtgtgcaagtgcatcaaatcggcggtgaacggaattccgtacaccagcaataacctcaatctcgcagccggcctacctgctaaatgtggtctccaactcccttacagcatcagcccctccactgactgcaacaaggtgcagtgaggttgatg

SEQ ID NO: 2406 - DNA, 1454 bp, Gossypium hirsutum
gttgttgtcatggcttctctgcctttcatcttcttcttatctttctttataatctccacaacattgacgtcagccggcgccgccgccgccaccatcaaactctccctctctcccttccctcacccttcttcctcccatccttaccaaattctcaacaacttagtcacttcttctgttgcaagagcccaccacctcaaacatcccaaagccaaggccgataatactacctcttctcttctcagggctcccctattttctcacagttatgggggctacactatctccctcaaatttggaactccgcctcaaacccttcctttcgtcatggacaccgggagcagcctctcctggttcccttgcacctctcgttacctttgttcccaatgcgcattccccaatgttgaccctgcaaaaatccccacttttgcccctaaactttcatcttccagtaagctcgtaggttgtagaaaccccaagtgtagttggctttttggccccgacgttgagtctcgttgccaagactgtgaacccacttccgaaaactgcactcaaacctgccctccttacataattcaatacggtttaggttccactgctgggcttctattagtagaaaaccttgctttcccccagaaaaccttccaagatttccttgtcggatgctccatcctctccaaccgacagcccgctggaatagccgggttcggtcggagcgctgagtctataccctcccaattaggcctcaagaaattctcttactgtctcgtttctcgccggttcgatgacactggcgtcagcagcaacatgttgttggaaaccgggtcgggttccggtgatgccaagaccccaggccttagctacacaccgttttacaggaaccaagtggcttcaaacccagttttcaaagagttctactacgtaactctacgtaaaattctggtgggcgataagcacgtcaaagttccgtacagttatttggtcccaggatcagacggtaacggtggcaccatagtggactcgggatcaacattcacttttatggagagaccagtgttcgaggtagtctcgaaagagttcgagaaacaaatgggaaattatagaagagtgcgtgaaatagaaaacagatcgggtttagccccatgcttcaacacttcgggctatacttcaatagaaatccccgaattgagtttccagttcaaaggaggagccaaaatggcattgcctttggttaactatttctcatttgacggtgatgataaggttgtgtgtttgatgatcgtttcaaacaatgtggtcggccaaggctcacacagcggtcctgcaataatactagggagctttcagcagcagaattattacatcgaatttgatatcgcaaacaataggtttggatgggctgaacgaagctgtgcgtgagctgcactttgttattttgtgttttggccatgaatatg

SEQ ID NO: 2407 - DNA, 1397 bp, Gossypium hirsutum
gaaaggaaatggcaggcgtcgaagcagggaaggaggaggaggcgaccgctgtgagaatcaccggaaaaagccacgtcaagccgggtaagttgataggaagaaaagagtgtcagttggtcacatttgatctcccctacctggctttctattataaccagaagctgctgttttacaagaacgacggtggtggtgagttcgaggacaaggttgaaaagctcaagggagggctgagggtggtgttagaggagttttatcagctaggaggtaagctcgggaaagatgacgatggggttcttagagttgattatgacgatgatatggatggtgttgaagtggtggaagccgtggcagaggggattaccgtcgatgaattgaccggtgatgatggtacgagctcatttaaggaattgataccttttaatggcgtcttgaacttggagggtcttcacaggcctcttttgtccatacagttgacgaagttgaaagatggtgttgcaatggggtgtgctttcaaccatgccatcctcgacggaacctccacttggcattttatgagctcttgggctcaaatctgtaacggtacttcgagctccgtcgttgtgccgccgtttcttgatcggaccacagctcgaaacacccgcgtgaagctcgacctcagtccggttgtttcctgcaacggcgacgacgccaccaaacaaggccagccggcgccgcagatgagggagaaactcttccgtttttccgaagccgccgtcgataagatcaaatcgagagttaattcaaccccaccaccgtccgatggctctaaaccgttctcgactttccaatctctagctgtccacatttggcgacacgtatcccaagcacgtaaccttaaacccgaagactacacggtttttactgtcttcgccgattgtcgtaaaagggttgatccaccgatgcccgacagttacttcggaaacttgattcaagccatcttcaccgccacagcggccgggttgttattggaaaacccaccgtcattcggagcttcagtgatacaaaaagctatagaatcccacgacgctaaagccatcgatgaacgtaacaaggcatgggaagcagcgccgaagattttccagttcaaagacgccggtgtcaactgcgtagcggtcggaagctccccgaggtttaaagtttacgaagtggatttcgggtggggaaagccggtaggggtgaggagtggatccaacaacaggttcgatggaatggtgtatttgtatcaagggaagagcggtggccggagcattgacgttgaaatcaccatggaagctcaagctatggagaaattggagaaggataaagagtttttaatggaagtatagtattttgcatggaagtagggtactgtggatctc

SEQ ID NO: 2408 - DNA, 1016 bp, Gossypium hirsutum
atgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagcacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgttggagacccttttaattacctatatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcactgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctgacggaacaaaagccaaagcagtagcagtctgccacacagatacatcagcatggaaccctaagcatttggcttttcaagtcctaaaagttgaaccaggaaccattcctgtctgccatttccttcctcgggatcacattgtttgggtccctaagtaaaaatcctg

SEQ ID NO: 2409 - DNA, 932 bp, Gossypium hirsutum
gcatacagagatggagaggcaaagaagcaagcaggtttgtttgttgatgtgggttttggttgctgcctttttctcccacaatagggtcattgcagtgacctccactggccttggtgagcagaaaaactactatccagctcctgaccctcatgctggaactcccccttcaggttcacatggcacaccaccatcttcaggaggtggatcacctccctctcatggaaccccgtcacatggaggtggttaccacccttcaccaacaccatcaacgccttcgggtggaaattgtggaactcccccacatgacccttcaactccatcaacaccatcacacactcctcctcatggtactccaccatcatctggaggtggtagtcccccatcgtatggaggaggcagtcccccatcgtatggaggaggcagtcccccatcgtatggaggaggcagtcccccatcatacggaggtggcagtcccccatcatatggaggtggcagtccaccaactactcccattgatccaggaactccaagcattccctcacctccattctttcctgctccaactccaccaattggtggtacatgcgatttctggaggagtcaccccacactgatatggggtctgcttggttggtggggcactgtaggcaacgcatttggcgtgaccaacgctcctggacttggaacaagcatgagcttgccccaagcactttcaaacacacgtactgatggacttggggcgctttaccgggaaggaacagcctcatttctcaactccatggtgaataataggttcccattctcgactaagcaagtcagggagacttttgttgcagcacttggttcaaacagcgctgcagcagctcaggctcgtctcttcaagcttgccaatgaaggccacctcaagccaaggacctaagcaaacacctttg

SEQ ID NO: 2410 - DNA, 617 bp, Gossypium hirsutum
gagaaagatgatgaaaaggggttttattgttttggccttgacggtggttttcgccgcgacggtggttacggcggctgacgagagtgggttagcgaatgagtgcagcaaagatttccagagcgtgatgacttgcttaagctttgctcaaggaaaagcagcgtcgccgtcgaaggagtgttgtaattcagtggcggggattaaagagaataaacccaaatgtttgtgttatattttgcaacaaacacaaacttccggtgctcaaaatctcaaaagcttaggtgttcaagaagataagctgtttcagttaccgtcggcttgtcaattgaagaacgctagcgtcagtgattgcccaaagcttcttgggttatctccgagctcaccagacgccgccatcttcaccaactcctcctctaaagcaacgacacccagtacttcaacaaccaccgcaacgccgtcttccgcggccgataaaaccgatagcaaatccagtggaatcaagcttggtccccacttcgtcggttccacggcggcgctactggttgctacagcggccgtgtttttccttgtattcccagctggatttgcttcaatagtttaggggttttgcatgggatttg

SEQ ID NO: 2411 - DNA, 2002 bp, Gossypium hirsutum
gcggcaacttaaaagaaaaccttttctttcctcattgttttactactaaaatcccataatgccggtcgtggattttgtctgtgtttttttagtttcagttgtgatgtttaatttgagagtaagcacagaaccagttgaagacaagcaagctctacttgctttcatttcgggaattagacatgccgaccgggttaaatggaattcatcgacctcagcctgtgattggttcggtgttcaatgcgacgccaaccggtctttcgtctacactttacggctccccggtgcggcccttatcggttcgattccgcccaatacaatcggtcggttgaaccgacttcgagttttaagtctacgagcaaaccgtttgtccggtgagatccctgccgatttctacaatttgactcagctgcgtagcctttatttgcaaggtaacgagttcaccggtccgttcccacctagtgtgactcgtttaactcgtttgactcgccttgatctttcttctaataatttcaccggtccaattcctttgggtgtcaacaatttgactcagttgaccagactcttcttgcaaaataacaagttttccggttctctcccgagcatcgactcggacggtttaaacgatttcaatgtgtctaacaacaaccttaaaggttcaatccccgactcgttatctaaattccccgaatcttcattcgccggaaacattgggctttgcggcggtccacttcggccatgtaacccatttcctccatctccatctccgactgagcccattccgcccaaaacttccggtcaaagctcgaaaagccttcccaccggcgccatcattgccattgccgtggggtcagcaattgttgcgttactgttattactattcctcattatctgcttccgtaaatggaaacggaagtcaccgaggcggcagaaggcgataccatcgacgacacatgcagttccggtggaggaggcggggacttcctcgtcgaaagatgatataaccggaggctcaacggaaatcgaaaggatgatgaataataagctcatgttcttcaaaggtggcgtttacagtttcgatttggaggatttgatgagggcgtcggctgaaatgttgggaaaaggcagcaccggaacgtcgtacagggtggttttagcggtggggacgacggtggcagttaaacggttgaaagacgtggcggttagtaaacgagagttcgtaatgaagatgggaatgttgggtaaaatcatgcatgaaaacgtggttccgttgagagctttttattattccgacgaggagaaattgctggtttatgattacatgcatggtggaagcttgtttgcgctgcttcacggtagcagaagctcggctcgtacaccgttagaatgggacccccggatgaaaatagccctaggcgtggctagaggcctcgcgcacctccacagttcacaaaacatggtccacggcaacattaaatcttccaacatccttctccgaccagaccacgaagcctgcatctcagagttcggtcttaactctcttttcaacaccaacactccacctagtcgcatcgcgggttaccaagcacctgaagtaattcaaacccataaagttacggtgaagtcagacgtttatagtttcggggtgttattattggaattattaaccggtagggcaccaatccaaccatcaataactgaagaagcgttcgatcttccgcgttgggtccaatccgtggttcgggaggaatgggcggccgaggtgtttgacgcagagttaatggcataccacgacatcgaggaagaaatggtgcaagcgttacaaattgcaatggtttgtgtctcgacagtgcccgatcaaagacccgtcatgtcggaagtggtacgtatgatcggagatatgatagatagagggggaacaaatgacggtacggcagccgccatatgatccgttaaacaatgaaacaaaattcaaagtgtgttgaccttgagaagccaacaaagg

SEQ ID NO: 2412 - DNA, 1556 bp, Gossypium hirsutum
gactgtaaaaaagcataggttcccaatgcagatcctcccgtttcgaggaggcgcacttgtgtgcttcattgcttccttgttatttgttgccagtttttgcaatgccgatgctaaaacagtcgaggttgtcggggctggtgagtgtgcagattgtgcagagaataacttggagattagccaggctttttcagggctacgagtaagcatagactgcaagcccgaaaatgggaagaactttaaaacacgaggatcaggggagcttgataaacaaggcaattttaaagtattcgttccagaggatttggttgaaaatggggaactgaaggaagaatgctatgcacagcttcacagtgtatcggcagcaccttgtcccgcccatgatggcttggagtcggccaagttagtgttgaagtccaggagtgatgggaaacacgggtttgggttaaaaggaaagctcagattctcacctctaacctgtgcttctgccttcttttggcctcactttaagtttcctcccttgcctaagtggaaccatccccctttgcccaagtttccacttcccccattcaaaggcttccaccaccattatccaataatccctcccatctacaagaaacctcttccgccaccgtccccggtgtacaagccccctccagttcccgtaaacccacctgttccaatctataaacctccaccagttccagtctataaacctcctccagttccagtaaaaccacttcctccacctgttccaatctacaaacctccaccagttgaaaaaccacatcctccacctgttccagtctataaacctccaccagttccagtatacaagaagccatgtcctccaccagttccagtctataaatctcctccggttccagtatacaagaaaccgcatcctcctccagttccagtctataagaaaccacatccacctccagttccagtatacaagaaaccatgtcctcccccagttccagtctataaatctcctccagttccggaaccacatcctccgccagttccagtctataagaaaccacatccacctccagttccagtatacaagaaaccatgtcctcccccagttccagtctataaatctcctccagttccggaaccacatcctccgccagttccagtccataagcctcctccagttccggtatacaagaaaagagtccctcctccggttccaatctacaagccccctccagttcctgtatacaacaaaccactacctcccccggttccagtgtatacgaagccacttccaccacctgttccaacctacaaaccaaaacccctccctcccattccttacaagccactccctccacttcccaagatccctccattccctaagaagccatgccctccccttcctaagctacctcctcttcccaagattcctcccaagtatttccaccaccaccctccccttcctaagctacctcctctccctaagattcctcccaagtatttccaccaccatcccaagttcggaaaatggccttctttgccaccctttgctccccatcatccttaagctg

SEQ ID NO: 2413 - DNA, 679 bp, Gossypium hirsutum
ggatggtgagaggcaaaattcagatgaagcgaattgaaaatgcaacgagccggcaagtcaccttctctaagcgacgaaacgggttgttgaagaaggcttatgaactatatgttctatgcgatgctgaagtagctgtcatcatattttctcataaaggaaaactctacgagttctcaagttccgacaacatgcaaaacaccatagaacgataccgtcagtacaagaaagatgtccagagtaacatccctgaatttgacagatacacacagcaactaaggcttgaagcagaaaatatggccaagaagattgagttccttgaggtttctaaaaggagaatgttgggtcaaaatcttggttcttgttctatagatgaacttcaagaggttgaaaaccagcttgaacgcagcttaagaaacattagggcaagaaagggctatttattcaaggagcagatactgcaactaaaagctaaggaaagatatatgcaagaggagaatgccaagttatctgctaagaacaatggtacaacatgcagccagcagaacgcggaggtggagacagaactgttcctcgggttgcccgaaaaccgctgttcctagcaggtaggtctttggatatggaatgaaaatgatattccctattggaataatgcttgcttgtacgttatcgccattgctag

SEQ ID NO: 2414 - DNA, 1864 bp, Hordeum vulgare
gatcctcacattgcgaggggcctgccgtcagcttcctcattgctgccctctgccctgccctccatggataggctcgtcgcagccggcattcttgccttcctactgatcgcgtcggtaggaagccatgcagctcgtgctccggggcaatactgggagtctgctcttcccaacactcccatgccaagctccctctctcaactcctcgacacgcaagccggaggcacgtcggtgaacgtcggctcgggcggcgtccatgtcgacgcgggccatgggatgcctgggggcacgacggtcgatgtgggcaagggtggcgtcggcgtcaacgtgaagcctggcagcgccaagcccggcgggactacggtcggcgtcggcaagggcggcgtgggtgtcaacgtcaagcctggctacggcaagcccgggggcacaacagttggcgttggcaagggcggcgtggacgtcaacgtcaaacctggcagcgccaagcccagcggcaccggcacgacggtcggcgttggcaaaggtggcgtggacgtcaacgtcaaacctggcagcggcaagcccagcggcaccggcacgacggtcggcgttggcaaaggtggcgtggacgtcaacgtcaagcctggctacggcaagcccggtggcagtggcaccacggttggggtagggaagggaggcgtcggcgtgaacgtgaggcctggcggcggcaccacggtcggcgtcgggaaaggtggcgtcggcgttaacgtgaaacctggctacggcaagccagctggtggcaccggcacgacggtcggcgtcgggaagggcggcgtcggcgtcaacgtcaagcctggctacggtaagccaggcggcacgacggtcggcgtcgggaagggcggcgtcggcgtcaacgtcaggcctggctacggtaagccaggcggcaaaccccggggtaagcctgtccacgtcaacgtctcacccttcatatacaactacgccgcaacggagacgcagctgcacgacgaccccagcgcggcgctcttcttcctggagaaggacctccacgccgggaagaagatgagcgtccatttcatggccaccccgggcgccggagggaagttcctgccgcggagcgaggccgacgccatccccttctcctctgagaaggcccccgagatcctcagccgcttctccgtggcgccggactccgccgaggcggcggagatgaagcagacgctgcgggagtgcgaggcggcggcgggcaagggggagaagaagtcgtgcgccacgtcgctggagtcgatggtggacttcgccacgtccagcctcgggaccagccacgtgagggccgtctccacggtcgtcgggaacgggaaggaggggtcgccggagcaggagtacaccatgaccggcgtgaagcgcgcggcgggggccgaccagctcgtggcctgccacgcggagccgtacgcgtacgccgtgttcgcgtgccacctgacgcaggcgaccagggcgtacacggtgtccatggtcggcagggacggcacggcggtggaggccgtcgcggtgtgccacgccgacacggccggctggaacccggggcacgtcgcgttccaggtgctcaaggtgaagcccggcggcgcgccggtgtgccacttcctgccgcaggaccacgtcgtctggacccgccgcggctgatgaagcccggtcgacccgcgccgttggtaagcaccatatacagttgtgctttgccctatattatggtatcttgcaccctagcatcgctatatacatttcccttgtttggtacctattgtgttttgatggcgtggcgttgccagtatcgccagcttgtacggagtggcacgtttgatgtatagtttagcac

SEQ ID NO: 2415 - DNA, 1492 bp, Oryza sativa
gatttctctagaaacaatggacccagctactgttggtggtggaggtggagagccagaggctgctgctgagtggagagctagagctgttggtggaatggagtacggttggtacagagctgttccaggtggtactggtactactctcctcgctctcagacttgctagaggtgctgaggctgctgttgctgctgctactgttcaggctgctctcagagctatcctcgatgctcatccagttctcagagctagactcagaggttctgcttctggttctccaactctcgctttcccatctgctgctgctccaccaccacctccacttgctcttgagcttctcccagttccagagtctgctaccgatttcccatctctccttgagcatgagcttaacagaaacccatggactgctgctgctgcaactgctactgcttctgagcatgagccagatgctccaccagttctcttcgctactctctacgagcttccacctccagcaggtggtggttctgctctcttcgtgagaatccatactgctgcttgcgatagagctgcttctgcttctctcgttagagagcttctcgctcagttggctggtgatggggcagcagctgcagccgcttcagagcctgaggacgctgctgttagagcttctcttgaggagagaatcccacagagagatagctggaagccattctgggctagaggtctcgatatggtcgggtactctatcaacggtctcaggacttctactctcccattcgaggtgacaggtactgagagatctactcagatgctcaggctcggtttcgatagagatgagactactaggctcctcgatgcttgcaagcagaacggtgttaagttgtgcgctgctatggcagctgctactctccttgctgctagacagtctaagctccagctcgcttctaaccagcaagagacctactctatcgctacactcatcaactgccgtaagttccttgagccagctctcgatgaccataacgtgggattctaccactctgctatcactaacactcacgctatccatggtggagaggagctttgggagcttgctaagagatgccaggactcttacaccaacgctaagaacaacaagaagcacctcaccgatatcgctgatctcaacttccttatgtgccgtgctatcgagaacccacagctcactactggttcagctctcagaactgctgtggtgtctgttttcgaggagccagtggtgtacgatctctctgatctccagtctaaggctggtgttgaggagttcgtttgctgcgcaactgttcatggtgttggtccatctatcgggctcttcgattctatcagagatgggcagcttgagttcgcttgcatgtacccatgcccactccattcaagaaagcagatgcaagagatcctcaacaaggtcaagcagatcctccatgagggttctatcggtgatgatgagtctttcgaggactgcacctgatga

SEQ ID NO: 2416 - DNA, 415 bp, Arabidopsis thaliana
aacaatggacaaattttggactttcctcactgctcttcattcaggcgctgggcctatcgtgatgttactttatccattgtacgcatcggtgatagcaatggagagcacaacaaaagtggacgatgaacagtggcttgcgtattggataatatattcgttcctctcactcacggaactgattctgcaatcgcttattgagtggattccgatttggtatacggtgaaacttgtgttcgtggcttggctagttcttcctcagtttcaaggcgcagcttttatctacaaccgtgttgttagagaacagttcaagaaacacggcgtcctccgctccacccactccaagcccaccaagcccaacatcctccactccattttcccccaccgggagggacacgaggctcacagtcactgatga

SEQ ID NO: 2417 - DNA, 535 bp, Solanum lycopersicum
aacaatggcaggtgaggcaactcgggtgatggtagcggtgaacgagtcgacgatcaagggttatccacatgcttccattagcagtaaaggagcattcgagtggactcttaacaaaattgttcgttccaacacttctggtttcaaactcctcttcctccatgtccaagttcccgatgaagatggttttgaagatatggatagcatatttgcatcacctgatgatttcaagggcatgaaaaacaggaacaagattagagggctccatctgctggagtactttgttaaccgctgtcatgaaattggggttccttgtgaagcatggataaagaaaggcgatcccaaggaagtcatctgccacgaagtcaaacgtgtacagccagatcttcttgtggttggttgccgtggtcttggtccttttcagagggttttcgtgggaactgtaagtgagttctgtctgaagcatgctgaatgtcctgttgtcacaattaagcgcagtgcagctgagactcctcaggacccaatagatgactaataa

SEQ ID NO: 2418 - DNA, 832 bp, Solanum lycopersicum
aacaatggattgggaaaaacagcagcagcagccaccggtgtcggcgccgcagcagacggcggaggaattgaacggaacagtcagtggtgggatgtttgtgaaagtgatgacggatgagcaaatggaagttttaaggaagcaaatcgctgtttatgctactatttgtgaacagcttgttgatttgcataaatccatggcttcacaacacgatcttgctggagccaggctgggaaatctgtactgcgatccactggtgacatctgctggtcataaaatcactggtagacaacgctggactccaacacctatgcaacttcagattcttgagcgcatatttgaacaaggcaatggaactccaaccaaacagaagatcaaagagataacttctgaattatctcaacatggccaaatttctgaaacaaatgtgtataattggtttcaaaataggcgtgctcgatcaaaaaggaagcaacaggttgcagcaacaaacaacactgaatcagaggtggagacagaggttgagtcgcccaatgaaaagaaaacaaagccagaggatctgcagtcttctcacatgcctacttcaatggctgaagatcttggctatgagaaccctgacgtgagctctggaatgcattcactagatccacgaaccagtaaacccgagcctatgtttccatcagacggtagttcaaaacctgctgcaagttatggccaaatgtccttctatggaatgtctaatccaagaatggaccagctaatgggaaagatggaagtgcctgggagctatcatccatatatacatgcagacgactacaacatgaccggctaataa

SEQ ID NO: 2419 - DNA, 646 bp, Solanum lycopersicum
aacaatgtttggtgggttcaatgtgtttttctatggacttggtgtggctgtgtatgcttttgaagggattggtatggtcttacctctggaatcagagacaagagacaaggacaagtttgggaaaatcttgggattggcaatgggcttcatatcattgctgtttggtgcttttggagtattgggctactttgcatttggggaagacactaaagatataatcactacaaatcttgggcagggattgctcagcacctttgttcaacttggcctttgcataaacctgtttttctctttcccccttatgatgaatccagtctatgaagtaatggaaaggagattctgggaaggcaggtactgtgtgtggttgagatggcttgtggttttagcagtgacttttgttgcattggcggtgcccaattttgctgatttcttgtcacttgttgggagcagtgtgtgcattgttttgggatttgtgttgccttctttgtttcacttaattgcgttcaaagatgaattgagatggtatggttttgcttctgatgctgcattgattgtcatgggcacaatttttgccgtctatggaacctcttcttccctgatggagatctttgcaaaaaaagcttagtttcttttcctcatagcatag

SEQ ID NO: 2420 - DNA, 1291 bp, Oryza sativa
ggatccaacaatgggactccacaaagaggcttctagttcttcttctaggctcgatgctgctcctcttcttcctcatcatggacatggtggaggtggagctggacatcatctctcatctcagcctaagaccttcgctaacgtgttcatcgctgttgttggatctggtgttctcggactcccttacactttctctaggactggatgggtggcaggatctgttcttcttctcgctgtggctgctcttactttccattgcatgatgctcctcgtggcttgtagaagaaggctcgcttacgatcaccctaagatcgcttcattcggagatcttggagctgctgtttgtggacctgctggtagacatgttgtggatgctatgcttgtgctctctcaggcttctttctgtgtgggatacctcatcttcatctctaacaccatggctcatctctaccctgttggagattcttctccatcttctcctctcctcaccgctaaggctatcttcatctgggttatgcttcctttccagctcggactcaactctatcaagactctcactctcctcgctccactttctatcttcgctgatgtggtggatcttggtgctatgggagttgttctcggacaggatgtttctacttggctcgctaacaagcctcctgttttcgcttctgctggacctactgagatcctttacggacttggagttgctgtgtacgctttcgagggaatcggaatggttcttcctcttgaggctgaggctgctgataagagaaagttcggaggaactctcgctctttctatggctttcatcgctgtgatgtacggacttttcggagctatgggatacctcgctttcggagctgctactagggatatcatcaccactaacctcggaactggatggctttctgtgactgttcagctcggtctctgtatcaacctcttcttcaccatgcctgtgatgatgaaccctgtgtacgaagttgctgagagactcctctgcagaaaaagatacgcttggtggcttagatggcttcttgtgatggttgtgggactcatggctatgcttgttcctaacttcgctgatttcctctctcttgtgggatcttctgtttgcgttctcctcggatttgttctccctgctgctttccatcttaaggtgttcggagctgaagttggatggcctggactcgctggtgatgttgctgttatcgttgtgggaactgctcttgctgtttctggaacttggacctctctcgctcagatcttctcttcttctgatgtgtgatga

SEQ ID NO: 2421 - DNA, 670 bp, Gossypium hirsutum
aacaatgaaagggattcgctccattcttattgcttttggcctatttgcttttgcttgctcatcggcctcagcatatgaccccagtcctctccaggacttttgtgtagctatcaaggacatcaagaatggcgtgtttgtaaatggtaaattttgcaaagacccaaagcttgcagttgcagaagatttcttcttttcaggcctaaacaggccgaggaacacatcaaatccagatggatcaaatgtcactatgatcaatgtagatataataccaggacttaacactcttggtttaactctggttcgagtcgactatgcaccttatggtgtcaaccctcctcacactcaccctcggggatccgagatcctacttgttgtcgaaggcacactttatgccggcttcgttacggcggacccagacaaccgtctcttcactaaaatcctaaaccctggagatgcttttgttttcccctttggtttgattcatttccagttcaacataggaaaaactgcggcggttgcctttgctgttctcagcagccaaaatgctgggcgtatcaccatagctgacgcagtgtttggctcaaacccaccgatcaacccagatgttttggccaaggcgttccagttgaacaagaatgtggttaagtatcttcagtctcggttctaataa

SEQ ID NO: 2422 - DNA, 1224 bp, Oryza sativa
cttctaataatcaaccgacaggccgcatcgagcagaacacgaaagatgatcatgttgtggctgcccgccgccgtctcgctcctcctctcgtcgtcgctgcatgtcgccggtgacgccggcggcggcgtcgcctccctctccgtccggcgctacgacgccatcttcagcttcggcgactccttggccgacaccggcaacaaccccgtcgtcttcgactggtactccatcttcgaccccgtcacccgccctccctacggctccaccttcttcggccgccccaccggccgcaactgcgacggccgcctcgtcctcgacttcgtcgccgaacgcctgggcctgccgttggtgccgccgttcttggcttacaacgggagcttccggcacggcgccaacttcgccgtcggcgccgccaccgcactcgactccagcttcttccacggcgccggcgatcccccgggcgccagcccgttccctctcaacaccagcctaagcgtgcagctgagctggttcgattcactcaagccctcactctgcagcacaactcaagaatgcaaggatttcttcggcagatcgctcttcttcgtcggcgaattcggcatcaacgactaccactcctccttcgggaggaggagcatgcaagaaatcagatcgttcgtcccggacatcatccgtaccatctccatggccgtcgagaagctgattggcgacggggcgaccacggtggtggttccgggcatgatcccgtcgggatgctcgccgccggtgctcgtcaccttcgccgacgccggcgcggcggagtacgacgcgagcaccggctgcctgagggagcccaacgaggtagcgacgctgcacaactcgctgcttctggacgccgtcgaggagctccgggagaagcacccggatgtcgccatcatgcacaccgatttgttcagacacgtctcggagatggtccagaatcctgacaagtttgggtttcaaaaggatgttctcagcgtttgctgtggaggtcccggaaaataccactacaacaccaggataatctgcggcgatgaaggtgcgaccacctgtgtggatccatccaagagcttgtactgggacggcgtccacttaaccgaggcagcttaccactacatcgccgatgattggcttcatgccataaccttatctgcaagagctacctcctaaaattgatatggcacgaacgtcggatacacacatgtaatg

SEQ ID NO: 2423 - DNA, 1457 bp, Arabidopsis thaliana
ttaccatgggagactataacatgaatgaatttgcttatggtaatctttacgatgatgatgatggcgatgttggtggatcgtctaaagaaggaaacaattcgattcagaaagtttcaatgttaccactcgttttcctcatattctacgaagtctcaggaggtcctttcggtgctgaaggtagtgtgaatgcagcaggaccattgttagctcttttagggtttgtgatcttccctttcatttggtgtatccctgaggcactaatcactgcggagatgagtacaatgtttccaataaacggcggttttgttgtttgggtctcctctgctttgggaaccttttgggggtttcaagtaggttggatgaaatggctttgcggtgttattgataacgctttgtatcctgttcttttcctcgattatttgaagtccgcggtcccggctttagctactggtttgccaagagttgcatcgatcttgatcttgactctattgcttacttacttaaactatagaggactaaccattgttggttggaccgctgtgtttatgggagttttctctatgcttccgtttgctgtaatgagtctggtttctattccgcagctcgagccttcgagatggcttgtgatggatttaggaaatgtcaactggaacttgtatctcaacacgcttttatggaatctgaactactgggattcggttagtacactggccggtgaagtggcaaatccgaagaaaacacttcctaaggctttgtgttacggtgttatctttgtcgctctttcgaacttcctccctcttttgtctggaaccggggctataccgttggatcgtgagttatggacagatggatatctagctgaggttgctaaagccatcggtggaggatggttacaattgtgggttcaagcggctgcagctacatcaaacatgggaatgtttttagccgaaatgagtagtgattcctttcagctacttggaatggctgaactcggtatacttcccgagatctttgcgcaaagatctcgctacgggacacctttactagggattctgttttcagcctcaggtgttttactcttgtcaggattaagctttcaagagattatagctgcagagaatttgctttactgtggtggaatgattttggagtttatagcatttgttagactgaggaagaaacatccggctgcatcgagaccgtataagatacctgttggaaccgttggttcgattctgatatgtgtccctccgattgtactgatatgtttggttattgttctatctactattaaagtggctcttgtgagctttgtgatggtggtcattggtttcttgatgaaaccttgtttaaatcatatggatggaaagaaatgggtcaaattctcagtctgttctgatttggcagagtttcagaaggagaatttggattgtgaagagtctttgttacgttagtag

SEQ ID NO: 2424 - DNA, 364 bp, Oryza sativa
ccaagaggtagcacatcctctccgaagggaagatatgagcgaccagagctcgtaccctaaccctgctcaagggtactaccagggtcccccagcctcggcggcggccggccaagataacacggcggccggcggtggcaagtccaacgcagccaagaaagaccaaccgagcttcatggataacctccttgcttgcctcccctgtgcccgcccagccgaagccaagaacgacgcgagctaactaaccttgctccatcaggcagcctagcacgggaaggaaggctgcaaagctactgcatgattatgcccagtgtttgtttgattattcagcatctaagtaagcacgtcgttaattagttcaatccgg

SEQ ID NO: 2425 - DNA, 635 bp, Oryza sativa
gtttgcttgcttaccaggagaaagatatgaggaaggaaattgtcatcaggctgcagagctctgagaagggccacaagaaagctatcaaggttgctgctgcagtctccggtgtggaatccgtgacgctcgccggcgaggacaagaacctgctgctggtgatcggcttcggggtggactccaacgacctcaccgagaagctgcggaggaaggtcggccacgccgaggtggtggagctgcgcaccgtcgacgccgacgagctcatgcgcgtcgccgccgccaaccagtacccgtaccgctactaccccggcgcgccgcccccggccccgtactacggcaacggcgggtaccctcctcctcaccagcgcggcggcggcggcggcggcagcggcggtggctactacacgccgatgacgatggccacgggtggctactacggcggcggcggcggcgggtacccgcagtacgggcagtcgtcgtcgtacccgcagtacgggcagtcgtcgtcgtactacccgccggcggcggcggcgacgacgaacacgcacaccgtcgtgcaccaccagtacgccaacaacgacccggacagctgcgccatcatgtagctgcaccagctagtgtacgatcgatgctgctaa

SEQ ID NO: 2426 - DNA, 289 bp, Oryza sativa
gagtttacaagagacccagacgatcaagatgtcgtgcggtggaagttgcaactgcggttcctgcggatgcggcggtggctgcggaaagatgtaccctgacctggctgagaagatcaccaccaccaccactactgcaaccactgtcctaggtgttgcacctgagaaggggcactctgagggggttggcaaggcagctgaatctggcgaggctgcccatggctgcagctgtggctccagctgcaggtgcaacccctgcaactgctaaggccaaggcgatctatgactgaat

SEQ ID NO: 2427 - DNA, 366 bp, Oryza sativa
actagctgcatggcaatggcgggagagagtaggaggaggaggagggcggcggcggaggcggtggcgtggtgcttggcgctgggcgtggtggcgctgctgctggtggggtcggtggagaaggaggaggaggtggtggtggtgcgcggggcgcggctggcggcggcgcggccgtgcgaggagatatacgtggtggaggaaggggagacgctgcacagcatcagcgacaggtgcggcgacccgtacatcctggagcagaacccgcacgtccacgaccccgacgacgtcttccccggcctcgtcatcaagatcacgccgcgccccggccgccgcaactgaactgaacttgctgatcgatcaacgcgttta

SEQ ID NO: 2428 - DNA, 1859 bp, Oryza sativa
ggatcctattcatggctccagctgctgttgctgctgctgaggctggttctaaggctgctgctgtggcaggaaaggcagttgctgcttgcgagagagatgctgagaagctcgagttcatcgaggagatgactagaggtttcgatgctgtgcaagagagagttctcgctgctatcctcgctagaaacaacggtgctgagtaccttagaaggcatggaatggagggtagaactgacagagaggctttcaaggctagagtgccagtggttacttacgaggatctcagaccagagatcgagagaatcgctaacggtgacaggtctaacatcatctctagccacccaatcactgagttcctcacatcttctggtacatctgctggggagagaaagctcatgccaactatcgaggatgagcttgaccgtagacagatgctctactctctcctcatgcctgtgatgaacctctacgtgccaggtcttgataagggaaaggggctctacttcctgttcatcaagagcgagactaagactccaggtggacttccagctagaccagtgctcacctcttactacaagagcgaccacttcaagcacagaccattcgatccatacaacgtgtacacttctccaactgctgctatcttgtgcactgacgctttccagtctatgtacgctcagatgctctgtggtcttgttgctagagctgaggtgttgagagtgggtgctgttttcgcttctggactcctcagagctatcagattcctccagctccattggagagagcttgctcacgatatcagaaccggtactctctctgctaaggtgacagagccatctatcagagatgctgtggctgaggttttggctgcacctgacgcagaactggcagcattcgttgaggctgagtgcggaaaggataagtgggagggtatcatcactagaatgtggccaaacaccaagtacctcgatgtgatcgtgactggtgctatggctcagtacatcccaactctcaagttctactctggtggacttcctatggcttgcaccatgtacgcttcatctgagtgctacttcggtcttaacctcagaccaatgtgcgatccatctgaggtgtcatacaccatcatgccaaacatgggctacttcgagcttatgccacatgatccagatgctccaccacttccaagagatgctcctccaccaagactcgttgatctcgctgatgctgaagttgggagagagtacgagcttgttatcactacttacgctggactttgccgttaccgtgttggtgatatccttcaggtgaccggtttccataacgctgctccacagttcagattcgtgcgtagaaagaacgtgctcctctctatcgattctgataagaccgatgaggcagagcttcaagctgctgttgagagagcttctgctctcctttctccatacggtgcttctatcgtggagtacacctctcaagctgatgctactactatccctggtcactacgtggtttactgggagcttatggtgcgtgaaggtggagcttggccaccacctgctgaggaggagggtagaggggttttcgagagatgctgccttgagatggaggaggctctcaacgctgtttaccgtcaaggtagaaacggggaggctattggtccactcgagatcagagttgtgagagctggtactttcgaggaggtgatggactacgctatctctaggggagctagcatcaaccagtacaaggctccaagatgcgtttctttcgggccaatcatcgagcttctcaactctagggtgatctctaagcacttctctccagcttgcccaaagtactctccacacaagaagtgatga

SEQ ID NO: 2429 - DNA, 1253 bp, Zea mays
caacaatggcgaggatgatcagccggccggccgtcctcctctcccccctggccatgatcgtcgtggccgccgccgtcatggcgctggcaccggcgccggtggtcgcgaccaagtacaacatcaccaagattctggcgccctacaaggagtactccaagttcaacgacatgctgtccaagacgcgcctcgcgtacgacatcaaccggcgccagaccatcaccgtgctggccgtcgacaactccgccatgtcggcgctcgaccactactcgctgcagaccatccgccacatcctcgagctgcacgttctcgtcgactactacggcgacaagaagctcaagaagctcgcccatggctccaccgcttcctcctccatgttccaggctaccgggtcggcgtctggcatgtcggggtacgtgaacatcacccggaaggacggcaaggttagcttcatgacggaggacgccgacgacaccgcgaagccgtcccggtacgtcaagtccgtcaaggagttcccctacgacatcgccgtgctccaggtgagctccatcatctcgtccgccgaggccgaggcgccggtgccgcccccggcgcccgtggacctcgtggagctcctatccaagaggtactgcaagtccttcgcgtccctgctctccgccaacgccgaggtgttccgcgccgtgaacgagaccaaggacaacgggctgacgctcttctgccccgtcgactcggccgtcgcggccttcgcggccacgtacaagaacctcacggccaaggccaaggcggccatcctcctctaccacgccgtgccggactacttctcgctgcagctgctcaagtccaacaacggcatggtcaccacgctggccaccgccagcgacaagaagatggactacagctacgacgtcaagaacaaaggcgagacggtcacgctgcagaccagggtcgtcacgtccagcgtcaccgccaccgttggcgacatggagccgttggccgtgtatgccgtgaacaagttcctgcagcccaaggagctcttcaaggtcgtcgaggcgcccgcgcccgcgccggagccgtccaagaagaagaaggctggtcgcggcgggagtgacgacgattcctcggacgattcgggagattcgaccgccgatgctgagaagggcgacgcagcaccggctctgctcgtgcgatggctagtcaccgcggtcgcgacagcgggagttgcatatgccctgatgggataaacttctatctaaccc

SEQ ID NO: 2430 - DNA, 1313 bp, Oryza sativa
ggatccccgccatgacaggtgctgtttctaagttggctgctccaagaccagctgctgctgctccacttccacctgcttcagtgagatctgctttcctcgcttctgctccatctccaaggcgtttctctgtgtctatcgctgctggaagagctagaagcccaatcattgctatggcttcagctaaagagggaaacggggctccaacaaagagaacaacgctccacgatctctacgatctccaaggacaatctccatggtacgataacttgtgccgtccagtgacagatctcctcccacttatcggatctggtgttaggggagtgacatctaacccatccatcttccagaaggctatctctaccagcaacgcctacgacgatcaattcaagcagctcatcctcgctggaaaggatgctgagtctgcttactgggagttggtgatcaaggatattcaggacgcttgcaagctcttcgagccaatctacgatcaaacagatggcgctgatggatacgtgtctgttgaggtgtcaccaaggctcgctaacgatacacaaggtactgtggaggctgctaagtggcttcataaggtggtggataggccaaacgtgtacatcaagatcccagcaacagctgagtgcgtgccatctatcaaagaggtgatcgctaacggaatctctgtgaacgtgaccctcatcttctctatcgctagatacgaggcagttatcgacgcctacatcgatggattggaggcttctggactctctgatctctctagggtgacatctgtggcttcattcttcgtgtcaagggtggacacactcatcgataagatgttggagaagatcggtactccagaggctttggctcttagaggaaaggcagcagttgctcaggctaagttggctaaccagttgtaccaaaagaagttctcaggaccaagatgggaggctctcgttaagaagggggctaagaagcagagactcctctgggcttctacatctgtgaagaacccagcttacccagatacactctacgttgacccactcatcggaccagatactgtgtctaccatgccagatcaggctcttctcgctttcatcgatcatggaaccgtgtctaggacaatcgatgctaacgtgtctgatgctgagggggtttactctgctcttgagaagctcggaatcgattgggatgaagtggggaagcaacttgagttggagggcgtggatagtttcaagaaggctttcgattctctcctcggatctcttgaagagaagggaaacagcttgaagaaaaccgtttccctctgatga

SEQ ID NO: 2431 - DNA, 974 bp, Oryza sativa
ggatccaagcaatggcctactcccgccagatctttgtgtgctccgccatggccgcgctcctcttctccgccgtggtgtccgcccagctctccaccgacttctacgacgagacatgcccggacgccctcgacatcatcgagtccgctgtgagggacgccgtgtccaaggaatcccgcatgggcgcctcactcctccgcctccacttccacgactgcttcgtgaacggctgcgacggctccgtgctcctcgacgacaccgccgccatcaccggcgagaagaacgccaagccgaacaagaactccctccgcggcttcgaggtggtggacgacatcaagtcccaacttgaggatgcctgcgagcaggtggtgtcctgcgccgacatcctcgccgtggctgccagggactctgtggtggccctcggcggaccgacctgggacgtggagctgggccgcagagatggcaccacagcctccctcgacgccgccaacaacgacctcccgccaccgacctccgacctcgccgacctcatcaagtccttcagcgataagggcctcacagcttccgatatgatcgccctctcaggcgcccacaccatcggccaggcccgctgcaccaacttccgcggcaggctctataacgaaacaaacctcgacgctaccctcgccacctccctcaagccgtcctgcccgaacccgacaggcggcgacgataatactgctccactcgacccggccacgtcctacgtgttcgacaacttctactaccgcaacctccttagaaataagggacttctgcattctgatcagcagctgttctctggcggctctgctgacgcccagaccaccgcctacgctaccgatatggccggcttcttcgacgacttcaggggcgccatggtgaagatgggcggcatcggcgtggtgaccggatctggaggccaagtgagggtgaactgccgcaaggtgaactgatga

SEQ ID NO: 2432 - DNA, 1726 bp, Oryza sativa
cgcacgcttctccatttcatataagattcccgagagacgccgccgcccgagaggcgtgggccgcgcgcgccgaaacatatcccgccggggcgccgccatggccggcgaggtggccatcgactccggcgagaagcgcctcaacgagctcgggtacaagcaggagctccgcagggagatgactctgttcaagacgctggccatctccttctcgacgatgacgctgttcaccgggatcacgccgctgtacgggagcagcctgcggtacacggggccggccagcctcgtctggggctgggtcgtcgtctccttcttcacctggttcgtcggcttcgccatggccgagatctgctcttccttccccaccactggttctctgtacttttgggctgctcatctggctggcccagtctggggcccgttggcatcttggtgctgtgcttggttagaggccataggtcttattgccggaattggtacacaggcattcgcgggatctcaagttctgcagagcataatcctgctatgcaccggcacgaacaaaggcggcggctacctgacccctcgctggctgttcctcctcatgtacatcggcctaaccttcatctgggccgtgctcaacaccttcgcgctggaagtcatcgccttcctcgacctgatctcgatgtggtggcaggtgatcggtggcacggtgatagtgatcgtgctgccgctggtggcgaagacgacgcagccggcgtcgtacgtgttcacgcacttcgagacggcgccggaggcgaccgggatacggagcagcgcctacgccaccatcctgtccctcctggtgagccagtactccctgtacggctacgacgcggcggcgcacctcaccgaggagaccaagggcgccgacaagaacgggcccatcgccatcctctccagcatcggcatcatcaccgtcttcggctgggcctacatcctcgccctcaccttcagcatccaggacttcagctacctgttcgacccgagcaacgagacggccggcacgttcgtgccggcgcagatcctgttcgacgcgttccacggccggtacggctcctccgcgggcgccatcgccctcctcttcgtcatctggggctccttcttcttcggcggcctctccatcaccaccagcgccgcgcgcgtcgtgtacgcgctgtcccgcgaccgcggcgtcccgctctcctccgtgtggcgccgcgtccacccgcgccaccgcgtccccgccaacgccgtctggctctgcgccgccgcgtgcgcgctgctgggcctccccatcctgtggatcaacgtcgtcttcacggccatcacgtcgatcgcaaccatcggctgggtcggcggctacgccgtgcccatcttcgcccgcatggtgatgcgggaggaggacttctcgccggggcccttctacctccggcgcgcgtcgcggccggtgtgcctcgtcgcgttcctgtggatctgctacacctgcaccgtgttcctcctcccgacggcgtacccgatcagcgccggcaacttcaactacgcccccgtcgcgctcggcgcctgcctcggcctcatcgggctctggtgggtgctcgacgccaggaggtggttcaagggacccgtcaggaacatcgacgatcctctgaaagatggtggtggtgatggcgtccataacaatggcaacaaggtctaagtatggtttaggttgttactggagtacttagtttga

SEQ ID NO: 2433 - DNA, 374 bp, Populus trichocarpa
ggatccgaaaaatggctaccccaatgaagtacatctgcctcttcatgttcctcgctatcctctcaatcgctggtcttaaccaggttgacggtgctggggagtgtggaaagaacactaccccagacatggaggctttcaagatggctccttgcgcttctgctgctcaggatgagaactcttctgtgtcatctcagtgctgcgctagagtgaagaagatcggacagaacccagcttgtctctgcgctgtgatgctctctaacaccgctaagtcatctggtatcaagccagagatcgctatgactatcccaaagaggtgcaacatcgctgatagaccagtgggttacaagtgcggtgcttacactctcccatgatga

SEQ ID NO: 2434 - DNA, 774 bp, Glycine max
ggagccatggccaaaatcgcacttggaagcacccgagaggccactcagccagactgcattcaggccctcatcgttgaattcatagccaccttcctctttgtctttgttggcgttggttcttccatggtcgttgacaagcttggtggggatgcactagtgggattgtttgctgtggccgtggcacatgcacttgtggtggctgtaatgatctccgccgcccacatttccggtggccacctcaaccccgccgtcacccttggcctcctcgccggtggtcacatcaccatctttcgttccatgctctattggattgatcaattagtagcagccgcaacagcttcttatctcctttactacctctcaggaggacaggcaactccagttcatacgctggccagtggagtggggtatggtcaaggagtagtttgggagattgtgttgacgttttctttgttgttcactgtgtatgcgaccatggtggatcccaagaagggagcacttgctgggcttgggccaacgctggttgggtttgtggttggggccaacatcctcgcaggtggggcttactctgctgcttctatgaacccagcaaggtcttttgggcctgccttggtcgctggaaactggaccgatcattgggtttactgggttgggcctctcattggtggtggccttgctggttacatctatgagactttcttcattgaccgatctcatgttccacttcctcgtgatgaagaaaactaaacaataggattgacaacttgcacttaa

SEQ ID NO: 2435 - DNA, 1128 bp, Oryza sativa
agattcgatccaaccaaacccacccgctaccagcgtcttctccttcgcgagcaagttttttgagagtttgcaatgggaggaagcgaatacgatgatgactgggagttgcctagcgctgacatcactgtagttctttgcggcaaacttggctgtggcaagagcgcaactggcaatagcatcgttggaagagaagcatttgtatcagagtactcccatgctagtgtgaccagtacttgtcaattggccagcaccgcgctaaaggatggccgtaccctcaatgttattgatacgccaggattatttgaaatgaccattacatctgaggatgccggtaaagaaattgttaagtgtatgagtatggccaaggatgggatacatgcagtgctgatggttttttctgccacatctcgttttactcgagaagattccagtaccattgagacaattaaagagtttttcggagagaagattgttgatcacatgatactagtatttacttatggagatttagttggtgaaaataaattgaagagcatgctgaataatgccccagagtatctgcagaaaactgttgagctatgcaaaaacagagttgttctctttgataatatgaccaaggaccgatggctccaagagaagcaacttgaaaatttgcttgatgttgttgactctgtgaatacaaataatggaggaaagccattttcagatcaaatgctcgcttgcattaaggaagcacatgccagagaacaggaggtgcatgatgctattggatatacagaagagcaaatatctgaattgaaaaaggagatccagagaactcgggatgaacagcttgcaaacattaccaacatggtggaggaaaagctgaatatcactgttgacaagctgcaacagcaactcatggaagaacagaatgcaaggctagaagcagagaggttggcagctgaagctaggctccgatcagatgaggagatccgcaagctcaaaaagcgcctcgagaaggcccaacaagaaaatgaggaattccgaaagatggcttctcaacacaagtgttctattctatgagtagctttctcctaggatcaagctgctgccatggttgaatgctccgtgcattgttaatagagt

SEQ ID NO: 2436 - DNA, 578 bp, Populus trichocarpa
ggatccaaaacatgaagagcagctacaccttcttcatcctcttcagcctcttctctttcgctaacgtgatcggtgctaggaaggatactggggagtactggcgtgctgttatgaaggatcagccaatgccagaggctatccatggtctcatcagagagactaccctctcatctgtgtctaacgagaaggctgattgccatacaactgagagcaacgagaagaacaacttcgtgaaggatttcggtccacagccaactgtgacctcttacgacaacggtatcaagccagctaaggacaagtctttcagcaaggacttccatccaaacactcagctcttcctctacaacgatggtgttgtgaagggggagagatctttcgctgaggatgtggagccaagaccaaacgtgtctgtgtaccacgatgatgctactcttaagggggagaagtcattcccagaggatttcgagccaggtcctaacgtttcagtgtacgatgatggtgttggtctcaagggcaagaagtctttctctgacgagttcgaacctagaccttctgtgactgcttactccaactgatga

SEQ ID NO: 2437 - DNA, 470 bp, Populus trichocarpa
ggatccaaacaatggctctccatggaaagatcgagactacccttgagcttaagtctagcgctgagaagttctacaaggtttggaggtctcagtctttccatgtgccaaagcacgcttctaagcacatccagggcgtggatattcatgctggggattgggagactgtgggttctatcagaatctggcagtacactatcggtggaaaggctggtgttttcaaggaagaagtctcattcgacgacgagaacaagatcatcaccctcaacggtcttgagggggatgtgatgaagatctacaaggtgtaccgtccaatctggcagcttactccaaagggttctggttgcctcgctaagttgactatcgagtacgagaagctcagaccagaggttccagttccagagatctacgtggatttcatggtgcacatgaccaaggatatcgacgagtctctctctactgaggaatgatga

SEQ ID NO: 2438 - DNA, 748 bp, Solanum lycopersicum
gaagaaaacccacaaaaccagatcggcgatccaccgaaaagcaagaaatcggttgtaaatgggtcaacagaaggctttgatctatgcgtttgtcggtcgtgggaatgttatattggctgaatacacagatttcagtggtaacttcaactccatagcttatcagtgtcttcagaagctacctgcttccaataacaagttcacctataattgtgatggtcataccttcaactaccttgttgataatggattcacgtactgcgtggttgctgaggagtctgttggaagacaaattccaatagcgtttttggagcgcattaaggatgatttcatgtcaaaatatgggagtgggaaggctgcgacagctcctcctaatagcctgaacaaggaatttggccctaagttgaaggagcatatgcagtattgtgctgaacaccctgaggaaattagcaaacttgccaaggtgaaagcacaggtttcagaagttaagggtgttatgatggaaaacattgagaaggttcttgatcgtggagagaagatagagcttcttgttgataagacagagaaccttcatcaccaggcacaggacttcaggaacacgggaacccaaatacggaggaagatgtggctgcaaaacatgaaaatcaagctgatagtgttaggtatcctgatagctttgatcctcatcattgttctctcagtttgcaagggattcaattgtggaaagtgagggaggatgtttctattgtga

SEQ ID NO: 2439 - DNA, 1076 bp, Solanum lycopersicum
tgaagatggaagcaaactctaactctgctgtgcccctctgtactccttacaaactggggagattcaaactcactcatagaatagtttttccagcacttacgaggaacagatcacaaaataatactccacagccacatgtaactgaatactattctcaaagagctactaatggagggcttatcatttctgaagcagctgctgcatctgatatttctaaggagtgccctaacttgcctggaatatggaatgaggagcaagtggaagcatggaaaccagtagtgaatggtgttcatgagaaaggaggcgtcttcttttgtcaaatttggcattcaggccgcttatctgtcccgactgttagtgcattatttttctcgatcggcattggctggtccacaagacctgatgataaagtgtatgcgaaaccaacacctcttcctctggagtctgataaaattccttgcattgtaaatgatttcaggattgcagcccgtaacgcgattaaagctggatttgatggaattgagatcaacgcttcaagtggcggctacctgattgatgaattcatgaatgatcaagtccatggttggactgatgaatatgatgaaagtattaaggaccgttgtcgtcttgccctggaaattgtagaagcagtggcaaatgaaattggagctgataaaattggtataaaattatctccttttgatggcaaaaaggactcaaattcagaagcactagcaacttacatggcaaatgaactaagcaagcttggcgttctctatcttcatgtgatggagcccagagaaacagttaatagaagtcttcttcccattaggaaggcttttaaggggacacttattgcttctggtggttatggtaaatctgatggagacaaagccatcgacgagaattatgcagatttgatctcatttggacgtatgttcttggctaatccagatttaccaaagcgttttgagattaatgctccacttaacaagtataataggagcactttctacaccaatgatccaattattggctacactgattatccatttcttgaagttgcttcctaataa

SEQ ID NO: 2440 - DNA, 832 bp, Glycine max
tagactgatgggaagtgttccattggcctccgctgctgctcttgccagaaggctagaagggaaggtggcactgataactggtggagcaagtggtataggtgagtgcacagcaagacttttctccaagcatggagccaaagtggtgattgctgatatccaagacgagttaggccactcaatttgcaaagacttggattcatcttcagctacttacattcattgtgatgtcacgaaagaagaaaacatcgaacacgccgtgaacacgaccgtttccaagtacggtaaactagacatcatgcacagcagcgcaggtatagttggcgcatggaaccccagcatattgcacaacaagaagtctcactttgagcaagttatcagtgtcaacctggtgggcacattcctgggaatcaagcacgccgcgagggtgatgatcccttctgggcgtggcagcatagttgcaatggctagcatttgtggaagaattggtggcgtggcttcgcatgcctatacgagctcgaagcacggcatcgtgggactggtgcgaaacactgccgtggagcttggaaccttagggatcagagtgaatagtgtgtctccttatgcggtccctacgcccatgagtaaaactttcctcaacactgatgatgaggggattgctgcactgtattccaatcttaaagggactgttcttaagccccaggatgtggctgaagctgttctttacttgggaagtgacgagtccaagtatgttagtggccatgaccttgttgtagatgggggtttcactgtcgtaaaccctggtttgtgtgtgtttgggcaatccgtgtagtag

SEQ ID NO: 2441 - DNA, 530 bp, Oryza sativa
ggatcccgacgatgctcagggctggcggcaggaggctcctcgctccaggcctcaggagggtgctcggcggaggcgctgctgctccagtggctgtgggcggagctagggcctatcacgagagggtggtggaccactatgagaacccaaggaatgtgggctccttcgagaacgacgacccatctgtgggcaccggccttgtgggcgccccagcctgcggcgacgtgatgaagctccaaatcagggtggacgagtcctccggcaagatcgtggacgcctgcttcaagaccttcggctgcggctccgccattgcctcctccagcgtggccaccgagtgggtgaagggcaagcaaatggaggaggtggtgaccatcaagaacaccgagatcgccaagcacctctccctgccacctgtgaagctccactgctccatgctcgccgaggacgccatcaaggctgctgtgaaggactatgaggccaagaaggccaagctcgcccaaaagggcgaggagaaggccgccgaggcctgatga

SEQ ID NO: 2442 - DNA, 1748 bp, Vitis vinifera
ggatcccttccatggataactctgtagctccaatggtgattactgatgatggtcttcaagagaccgccatctcctccaagacaaatccctccaaaggtcgatggagagctgccattttcatcatctttgttgaaatggcagagaggtttgcttactacggggtggccggaaacctcttcacctacctcaccaatgtcctcggtgagcacaccgccaccgccgccaaaaatgtaaacacctgggtcggcgtctccgccatcttcccgttgctcggaggctttatcgctgattcctaccttggtcgcttcaagaccattatagcatcctctgttatttacctcgccggactactcttgatgactttgtcggtatcagtgcaatcactccgacatcaccgcgcagtgtttttcacggcgctgtacatactatccataggagaaggagggcacaaaccatgcgtgcagacctttgcagccgaccaattcgatgaagacaccgtggaggagaagaaggacaagagctccttcttcaattggtggtacgtggggatagtggtcggctccaccaccgccatcctcgtggtgatttatgtgcaggacaatgtggggtgggggctcggctttggaatgctggcggcggccgtagcagcagctctgctattattcctaattggaattagaagttaccggcgccagcgcccagtgggcagccctctgactagggtgatgcaagtgttggtggccaccgccaggaagctgcgcgtgaacgagacgcgctatggccgaggtgtttgtttggaggatgagggcgatgatggggtggaggagggtggcaggcgaggcaggagtttggctcctacaaatcaattcagatttttggataaggcaaccatcattgacgatattgatgcctcaaccaaggtgagaaaccactggaggctatgcccagcgacccaagtggaggaagtgaaacttctcttcagcctgtttcctatttggttgagttgcttgacatttgccactgtgatagcacaaatgagcacctacttcaccaagcaaggcagcactctggagagatcaattggctcccacttctccatacccccagcttcacttcaagtctgcactggcctcactatccttgtttccgtcggactatatgatcgggtccttgtcccggttgctagaaaattcactggactcccctctggtataacaatgctccagaggataggcactggaatattcttttccatgcttaccatggttgtagcagctcttgtagagaccaaaaggatcagcgttgccatagaccatggcctcacggattctcccagaacaactctccccatgaaaatatggtggttgctcccacaatacatgctgacgggaatgtgtgatgtgttcaccattgttgggatgcaggagcttttctacgaccaaatgcctgaagagatgagaagcattggagctgccttgtacatcagcacagtgggcgtggggagcctcatgagcagtgcagctatatcaattgtgcaggctataacatcaagagctggaggaaaatggctgggagataatctgaatcgtgcccacctcaattacttctactcggtgttggcaggatgtagtgctttgaatttgattgtttacatctgggttgctaagcgctttgtgtacaaaaaaactggatatgatgatccgaaaggagaacagaaaaaagcagcagagcttgcatagtgatctaga

SEQ ID NO: 2443 - DNA, 1042 bp, Zea mays
aggcgagatgtgggagtcggtggcgctgacgctggcgggcaccgccggcaataacatcggcaaggtcctgcagaagaagggcaccctcatcctccctccactctccctcaagctcaaggtggtcaaggcgtacgcgtcgaaccagctctggatcagcggtttccttatggacatgtgcggtgccgcgctcatgctcaccgcgctctctcaggcgccggtctccgtcgttcagcccattgctggttgcggtctcgcaatactctgcgttttctcccatttttacctcaaggaggttatgaacggcctcgattggattgccatcacgctagctggtctcggcaccataggtgtaggtgttggaggtgaggaacagaaagttgaccagatacctcttttaaatataccctggctagtgctctccattgtcatcttgtttgtactgctcaacacttggcttcatatgtataaaaagcaaaggcgtgagcaagagttgactggacctgaagtgattgaggagatcatatatggcttagaatcaggcattttgtttgggatttcttcagtgatctctaagatgggatttgtgatgtccgagatgggttttccaaagattgttgtgcctgctgccatatcttgtagtgtttgctgcagtgcagtgggatttgtgtatcagactcgaggcctcaagcatgggagggcaattgttgtatctacatgtacatcagtggcatctatagtgtccggtgttgttgctggcatgattgcacttgatgaacatctgcctaaagctcccacagctcggtttttcctcttactgggatggttcttcatcatcacaggagtaatactgcttgttagttcaacccgattgattgcgcgtctacctaggtctgttcagaagtatttgaagagcaacatagagcgcacccacagcatcaggaggcctggttcagcacgagggaaggatcccatcccaacaacaacgatccatacgtcgtcactacacttgcttgcttctccaacaaaggagaaggcctagtag

SEQ ID NO: 2444 - DNA, 1511 bp, Oryza sativa
ggatcccgcggatgccagctgatgctgctgctaagggaatgaagctcgagagatacgcttctggtgctggtgctatgctcctccttagaagggctgcttctggaaaggttgtgtctgcttcttctcatctcctcttcagggctactgttctcgctacaatggctctcgtgttcctcttcaccttccattacccatctctcctctcaagatctttcacactctcttcaggtgctggggctggggagggtggagctgctgctcatgcttctcatcgttctctcctcatgtctagctcttcagcttctgcttctgctgcttcagtttacggtggtgctgcttgggagaaagaagttaggcgttctgcaaagcctagaaaggatggtggaatcgctgttctcgttactggtgctgctggattcgttggtacacattgctcactcgctctcagagctagaggtgatggtgttctcggactcgataacttcaacgcttactacgatccagagcttaagagggctagacagagacttcttgctggaaggggagttcttgttctcgacgctgatatcaacgatgctctcctccttgagaagctcttcgatctcgtgccattcacacatgttctccatctcgctgctcaagctggtgttagatacgctatggaggctccacaaacatacgtggcttctaacgtggctggactcgttactgttcttgaggtggcagcaaagcacgctgatccacagccagctattgtgtgggcttcttcttcttctgtgtacgggctcaacacagatgctccattctctgaggaacataggacagatagaccagcttctctctacgctgctacaaagaaggctggggaggctattgctcatacctacaaccatatctacgggctctcaatcacaggactcagattcttcacagtgtacggaccatggggtagaccagatatggcctacttcttcttcgctaagtctatcgtttctggggagccaatcacacttttcagggctgctgatggtgctgatgctagaagggactttacctacatcgatgatgtggttaagggatgccttggtgctcttgatacctctggaaagtctaccgggtcatctaagtctggaaagaagtctggaccagctccactcagagtttacaacctcggaaacacatctccagtgccagtgacaaggatggttgctatcctcgagaagctcctcggaaagaaggctaacaagaggatcgtggctatgccatctaacggtgatgtgcctttcactcatgctaacgtgacacatgctgctcatgatttcggataccgtccaacaacatctctcgatgctggactcaggcatttcgtggattggttcgccgattactacaagctcaagctcgatgtgccaaagatcgctgctaaggtggcaggtgctggaaagccatcatcaagcagcgcaagcaagaagaagaaaaaggctgctgctatgtctgcttcatcttgatga

SEQ ID NO: 2445 - DNA, 1628 bp, Oryza sativa
ggatcccagccatggagtctggtggacttattgctccaagcgagacatgctcttcagatggaagaggtggaggtggtggagggtggagagctgctagattccttatcgctgtgggattcctcgagaggatcggattcaacggtgttcagggaaacctcgtgatgtacctcacaggaccaatgggaatgtctactgctgctgccgccgctggtgctaatgcttggggaggaacagttctcgttctcacactcgttggtgctcttgctgctgattctaggctcggaagataccgtgctatcgtggctgctggtgttctccatctcctctcactcggaatgctcacaatctctagcgtgatgcaacctaaccatccacatccagcttcatgccatgatgctgccgctgcttgttcaccatcaccaccgcctcctccatctctcgctaggctcgtgttcttccatgctgcactctaccttctcgctctcgctcaaggattccataacccatgctctgaggctttcggagctgatcaattcgctgcttctgatccaggtgctagggcttctaggtctagctacttcaactggtatcagttcttcaactctttcggctacggaatctctaacaccgctctctcatacgtggaggattctgtgtcttgcacagtgggattcgctgtttgccttgctacaacagctgtgtacctcccaatcttcctccttggaacaagagcttaccgagcagagcaaccagttgatggtgctctcctcgctagactcgctaagacatcttcttcagctgctagagcttggacagctagggtgttcagaagaaaggatacctcttgcacagagagacttctcgctagagaagaagttggggagaagggattcctcgctaagttgctcccaatctgggtgacatctatcgtgttcgctatcgtgtctgctcaagaggtgacactcttcatcaagcaggggtctacaatggatagaaggatcggagctagaggtggacttgttgttccacctgctgctctccagtctatcgtgtcagtgatcttcctcacattcgtgccagtgtacgatagagctttggtgccactcgctagaagattcacaggacatccagctggaatcacaacactccagcgagtgggagttggaatggctatgtcttgcctcgctatggctgttgctgctctcgttgaggctaagagactcagggctgcttcagatgctggactcatcgataggccagatgctactgtgccaatgggagtttggtggctcgttccacagtacgctctcgttggtctttctaaggtgttcggaatcatcggactcgatgagttcttctacgatcaggtgccagatgatctcagatctgtgggactcgctatgtctctctctgtgaggggagttggatcttacgcttctggtgttctcgtgtctgctatcgattgcgctacaagatctggtggagagagctggttctctgataacctcaacagggctcacctcgattacttctactggatcttggctgcacttgctgctcttgaggtggcagtgttcgtgtacattgccaagcgttacgtgtacaagaataagggggagccatgatga

SEQ ID NO: 2446 - DNA, 1640 bp, Sorghum bicolor
ggatcccggcaatggacgccaacaccctcctgctcccgtgctctgacggagccgtggccggagccgtggatttcaggggcaggccagccagccgctctggcacaggcaggtggagcgccgccatgttcgtgctcggcgtggagatcgccgagcgcttcgcctaccacggcgtgtccgccaacctcatcagctacctcaccggcccactcggcgagagcacagctggagccgctgccgccatcaacgcgtggagcggcgtggccaccatgctcccgctcctcatggcctgcgtggccgacgcctggctcggccgctaccgcaccatcgtgctcgccagcctgctgttcgtggtgtccatgggcatgctcaccgtgtctgccctcccggccttccaccacgacggctgctccagctacgccagcagcagcctcgcctgctccccaagcccagcccaagtgggcgtgttctacgtgtccctctacctcgtggccctcgccgaggccggccacaagccatgcgcccaggccttcggcgccgaccagttcgaccagaacgacccgaaggaatctgtcagccgcagcagcttcttcaactggtggtacttcggcatgtgctccggcaccgccgtgaccaccatggtgtccagctacatccaggacaatgtgggctggggcctcggcttcggcatcccgtgcctcgtgatggtgttcgccctcctcatgttcctgctgggcacccgcaactaccgctactacaccagcaccgagagcagcccattcgccaggctcgccagggccttcatcgccctcatcaagggcagcaagagcagccagagcgacggcaccctcgctagcgacgacgacgctggacaccgcgaggaagtgaagggcgtcctccgcctcttcccgatctgggccacctgcatcatctacgccgtgatcttcagccagagcagcaccttcttcaccaagcaggccgccaccctcgaccgcaggatcggcccgaccctcagggtgccgccagccgccctccagaccttcatcagcgtgacgatcatggtgttcatcccggtgtacgaccgcgccttcgtgccgctcgccagaaggctcaccaggctctccagcggcatcaccatgctccagaggatcggcaccggactcgtgctcgccctggtggccatggtggtggctgccctcgtggagatgcgcaggctcggcgtggccagggacgctggcctcgtggaccagccgaaggccgccctcccgatgagcctctggtggatggtgccgcagtacgtgctgttcggactcagcgacgtgttcgccatgatcggcctccaggaatttttctacgaccaggtgccggacgctctccgcagcctcggcctcgccctcttcctgtccatcttcggagtgggccacctcttcagcagcttcatcatcagcgccatcgacggcgccaccaagaagtccggcgccagctggttcagcaacaacctcaaccgcgcccacctcgactacttctactggctcctcgccggcctctgcgccgtggagctggctgctttcgtgatcgtgtcccgcgtgtacgtgtacaagaagcgcgtttcccacgacaacaacgacgccgtgatgtgatga

SEQ ID NO: 2447 - DNA, 1928 bp, Arabidopsis thaliana
gaaattgtgtttgtttgatggggtttttggtggatacgcaaaaggaaggaggtggacattcatggggttacgttagaagtttggttagaaggaaacaagtcgactctgctaatggccaatctcatggtcaccaacttgctagagccctcactgttcctcatctcgttgcaattggtgttggagcaacaataggagctggagtttatattcttgtaggaacagttgcgagagagcattcaggaccttctcttgctttgtcttttcttattgctggaattgctgctggtctttctgcgttttgttatgctgaactctctagtcgttgcccttcagctgggagtgcgtatcactattcttacatttgtgttggtgaaggtgttgcgtggataatcggttgggcgttgattctggagtataccattggtggctcagctgttgcccgtggcatatcccctaatctggcactgatttttggtggtgaagatggtttgcctgcaattttagcgcgccaccagatcccaggccttgatattgttgttgatccatgtgctgctattcttgtgtttgttgtaactggccttttgtgcatgggaataaaggagagcacatttgctcagggaattgtaactgcagtcaatgtgtgtgtcctgttatttgtcatagtagctggcagttatctcggcttcaagacaggttggcctggttatgaacttccaacagggttctttccattcggagtagatggaatgtttgctggttctgctacagtcttttttgcattcattgggtttgattcggttgcaagtaccgcagaggaggtgagaaatccccaacgggatttaccgattggtattggtcttgctctcttgttatgttgttctctctacatgatggtctccatagttattgttggtttaattccttactatgcaatggatcccgacaccccgatatcctctgcattcgctagtcatgacatgcaatgggctgtatacttaataactttaggagctgtcatggcactctgctcagctttaatgggtgcccttctccctcagccacgaattctgatggcaatggctagggatggtctgctcccttctattttttcagacattaataaacgcacacaggttccggttaaagcaacagtggcaactgggttgtgtgctgcaaccttagcgttctttatggatgtttcacagcttgcagggatggtgagtgttgggacacttctggcatttacaatggtggcaatatcagtgttgatactaagatatgttcctccagatgagcaacctcttccgtcatctcttcaagagagaattgattctgtttcctttatatgtggtgaaacaacgtcatccggtcatgttggtacttccgatagcagtcaccagcctttaatagttaataatgatgctttggtcgatgtcccacttatcaagaatcaagaagctctagggtgtttggttctcagcgaggaaaccagaaggattgtcgctggatggagcattatgttcacatgtgttggggccttccttttaagttatgcggcatcaagcctgagcttcccagggcttattagatatccgttgtgtggtgttggtggatgtctcctccttgctggtttgattgctctgagttccatagatcaggatgatgcgagacacacttttggacattctggaggttacatgtgcccgtttgttcccctcctacctatcatctgcattctcatcaacatgtaccttttggttaaccttggatctgcgacatgggctcgtgtatcggtgtggctgcttataggagtgattgtgtatgttttctatggtcggaaaaacagttcgcttgccaatgcagtttacgtaactacagctcatgcggaggagatatatcgcgaacatgaaggttctttggcatagtag

SEQ ID NO: 2448 - DNA, 757 bp, Oryza sativa
aacaatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgacgacgacgacgacggccaagttgatgccccacttcggcagcgacgacgtcgacgcggggctcttcctccggccgtcgtcgcagcatcatccgccgccgccgcacgccggtgccggcttcacgtcctccgagccggccgccgaccaccagtccttcaacttccactcgagctggccgtcgtccacggagcagacctgcagcagcacgccatggtgggaattcgagagcgagtgatga

SEQ ID NO: 2449 - DNA, 1030 bp, Zea mays
ctggaaggacagcatgtcggcctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctccgccatttccagtgccaacctccaatagcgcttatgttgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacctacttcaagatttctgatatcagtgaggtgcgagtagaaggattggaaactctggattacctagacaacttacaagatagagctcgttccactgaacaaggcgatgcaattgtttttgaatctgaactggacagaatatatctgggcacaccatcgaaaattgccattattgatcatgagaagaaaagaacatttgttgtgaggaaaggaggccttcctgatgctgttgtttggaacccctgggataaaaaagcaaaggctatgtcagattttggggatgatgaatataaacgaatggtatgcgtggaggcggctgctattgaaaagactgtcactctgaagcctggtgaagagtggactggaaagttggaactttctgctgtgccatctagctattacagtggtcagctagaccctgaccgtgtgattcaggattccactgtcccggaggactccatcagctagtcatag

SEQ ID NO: 2450 - DNA, 1781 bp, Oryza sativa
caagaattaaggtgtagcaacctgcaaaaatgcgcgccaaagtggagctagccgtcctcctcttggtcctcgtcggcgtcgccgccgggacccggccgccgtcggcgccgccgccggtgacggaggacacacttcagaaggtggccggctcgctggaaatgtacgtcgacgagctccctcagatgcccaagatctacggcttctccatgagacacggtcacccctctcccattcgtctcaccatcggcatgtaccagaagaaatggaaattccaccgcgacctgccggcgagcaccgtgttcgtgttcgggacgtcggcggcgacggccacgttcccggggcccaccatcgaggcagcgcagggggtcccactgtcagtgacgtggcagaactacctccccgcgcgccacatcctcccgtgggaccccaccgtgcccaccgccatcccgcgccgcggcggcgtccccaccgtcgtccacctccacggcggcgcccacccgccgcagtccgatggcagcgacttcgcctggttcaccgccggcttcggcgagaccggcccggcgtggtcgacgccgacgtacacctaccccaacgcgcagtcccccggcgtgctctggtaccacgaccacgccctcggcctcacccgcgccaacctcctcgccggactcctcggcgcctacgtcatccgcaacccggcggtggaggcgccgctcggcctcccctgcggcgatgagttcgaccgcgtcctcatgctcgccgaccggagcttctacgccgacggctccatctatatgaactacaccggcatcatccccaacatccacccgcagtggcagccggagtacttcggcgaggccatcaccgtcaacggcaaggcatggccgttcctcgccgtcgcccgccgccgctaccgcttccgcatcatcaacaccagcaacgcgcgctacttcaacctctccctcaccaacggcctccccttcaccgtcgtcggctccgacaccaactacctctccaagccggtcaccgcggcgagcctcctcgtctccgtcgccgagacgttcgacgtcgtcgtcgacttctcccagtccaccagctccgaggcggagctggtcaacacggcgccgtacccgtaccccgacggccaagcgcccaacgacctcaacggcaaggtgatgaagttcgtgatctcgccggcgaaggcgaaggacacctccagggtgccggcgaagctgctcgactacgtcgctgtcgccgaggaagaggcagtgcagaggcggtacatcgtgatgtacgagtacgaggacgccgccaccggcaacccgacacacctgtacatcaacgggaagaggctggaggacccggcgacggagacgccgcggccggggacgacggaggtgtgggaggtgatcaacctgacgccggacaaccacccgctccacctccacctcgcgacgttccaggcgacgcgcgtccgcgggctcgtcgacgaggacgcgttcaagggctgcatggcgaagctcaacgacgcggtgaggtgcaacgtgagccggcacgccgtcggcgaggaggtggcggtgccggagcacgagaaggggtggaagaacgtggtcaagatcgcgccggggtacatgacgacgatcgtcgtcaagttcttcatggtcgacagcggcaagccgtacccgttcgacgccacggccgagcccggctacgtctatcactgccacattctggatcatgaggacaacgccatgattcgcccgctaaagctgatcaaatgatga

SEQ ID NO: 2451 - DNA, 710 bp, Triticum aestivum
ggatcccagcaatggccgctcttactgcttctatcgctacctcttctgctttcgctgcaaagccaagacttgctagaccacctgctagactctcagtgtcttgctctgcttcttctggggataacaacaccccatcactctcagcttctatcaagaccttctctgctgctctcgctctctcttctgtgctcctctcttctgctgctacttctccaccacctgctgctgctgatatcgctggtcttactccatgcaaggagtctaaggctttcgctaagagagagaagcagagcgttaagaagctcaacagcagcctcaagaagtacgctccagattctgctccagctcttgctatccaggctactatcgaaaagaccaagaggcgtttcgagaactacggtaagttcggactcctttgcggttctgatggactcccacatctcatcgtgtctggtgatcagagacattggggagagttcatcactccaggggtgttgttcctctacattgctggatggatcggatgggttgggagatcttacctgatcgctgtgtctggggagaaaaagccagctatgagagagatcatcatcgacgttgagcttgctgctagaatcatcccaaggggtttcatttggccagttgctgcttaccgtgagttgatcaacggtgatctcgtggtggatgatgctgatatcgggtactgatga

SEQ ID NO: 2452 - DNA, 630 bp, Oryza sativa
gagaaatgacaagtgtctggaagaccaaggttctcactggactcaacaagctctttgacaaggatggaaagaaggctgctgctgctgagttcttgaaatcattcaacaaggaggagattggcaaggagattgatgacaagaagacagagctagagcccaaggttgtggaggttgttgagtcatctcctcctgagattaaggctttgttgaaggacaaaaaaacagccagcaaaatcaagaagaacggtcctgcagtcactaagttccttgaggaattggctaagattgatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactcc

SEQ ID NO: 2453 - DNA, 512 bp, Arabidopsis thaliana
cttcttcaatggcgacgggaaagagttactacgctaggcctagctatcgatttctcggcaccgatcagccgtcttacttcaccgcttccgattcaggtctcgaattcgacgaatccgatctcttcaatccaatccactccgattcaccagatttttgccgtaaaatctcttcatcagtcagatccggtaaaaaatcgtcgaatcgtccctccgccgcttcctccgccgcagcagcgtcgtcgcttcctgttaacgtgccggactggtccaagattctccgcggagaataccgcgataaccgacggagaagcatcgaggataacgacgacgatgacgatgataacgaagacggtggcgattggttaccgccgcatgagtttctggcgaagacgagaatggcttcgttctcggttcatgaaggagtagggaggacattgaaaggaagagatctgagtagggttcgaaatgcaatttttgaaaaatttgggttccaagattaaatatttgcatga

SEQ ID NO: 2454 - DNA, 1154 bp, Oryza sativa
tgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaagacccttgcgtctgatggtattgctggtctgtaccgtggattcaacatctcctgtgttggtatcattgtctatcgtgggctgtactttggaatgtatgattctctcaagccagtcgttcttgttggcaaccttcaggataacttccttgccagcttcttacttggttggggcattaccattggtgctggccttgcttcatacccaatcgacactgttcgtcgtcggatgatgatgacatctggtgaggctgtcaagtacaacagctccttggatgcgttcaagcagattgttgcgaaggagggtgcgaagtcactcttcaagggcgctggtgctaacattctgcgtgctgttgctggtgctggtgtgcttgctggatatgacaagctgcaggtggtcgtctttggtaagaagtacggttctggtggtggctaagactag

SEQ ID NO: 2455 - DNA, 914 bp, Gossypium hirsutum
acaaggaaatgatggctattgggctgatgaacatggttggctcctccacttcttgctacattacaactggcgccttctctcgatcagcggttaatcacaatgcaggagcgaaaagtgcagtgtctaacatagtaatgtcgattacggttatggtgacccttctctttctcatgcctttattccagtacaccccaaacgtggtgttgggagctatcattgtgtcagctgtagttggccttatagacattccagcagcctgtcaaatttggaagatcgacaaattcgatttcattgtgatgttgtgtgctttcttcggtgttattttcatctcggtccaagatggtcttgccatggcagttgggatgtctattttcaagatcctccagcaaattactaggccaaaaacagtgatgttggggaacattcccgggacagatattttccgggatcttcaccactacaaagaatcgatgaagatcccgggtttccttatcctaagcattgaagctcctatcaacttcgctaactccacatatctgaatgagaggatcttgagatggattgaagaatatgaagccgaagatcataagaagcagtcaaaccttcaatttgtggttttagtgatgtcagcggtgagtaccatagacacgagtggcgtatcaatctttaaagaactgaagaaaacagtggaaaagaaaggagctgagcttgtgttggtgaatcctttgggagaggtgatggaaaaattgcaaaaatcagatgaagcaggagatttcatgagaccagattgcttgttcttgacagtaggggaagctgttgcgacacttacagcaacaatcaaaagccaggtctccaatcatgtagtatgaacaaaaccaaaaatataactccacaaaagctatcatgttgtggtg

SEQ ID NO: 2456 - DNA, 1631 bp, Zea mays
ccaccatggctccagaaaagcctcgtaaggaacaagaagaggaacttatgcttgaggatgggggaattgaggaatctccaaggcgttctttcgaggattgcggggattctgaggaagataggggggagggtgatgatgaggaagagagggattctgatagggatggtgttggatctaccagatctttcctcccacaaaagtggccacaatcttaccgtgagaccactgatacttacaccatcgctgcttctccatctttcggatacctcgggtcatctacctctaagtactcactccttgatctcggaagatctatcctcggatctgatctcaagtctccactcatctctgctaaggctgattctgtgaggaacctcccaaagactcttggatctatgagggatggaagggtgtcattccagcttcaacataccggggagatctacatttctcagggatgcaacgttactcagactgtgttcaacggtatcaacgttcttgctggtgttggacttctctctaccccattcactattcatgaggctggatggactggacttgctgttcttgtgtgcttcgctatcgtttgctgctacactggaatccttctcaagcactgcttcgagtctaaggatgggatctcttcttacccagatattggggaggctgctttcggaagaattggaaggctcctcatctctatcatcctctacaccgagctttacacttactgcgtggagttcatcattctcgagggtgataacctcactaccatcttcccaaaggctggtgttgattggttcggaatccacgttgatggaaagcacttcttcggagtgcttactgctatccttgtgcttccaactgtttggcttagggatcttagggtgctctcttacctttcagctgggggagttatcgctactcttctcgtgttcctttctgttggacttgtgggagctactgatggaatcggattccactctactggaaaggctgttaactggtctggaatgccattcgctatcggaatctacggattctgctactctggacactctgtgttcccaaacatctaccagtctatgtctgataggtctaagttccctaaggctctcttcatctgctttgctatctgcactgctatctacggatctttcgctgtgatcggattccttatgttcggaaagaacaccctctctcagatcactcttaacctccctaagcactctttcgcttcagaagtggctctttggactactgtgatcaacccattcaccaagttcgctcttctcttgaacccactcgctagatctcttgaggaacttaggccagagggattcatgaacgagacatcttgcgctatcatccttaggactgctcttctcgcttctactgtgtgcattgctttcctcttgccattcttcggacttgtgatgtctcttatcgggagtctcctttctatccttgtggctgtgatcatgccaccactttgcttccttaagatcgctcagaacaaggctacttgcgctcaagttatcgcttctatctgcatcgttatgctcggagttatctctgctgctctcggaacttactcttctgtgaagaagatcgttgagaactactgatga

SEQ ID NO: 2457 - DNA, 1237 bp, Zea mays
tctagagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtcgatggcaacggccatgaccaacttgatccccgccatcaccttcgtcatggcggcatcagtcggcctagagagggtggaggccaggaggccgaggagcctggccaagatcttcggcacggccgtctgcgtgagcggcgccatggccatggctttcttcaagggcccgaagctgctcggcgacggcccgaacgctctccagctcctcctccacgcgggcggcggcggcaggtgggtggccggcgcgctcttcctcgtgggcagcagctcctgctggtcgctctggctcatcctgcaggtgcccatctgcaagtcgtacgtggagccgctggctctgtcggcgtggatgtgcgtcctgtccacgctccagtccgcgctgctcgtctccttcctcctgccggaccccagcgcctggaggatccactcgctcttcgagctctcctgctgcgtcttctcgggcgtgttcgggtacggcgtcacgttctacctgcagtcgtggtgcatctccgtgaggggcccgctctactccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaacaagggcggggtggagccagagcaccactcggacgatctggagaagacgtcatcagcgcggtcggatcccaattcgacggccggcgtcggcagtggcatcgccgagcccctcctggcgggcggcgatccaacggagaagtagatgggattttgctgctcttcaagtgttctgtgcgtgcgcgcgcggtgttttcagggtcggtatgctagtgatctc

SEQ ID NO: 2458 - DNA, 972 bp, Zea mays
gattaggagcagggaccaatcatattgaactcagatctggagcggagcaggaggggagccattgccggtgttctgattgctgttggaggtcgagggatggtaggggtgctgtcgaatcgcgtggatcgggacgacctcaaggccggggatcacatctacacttggcgggccgcctacatctacgcccaccacggaatatatgctggagatggcatggttatccattttacaagggcagctggacatgagattggaacaggaacattcttggactggttcctttatagctcctctccggcagcaactgagggtcctccctgccagaaatgtgggcacctagtcaagtccgatggggtcatcacctcttgcctcgattgcttcttagatgggggcagcctgtacctctttgactacgctgtgtcgcctgctttcttcctcgccaaagcacggggaggaacgtgcaccctggctgcctctgaccccagtgacgttgtgatccaccgtgcacggtacctcctggacaatgggtttggcatgtactccctgttcaagaacaactgcgaggacttcgccatatactgcaagactgggctgcttgtggagaccgctttcagtgttggccgtagcgggcaacttgcgtctctgactgctgccttcagcgccgtggcctcgtcccccttgcgtttcctgacaaccagtgctggtggcctggcaattgtgaccagcggcatgtactgtttcgggcggtatgtgtcggatattggtgtccggcgtgatgttgtcaaggtccctgtcgaaaggcttgtggagcagaatgttacttggattcctcagtgtgtggctacagagacagatatcgcggcaggagcaccgcagcagcagttggaggttccttgtgcggttgccgaggaagcatccgttatacagcccgcggcaccgtgatccattgctgaaatgtcatcatgtacctaa

SEQ ID NO: 2459 - DNA, 412 bp, Arabidopsis thaliana
cctattgctcatgatgtttgagcaaggattcaactacatcaacttaggtgtggccagtgatggagcttccccgaagttggcgttaatcggagagtttttgaagcagtttttctactcaaatccggaagaaacttggcgttgtgggctcaagcttagagatcgacatgaggaaagaggattcacatcgcctcaaagccgattgacggtggctgatcggaatttttgcggtgtcccggtgaacccgacaatgaggctcaacgtcatgacacgtggcttaaggacgacacgttcgttacacgtgttagacactaaatcaacttgcgtttcttgtttatctttattttaatttggtttggcctgggcttatatccatgtaatttttttgaaccttctgtatttcctgcctttgtaa

SEQ ID NO: 2460 - DNA, 1763 bp, Arabidopsis thaliana
gatgatggtttgatgcagatgggttttcaaaaatctcatcttttttcttaacaaatcaaaaagcttagaacttgttgaacaatactagagactagagaatttgcagataatctgtttcaaaaatggatgctacgagtggaactccgagtttacagtatattaacttgccggagcaacctgtttcgactacttctcctcctgtgtcaccatttcagaggccaaaacgacattgctttggtgacacaactccaggagagtttcctttagcagctaacccttccattgtcctacatgttctcactgaatgtagattggatcctcgtgacctcgctaatctcgaggcaacatgctcgttctttagccagccagcaaactttgccccggacattaacctatcactatcggagctcgctgctctcgacatgtgtaataaaagggtgattttcaagccgatgaatgaagaagaacgtcaagagatgaaacgtaggtgcggaggatcatggaaattagtccttcggtttttgctggctggtgaagcgtgttgtcgaagagagaaatctcaagctgttgctggtcctggtcatagtgtagcagtcacatcgaaaggagaagtttatactttcggatataataactctggacagctaggacatggtcataccgaggacgaagctcgaattcaacctgttagatcattacagggagttcgaatcatccaagcagctgctggtgctgctcggacaatgctaataagcgatgacggaaaagtttatgcgtgtggaaaagaatccttcggggaagctgaatacggagggcaagggactaaaccagttacaactcctcagcttgtaacatctttaaaaaacatatttgtagtgcaagcagctattgggaattactttaccgctgttctctcccgagaaggaaaggtttatacattctcgtggggcaatgacggtagactaggacaccaaactgaggctgcggatgtcgagcctcgtcctttgttaggcccactcgagaatgtacccgttgtgcagattgctgctggttattgctaccttcttgccttagcctgtcaaccaaatggcatgtctgtttactcagttggttgcggtttgggaggcaaacttggtcatgggtcaagaacagatgagaagtatcctcgggtcatcgagcagtttcagatattgaatcttcaacctagggtagttgcagcgggtgcttggcatgccgcggtggtaggtcaggatggaagagtgtgcacttggggttggggaagatatggatgtttaggtcacggtaacgaggagtgtgaatcagtccctaaggttgttgaaggtctaagccatgtcaaagcagttcatgtcgcaacaggagactacactacttttgtggtctcagacgatggtgatgtttactcgtttggctgcggcgaatccgctagtctcggtcaccatccatcctttgatgaacagggtaatcgacatgcaaacgtgctaagtccaacggtagtaacatcgctaaaacaagtgaacgagcggatggtccagataagtctaacgaactccatatactggaacgctcatacatttgcgctcacggaatcggggaagctattcgcgtttggtgcaggcgatcagggtcagcttggaacagagcttggtaagaaccaaaaagaaaggtgtgtaccggaaaaagtggatatcgatctcagctagcttgctgacttatgtggtttggttggtaagaaactacgttag

SEQ ID NO: 2461 - DNA, 715 bp, Glycine max
actcatcagcaactacaacgtgagaaacatggcttccttaagctccttagtgctgctccttgcagctctaattctatcccctcaagttcttgcaaactatgagaatcccccagtgtacaagcctcccactgagaaaccaccagtttataagcccccagttgagaagcctcctgtttacaaacctccagttgaaaaccccccaatttataagcctccagtagagaagccaccagtgtacaagcccccagttgagaaacccccagtttataagcccccagttgagaaaccaccagtgtacaagcccccagttgaaaaaccaccagtgtacaagcccccagttgaaaaacccccagtgtacaagcccccagttgaaaaaccaccagtgtacaagcccccagttgagaagcccccagtttacaagcccccagttgagaagccaccagtttacaagcccccagttgagaagccaccagtatacaagcccccagttgagaagcctccagtgtacaagccaccagtagagaagcctccagtttacaagccaccagtagagaaacctccagtttacaagcccccagtggagaaacctcctatttacaagccacctgttgagaagcctccggtctacaagccaccatatggaaagccaccatacccaaagtaccctccaactgatgacacccatttctgaaggatgtcaagaggtgtattgtag

SEQ ID NO: 2462 - DNA, 786 bp, Arabidopsis thaliana
gatacaatgagaatgttagttcttcgcactcccaccggacctgtctccgccgtcagattcatcaccaaatccaaaccttctcctttctcttctcccgattcatggctcctccctgcaccaaacactcaccgtagtcgtccccgcgtcgtcctcgctctctctaaccccgacggaagcgtcaactcaaaaccctcaacctcagcttctcaaatcccttcttcaggagatgaaacagttttcgtgggtcaagaaaatgttcctctcgagggcgtgattcaattcgataaaccgtcatctacttcatcttctaacattaccaaatggggtcgtgtggctttacttgcgggtggtgatgttttagctctgcttatcttctctgccattgggagatttagccatggtttccctgttttttctattgatactctccacacagctgaccctttcattgcgggatggtttctgagtgcttatttcttggggggttatgcggaggaaggacgaggaatgaagggaaagtctaaagctgtggttgcagctgcgaaatcttggattgtcggaactccgcttggaattatcattaggtcagcttcatcaggtcacattccggcatatagctttgtgttggtgacaatgggaagtactgctgttttacttataggatggagagcattgttattcagtgtgcttcctacagagtccaagaagaaagatgatacgtatcggaagggtagtgcattcgagctatttgagttgcttacttcattgataagacgatggtgatga

SEQ ID NO: 2463 - DNA, 1109 bp, Arabidopsis thaliana
gagagaagggtgtaatgagctgttttggttggtgtgggagtgaggattttcgcaacgctactgacactggcccaaggccagcgcataacccagcaggttacaatggaggccactaccaaagagctgatccacccatgaaccagcctgttattcccatgcagcctatttctgtaccagccattccagtggatgagctgagagatataactgataactatggttcaaagaccttgatcggcgagggttcttatggaagagtgttttatggtgttcttaaaagcggtggtgcagctgccatcaagaaacttgactctagtaagcagccagatcaagaatttctttcccagatatcaatggtttcgagattgcgacatgacaatgttactgcacttatgggctattgtgttgatggccctctccgtgttcttgcttatgaatttgctcctaaaggatctcttcatgatactcttcatggcaaaaaaggtgccaaaggagcacttagaggtcctgttatgacgtggcaacagagagtcaaaatcgccgttggtgcggccagaggacttgagtacttgcatgagaaggtgagccctcaggttatccaccgagacatcaaatccagcaacgtacttctgtttgatgatgatgttgccaaaattggtgattttgatctgtctgatcaagcccctgacatggctgctcgccttcactcaactcgtgtgctaggaacctttggctaccacgctccagaatatgcaatgacaggaacgttgagctcaaagagcgatgtgtacagttttggcgttgttctgctggagctcctaactggtcgtaaaccagtcgatcataccttaccgcgtggacaacaaagtctagtgacatgggcaacccctaaactaagtgaagacaaagtgaagcaatgcgttgatgcaagactactcggagagtaccctcccaaagctgttggcaagctagctgcagtggctgcactctgtgtgcaatatgaggcaaatttcagaccaaacatgagcattgtggtgaaggcacttcaacctcttttaaaccctcctcgttctgctccgcagactccacataggaacccctactgatga

SEQ ID NO: 2464 - DNA, 1043 bp, Triticum aestivum
ttaagatggccaaggttaacgccggcgccgccctgttgtctctgtgcctgttgctggcgtattctgccgggcaatcggcggccgcctacgtggacgtggagggcaccgtaaggaaagaagtagagaatgccatcaagggcaaccccggcatcggcgcggccctcgtccggctggtgttccacgactgctgggttaatggttgcgatggatcggtgctcttggacaagacgccatccggtggcaacaccgagaagaaggcgatcaacaacatcggcctggacggcttcaacctgatcgacaccatcaagtacaaactgggcaacagcgtctcgtgcgctgacattgtcgtcttcgccgcgcgtgacgcggccagatacctgagcggcggcaaaatcgcctactccgttccctcagggcgcaaggacggcattgtctcgtcggatgctaccgcagacgccatcctcccgcaatccacctttgagttccagcagctcaaggacaacttcgccaacaagggcttcacccaggaggagctcgtcatcctctccggcgcgcactccatcggcgtctcccacctctcgtctttccaggaccgcctcaacgattcaaccgcgaccccgatcgacgacagctacaagcaggcgctcgttaaggacgtcgaggatcagaagaagagccaaaatacgtcggatccgatcgagaagaacaacatccgcgacatgagcttgaagttccagaacgactccggctacgacaccacgggggtgaacaccgcggcgaagggcgccctggacaacagctactaccacgccaacctacagaacagggtgctcttcaagtccgactgggttatgcgcaccgacagcaaagctggggacgatatggccgagtacatgaacaatgccaccaagtggaacaacgacttcgccgccgccatggtcaagctcagcaagctcccggccgagggtagtacccgttacgagataaggaagaactgcagagtcaccaaccagaactactattactagaagcaacggcattag

SEQ ID NO: 2465 - DNA, 896 bp, Oryza sativa
ggatcccattgatggcgaccgacgtggcagcgactgagcccgaggtggcggcggaggaggctgcggccgccgcgcctgagaccacggccaccgccggggattccaagccggcgaaggaggccaaggccaagaaggccgccgcgccgaggaaggcacgctccaccgccacccacccgccgtacgccgagatgatctcggaggcgatcgcgacgctgaaggagaggaccgggtcgagccagtacgcgatcggcaagttcctcgaggacaagcacaaggaccacctgccatccaacttccgcaagcagctgctcgtccagatcaagaagctcgtcgccgccggcaagctgaccaaggtcaagaactcctacaagttgccgccgacgcgcgcgccggccgcggccaagcccaaggcgaagcccgccgccgccgcaaagccgaagccgaagccgaaggccgcagctaagcccaaggcggctgccaagccgaaggccaaggctccagccaagtccaaggccgccgcgaagcctaaggcggctgccaagccagccgcgaagccgaaggcggcggctaagcccaagtctccggctaagccagccgccaagcccaaggctgcccccaaggctaaagccaagccggccgcgaagccgaaagccaaggcggctcccaagccgaaggcggcagccgtgacgaagacgaaggcgacctcggctcccgcccggaggccggcgaaggcggcgaagacgtcagccaaggacacgcccagcaagaaggcggcgccggcggccaagaagcccgccgccgcggcgaagaaggcgcccgccaagaaggccgcgccggcgaagaaggcggccgctccggcgaggaaggtgcccgcccggaaggcgaagaagtagtaa

SEQ ID NO: 2466 - DNA, 861 bp, Oryza sativa
ctgggagctagctttggaggaggaggaggaggaggggcgcgagccatggcggagaaggaggagtcaacgtcgatcccgctcagccaggcggcggaggcggttgacccggaggacccggccaagtcgccgccgcggcccagctcgcccaccacctccacccgcaaggcatgctgcgctgttcttcaaagttgggtgtcaagaaaatttatgactggatgcgtcgttctgtttcctgttgctgtcacgttcttcatcacatggtggtttattcaatttgttgatggctttttcagcccactatatgcaaaacttgggatcgacatatttggtcttggttttctgacttctctggtattcatttttctggttggaatatttgtttcctcatgggtgggttcaaccatcttttgggttggagaatggtttataaagaaaatgccatttgttcggcacatatactctgcatcaaagcaagtcagcactgccatttcaccagatcaaaacacaacagcttttaaagaagttgcgataattcgtcatccacgtattggtgaatatgcatttggatttataacatcaactgttgttcttcagactgacaaaggcgacgaagaactgtgcagcgtttatgtgccaacaaatcatctttacattggtgacatatttctggtgaactctgaggagataataagaccaaatttatccattcgagaaggaatcgaaataattgtttctggaggaatgactatgccacaggtgatcgcgtcccttgaacccaccccaaggaagagccagaatatccgtctaaatagaataatgacataatgtcatacgagagctcaagtgctcaacacgatctga

SEQ ID NO: 2467 - DNA, 1211 bp, Sorghum bicolor
tcgtctcatcaattcaagatccaatctttgctgctgccactcggcgatccgatcgttctcgagcaaggtcggtggccatggctcgctgccgccgccacctcctcctccttgctctctttctcgccttggctgctgctgctccggggcaggcgcagagtcatggcgaagcctccgccgtcttcatcgacgccgcgtcgcaccgctacctgcgggaccagcaagccgacggccaggacgcttcaatgtcgttaaatgaagtttctgcggctgtttctgtcttgcttggttttgcagcgccaacctccctaccagcgatttcatcgtcgaagttgaacaaagtgcttcttcccaatccatttgatagaccgcgtgctgttttccttatgcaaattgctgggaccgatgcctcagcccctagcttcgtatctgaaggcagcaacattttcaagaccaggattgaaggtgcaaacagcgctgatacagggctttcagatacagatgatttaattgtcattcattcagatgaatctctagatctttctcgatcagattatcttgataatgaactttccagcttggcaaactggttggagggatcttatcagaagtctagcagcaaactagtcattcccttggagagtggaaacagtctcactttgctacttgataaggaagcagacatggaatttgtgtccagcttggcttcccttcttaagactatcgagagggcgatccaggttcacgaagatttctcaggtgtcatgaaccccgcagagctactagaatgccacttcacaggaataaaggctctggagaatgaatatggttccactgaaattgttaagcaggcaactgaagtagttcagagagctgtcaccaaatcattccagtccctacatgaagcatacaaagggaaaattgttgggctggtaatatccacaaaggaggcttcatcatccttaggatccataattgacgcaccttcttcactgcacatttcaagacgactagaagaagcaagcaagactaaagaagcctctgtggcacttgttcgaaagagtttggcatggattacagggatcatcctgcttgtttcaactctcataggggtttgcttgcttatgaacatgccacttaccagggacaccctcttgtactcgaacgtcaagattgattagtactcgaacgtcaagattgattagtttgaaggg

SEQ ID NO: 2468 - DNA, 851 bp, Sorghum bicolor
ggatccaggcgatgaccaccgccaggaaggccgcctgcgtcctggccgcctgggtgctcgtggccgctgccctgagcgacctgggctccgccagggccccactgggcagcaagccgcagcgcgagttcgactacttcgccctgagcctccagtggccgggcaccatctgcgccagcaccaggcactgctgcgccagcaacggctgctgccgcagcgagccgctccagaccttcaccatccacggcctgtggccggactacgacgacggcacctggccatcttgctgccgccgcacccagttcgagctggacaagatcctgccgctgatggaggtgctgaacaagtactggccgagcctgtactgctccaagagcggcacctgcttcagcggcaagggcctgttctgggcccacgagtgggagaagcacggcacgtgctccgccccagtggtccaggacgagcttcagtacttcacgatcgccctggacctgtacttcaagtacaacgtgaccgagatgctgtccagcggcggcatccaggtgtccaacggcaaggagtacgccctgtccgacgtgatcgacaccatcaagcacgccttcggcggcagcccacagattgtgtgcaagaacggcagcgtccaggagctgcgcctctgcttcgacaaggagctgaagccgcgcgactgcctgaccacctccctgaccaatggcagcgtgtccaagagcaagcactgcccgcgctacatcaccctgccgacctacgacccactggtgctggccaacagcaccgtggagatcatgagccagttcgacgagttcgtggtgccgaccgccctgtacaccgcctgatga

SEQ ID NO: 2469 - DNA, 1392 bp, Sorghum bicolor
aagagcaccaccagagcagagagcatcgtcgtcgtcggcggcggtcgggcaggcaagcaagcatggcggggttcaaggtgacgcggatctcggagggtccggtgaagccggcgtcatcgacgcccgaggagacgctgccgctggcgtgggtggaccggtacccgacgcaccgtgggctggtggagtcgatgcacatcttccggtccggcgcggacgctgccccggccgtgatccgcgccgcgctgggcaaggcgctggccttcttctacccgctggcggggcgcatcgtggaaggggaccagcccgggtgccccgccatccggtgcaccgccgacggcgtctacttcgcggaggccgtggcggactgcagcctcgaggacgtgcggttcctggagcggcccctcctgctccccaaggaggacctcgtcccttaccccggcgacgaccgctggaccgtcgagccgcacaacaccatcatgatgatgcagatcaccaagttcacctgcggcgggttcgtgatgggtctgcggttcaaccacgcgtcggcggacggcatgggcgcggcgcagttcatcaacgccgtgggcgacatggcgcgggggctgacggagcccaaggtgctgcccgtgtggcaccgggagaagttccccaacccgaacatcaagcccggaccgctcccggagctccccgtgctggcgctggactacgtcgtgctcgacttccccacgccctacatcgacgacctcaagaggcagtacaaggcgcacagcggcaagttctgctcgggcttcgacgtgctcacggccaagctctggcagtgccgcacccgggcgctcgccctggaccctgccaccgaggtcaagctctgcttcttcgccagtgtccgccacctgctcaagctcgacagggggtactatggcaactccatcttccccgtgaagatgtccgcgccggctgagaaggtgctcgcctcctccatcttggaggtcgtcgacatgatccgggaggccaaggacaggatggccgtcgagttcttccgcttcgccaaggaggagacggaccaggacccgttccagatgaccttcaactacgagtccatctatgtctccgactggagcaagctcggcttctccgacgtggactacggctttggcccgcccatgttcgccggcccgcttgtcaacaatgacttcattgcctccgtcgtcatcctcaaggcgccgctcccgctggacggcaccaggatgctcgccagctgcgtcaccaaggagcactccgacgagttcgcccgtggcatgaaggaagacctgccctgaataacactttgatgttgcttatcatacagctgatccatgatgagacggggaaactgagatgaatggtgacataaag

SEQ ID NO: 2470 - DNA, 772 bp, Sorghum bicolor
gaagcgtctgagccagtccccgagtcgatccgccgccatgcctgtcaatcctcctcccccgccgcctcctgggtcgtcgtcttcggctccggcggggcccagctacttccctctccctttccatctgcagcagcaccagccgccgccgcagatgccgccgcctatggcggcgaacagctaccagcagtaccagcaacagctgcatcaggcgcatcagctcttccagcgggacgcgcagaccatcacccccgaggcgctgcagagtgtcaaggctgccatcgccaccagcgacgtcctcgaccccgccgccgccgctaacgccaggccctccgatccctctaccagcaagaagcccattccacgccgcgctgccggacaatcctgggaggatcctaccctcactgactggcccgaaaacgactaccggctcttctgtggagatctaggcaacgaagttaatgatgatgttctctccaaagcattctcacggtttccatccttcaacatggcaagggttgttagagataagaggactggcaaaactaaaggttatggatttgtgagcttttcaaaccctactgacctggctgcagcaataaaagagatgaatggaaagtatgttgggaaccgccctattaaattgcgtaagagtaactggaaggagaggacagatgttgaggctctagaaagacaaaagaatcatgtccataggaagcctaaaattctgaagaagagtattcttcacaagtagagatatagagggtgaaggcca

SEQ ID NO: 2471 - DNA, 1352 bp, Oryza sativa
ggatcccgacaatggcggctgttgataacgctccaccatctccagtggtgactgtgacttctactagaactgtggctccagctgctgctaagtgcgttctcgctactttcgatctcccttacatcaccttctactacaaccagaagctcctcttgtaccgattgccaaacggggcttctgatttcccagatgctgtggctagaatgtctgcttctctctctgatgctctcgcttacttctacccactcgctggtagaatcaggcaggatgatcacgatggttcactctcaatccatggacagcatggtgctgaggttatcgaggcttctgctgatcatgtgtctgtggatcagcttgctggggaggagtgttctgaagaggctgagaaggttatgcaactcctcgtgccatacactggtgttatgaacctcgagggtcttaacagaccactcctcgctgttcagctcactagactcagagatggtgttgctgttggttgcgctttcaaccatgctgtgctcgatggtacttctacttggcacttcatgacatcttgggctgagttgtgtcgtgttggtggtgctccatctcttctccctgtgcataaccgtggaatggctagatctgtgagagttaacctcccacttccagcttcagctgaggctcacgaaaagactgatccaaacggtccaaaggttccactcgtggctagagtgttctctttcccaccatctgctgttgctagagctaaggctgctgctaacgctgcactgcctccgggagccaagcctttcagctctttccagtctctcgctgctcatatttggagagctgtgtctagggctagagcacttggtccatctgatatcactgtgttcgcagtgttcgctgattgtcgtgctagactctctccaccacttccacctgcttacttcggtaacctcatccaggctgtgttcactggtgtccctgccgggatgcttcttgctggtccaccagagcttgctgctggacttcttcagaaggctatcgacgatcacgatgctgctgctatcactagaaggctcgaggagtacgaggctgctccaaagttgttccactactctgatgctggtccaaactgcgttgctgtgggatcttctccaagattcagggtgtacgatgtggatttcggtttcggtagaccagagagagttagatctggggctaacaacaagttcgatgggatggtgtacctttacccaggtagaggtggtgatggtggtatcgatgtggagctttcacttcagccagagccaatgcaaagactcgataaggatcaggacttcctccaaatgagggctccatgatga

SEQ ID NO: 2472 - DNA, 1386 bp, Zea mays
agtgctctccggtttgagggcgcgatgagggtgaaggtgatttcgcgttccaccgacgactacacgcgcgagcgcagccaggacctgcagaaagtattccgcaactatgatccagcgcttcgtagtcaagagaaagctgttgagtatactcgggcactcaatgctgccaagttagagaagatatttgctaagccatttatcggagctatggatgggcatattgacgcggtatcgtgcatggccaaaaaccccaatcatttgaaagcaatattttctggttcaatggatggagatgttcgcctttgggatattgctgcgaggaagacagtttgtcagttccccgggcaccagggtgctgtaagaggtttaacaacatccacagatggtgatcttcttgtatcatgtggcgttgactgcactgttcgactctggaaagttccgatgcttaaaatggtggatactagtgagcgtgctggagataattcccagccatcagcagtttacacctggaagcatgcattctggggtgctgatcaccagtgggacggcaatcttttcgcaactgttggtgctcaagttgatatatgggatcctgacaggtcagagccaataaatagcttcgaatggggtaaagatacggttctttctgtgcgatttgatcctggagactctaatattttgattacgtcgggcagtgatcggagtctgacactctatgacttgcgtatgtcatctccagctagaaagctgataatgaagacaaggtgcaattcagtatgctggaaccctagagagcctatgaacttcactgctgcaaatgaagacacaaactgttactcctttgatgctagaaaattagatgaagcaaaaattgttcacaaaggccatgtttcagcagtgatggatattgactactcaccaacagggcgtgaatttgtcactggttcatatgatagaacagtaaggatttttaattatcttggagaccacagcagagagatttaccacaccaagaggatgcaaagggtgttttgtgtgaagtacacctatgatgggacctatttagtctctggcagtgatgatacaaatcttcgtctgtggaagtccaaagcttcagaacaacttggagttcttcttccacgggagcgcaaaaagcaagagtaccaggatgctttgaaggagcggtacaagcatctcccagaagtcaagcggattgtaaggcatagacatctaccgaagccaatctacaaggcagccaacctacggcgtacgatgatcgaagctgaaagccgtaaagaggaaaggaggcgaaagcacagtgctcccgggagcatgcctgtgcagcccttcaggaagcggagaatcatcagagaagttgagtagtag

SEQ ID NO: 2473 - DNA, 1319 bp, Glycine max
ggatccagaagatgtactccaacttcaaggagcaggctatcgagtacgttaagcaggctgtgcaagaggataacgctggcaactacgctaaggctttcccactctacatgaacgctctcgagtacttcaagacccacctcaagtacgagaagaacccaaagatcaaggaggctatcacccagaagttcaccgagtaccttagaagggctgaggagattagggctgtgcttgatgatggtggtccaggtccagcttctaacggtgatgctgctgttgctgctaggccaaagaccaagccaaaggatggcgagggtggtggtgatggcgaggacccagagcaagctaagttgagggctggcctcaactctgctatcatcagagagaagccaaacgttaagtggaacgatgtggctggtcttgagtctgcaaagcaggcacttcaagaggctgtgatcctcccagttaagttcccacagttcttcactggaaagagaaggccttggagggctttccttctttacggtccaccaggtactggaaagtcctacctcgctaaggctgttgctactgaggctgagtccaccttcttctccgtgtcctcttctgatctcgtgtctaagtggatgggagagtctgagaagctcgtgtctaacctcttcgagatggctagagagtctgctccatccatcatcttcatcgacgagatcgattctctttgcggtcaaaggggagagggtaacgagtctgaggcttccagaaggatcaagaccgagcttctcgttcagatgcaaggtgttggccacaacgatcagaaggtgctcgttcttgctgctaccaacaccccatacgctctcgatcaggctatcagaagaagattcgacaagaggatctacatcccactcccagatcttaaggctaggcagcacatgttcaaggttcaccttggcgatactccacacaacctcaccgagtccgatttcgagtaccttgcttctaggactgagggcttctctggctctgatatctctgtgtgcgtgaaggatgtgcttttcgagccagtgagaaagactcaggacgctatgttcttcttcaagaacccagagggcatgtggattccatgcggtccaaagcaacagggtgctgttcagacctctatgcaagagcttgctgctaagggcctcgcttctaagattctcccaccaccaatcagaaggaccgatttcgagaaggttttggctaggcagaggccaactgtgtctaaggctgatctcgatgtgcatgagaggttcaccaaggagttcggagaggagggatgatga

SEQ ID NO: 2474 - DNA, 1637 bp, Sorghum bicolor
gagtatgctttccgatgggaaagggcatatatcgagtggttcatatacctgaagatgagtctgttcttctgaattctagggagaaagctccttaccttatatgtgttgaagttttaaaagcagaagctcctagccactctaaaggatcatccgatgggcacaaattatcaaaaggtgggataccattggctaatggagatgtgcaactaccaaaaccaccaccatgggcttatcctttgtggagcaggcacgacacacaaaactatgaaacagacagaatgctgaagtctacttctcaggttattgaccaagcaatggctcaactctgggagacaaaagtaaaatttgtaaatgttagtttctctattgagaaacttggtcgctcaaggagcattgcactttctgaaacggggcgtaggctgcgacatgatgctatagattctcatgagccacctggagattcgcaaacagttgctgatcagcctattgaatgggtgaaggttacattgtctgcagttccaggagttaacatggaagatgtagatgataatgaaccaacacgaaagaaggaccatcgccgcattcctagtacaattgccattgaggaagtaaaggctgcagcattaaaaggagaagctccacctggtcttcctctaaaaggagttgggcagagcacccaaaatttagatcctaaggctactgatggtggggatccaaaaccaaccgatgctttggctggtgagctttgggctgtcaaacgagagagaattcgacggtcttcggttcatggaaaatcacctggctgggacttgcgctctattattgtcaagagtggtgatgactgccgtcaagaacacttggccgtacagcttgttgcacatttctatgacatatatcaagaagctggtttaccactatggctgcggccttatgaagtgattgttacttctgcttatacagcactaattgagactatccctgatacggcatcaatccattccgtcaaaagtaggtttcccaatatttcaagtctccgagactactatgtagccaagtatgaagagaattctccaaatttcaaacttgcacagagaaactttgttgaaagtatggctggatattcaattctgtgctacctacttcaggtgaaagatcgccacaatgggaatcttctaatagatgaggaaggacatattattcatattgattttggtttcatactatctaactctcctggaggggtaaacttcgagagtgcaccatttaaactaacaagggaactccttgaagtgatggattctgatgcagagggaactcccagcgagttctttgattacttcaaggtcctatgcattcaaggtttcctgacttgtcggaagcatgcagagcgtattatacttcttgtggaaatgttgcaggattctggctttccatgtttcaaaggtggccctcgcactatacagaacttgaggaagaggttccacttgagtctaactgaagagcaatgcgtatccctggtgctctcactgatcagtagcagcatggatgcttggcgcactcggcaatatgattactaccagagagtattgaatggaattttatgattttccccacaagagtcacggattcattcatag

SEQ ID NO: 2475 - DNA, 931 bp, Zea mays
cctactatacttgcaacctctcccgctgactcgcttcgatctacccgccctcgcgtcaccatggggtacgcgcagctcgtcatcggccccgctgggagcggcaagtcaacttattgctccagtttatacgaccattgccagaccgtgggaaggacaattcatattgtcaatcttgatccagctgctgagcacttcgactatcctgtagatatggatattagagagctgatttcattggatgatgttatggaggagattgggttggggccaaatggcggtctcatctactgcatggagcaccttgaagacagcttggatgattggtttgatgaacagctagagaactacttagatgatgattatcttgtgtttgattgccctggccagattgaactcttcacacatgtcccagttctgcggaactttgtcgagcacctgaaacgaaaaaatttcaacgtttgcgctgtttaccttcttgattcacagtttgtcagcgatgtaacaaaatacatcagtggttgcatggcttctctatctgctatgattcagcttgaacttcctcatatcaacatcctttcaaagatggatctggtctccaacaaaaaagatgtagaagagtacctggacccgaatgcacaggttcttctttcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacctgtatccagtatggggaagatgcagatgtgaaggtcagggacttcgaagaagacgaagactaaccactggcactggatgctgtaggaggtgcaaactggttgctagcagtcgtgtagtgcggagtgagacttt

SEQ ID NO: 2476 - DNA, 470 bp, Hordeum vulgare
caaacaacatgtctgcctgtgtcatggcatctttggctctgaaaccatcttcctctcctctgttacaacgatccaagcttggaggcgtgcgaccatcggcgaggccgtcgttggtcatagtggccaagaaggcgaagaaggtccagactgcccaaccctacgggcctggtggtggagtggcgttcaaggaaggcgtcgatgcgtctggaagggtagccaaggggaagggtgtttaccagtttgccgacaagtatggagcaaatgttgatgggtacagccctatatacacaccagaagagtggtctccaagtggcgacgtttatgttggaggaaagacggggctgtttctctgggcagtgactcttgctggaattctgctgggcggtgctcttcttgtctacagtactagcgccttggcttcctgaagcctatgtgcagcaaaccaagctatgcaccaaacgatgtgttaa

SEQ ID NO: 2477 - DNA, 957 bp, Sorghum bicolor
cacgaccattcttcattttccaggaagctctagagcgcaggtgcagagtgctgtgcagacaccatggcgcggcggtctctggcccttctgctcgcgtcgtcgctggccctcgtgatgatggcggccgtcgcgtcggcggactcgtggctctacgagaagttcagcacggacggcaccgtccgcaccaactacgacgagtccggcgcgcaggtggcgatgctcaacctcgaccgcagctccggcgccggcttcaactccaaggagcagtacctctacggccagttcagcgtccagatgaagctcatccccggcaactccgccggcaccgtctcctgcttctacctttcttctggcgacggcgacgggcatgacgagatcgacatggagttcatgggcaacgccacggggcagccggtggtgctcaacacaaacgtgtgggccaacggcgacggcaagaaggagcaccagttcgacctgtggttcgacccggccgccgactaccacacctacaccatcatctggaacccgaccaacatcctcttcaaggtggacgacaacgtgatccgcgtcttcaagcgctacgccgacctggcctacccgagctccaagcccatgacgctgcacgccacgctgtgggacggcagctactgggccaccgagaagggcaaggtgcccatcgactggtccggcgcgcccttcgtcgtctcctacaaaggctactccgccgacgcctgcgtcagcggcggcgcctgcgccgccggcagcggcgcgtggatgaacaagcagcctgacagcgccgagtggggcaccgtcaagtgggccgagagcaactacatgcgctacaactactgcgacgacggctggaggttcccgcaggggctgccggcggagtgcagccgcagctgattcaattcgatcgttcgccggcgtctcccatcctttcagactcagttctaa

SEQ ID NO: 2478 - DNA, 545 bp, Oryza sativa
ggatcccgtcgatggaggttgaggctttcccaatcagattcaccagagggatcagatctcattgggggagaagaaagtaccagagactcgaggctgctaacggtggtggaaagactagagctactcagcaactcggtggtgctagaagaggtggtgctggatggggtcttagactcagaaggctcctcagagttagagtgagagtggctagagcttggctttcttcaccagctagactcctcgctagaatcagagatgcttatgtgggaggaatgctcgctgtttctcgtaaagcaagcggtatgtctcttccaaacgctccagagggactttggccaagaagagtgccaagaagaaagcagcttccagctgctagaccaggacagctcactgatttcgagcagagactcgtggttgagatctacaagtctatcgtggcttctaaggaacttactaccatgctccatcattctactgctcatctcccacagcagcataacactgctgctccagcttcatctggacagctcctcgtgaactgatga

SEQ ID NO: 2479 - DNA, 4438 bp, Arabidopsis thaliana
aggaagattgtgagcattgaagtgccttgggctctggctgaagatttgagcagattaaatgggtcgcctaaagttgcattctggaatcaaggccattgaggaagagcctgaggactttgagtgtactgattcaagtaatacaaccactttagcatgcatgattgatacggaaattgctgctgttttagcggttatgagaagaaatgtaagatggggaggtcgatacatgtctggtgatgatcaactagaacactcgttgattcagtcacttaaagctcttagaaaacaggtgttctcatggaaccagccgtggcatacaattagtcccatgttgtatcttcagccctttcttgatgtgatacggtcagatgaaactggagcaccaataaccagcattgctttgtcatcagtttacaagatcttaaacctgaatgtaattgatcaaaatactgcgaatattgaagacgctatgcacttggtagttgattctgtgacaagctgtcgatttgaggtgacagatcctgcatcagaagaggttgtgctaatgaagatacttcaggttcttctagcatgtatgaaaaataaagcatcagttatgctaagcaatcagcatgtatgcactgtcgtcaacacttgttttcgtgttgtccaccaagcaggaatgaaaggtgagttattgcaacgagtagctcgccacacgatgcatgaattagtgaggtgtatcttctcgcatctcccagatgttgaaagaacagaaactacacttgtcaacagagctggtagcatcaaacaagagaaagctggagtagacagtgattatgccattgtgagtaaaccagtcgaggatggaaatgctaattccgagtatgatgttgaaaattctatggcaacttttgcaactggtgctcaaagtttgatggatgatggaccagttggccctggaagcagaaagccggcttctccatatgatttgcatataatgacagagccatacggagtcccaagtatggtggaaatttttcacttcttgtgctctttgttaaatgtggtcgaacatgttggtatgggatcccgatcaaacaccatagcatttgacgaagatgtgcctctgtttgcgttgaacttgatcaactcagccattgaattgggtggatcgtccatccgccatcacccaagattgttaagcctaattcaagatgagttatttcgtaacttgatgcagttcggattgtcgatgagccccctaattctttcgatggtttgcagcattgtgctcaatttgtatcaacatctacgaactgaactcaagttgcagcttgaggcattcttttcatgtgtgattctaaggcttgctcaaggaaaatatgggccctcgtatcagcagcaagaggttgctatggaggctcttgtgaatttttgtaggcagaagagttttatggttgaaatgtatgccaatctcgattgtgatataacttgcagcaacgtgtttgaggagctgtctaatcttctctcgaagagcacatttcctgtgaactgtcctttgtctgcaatgcacattcttgctctggatggcctaatcgctgttattcagggaatggccgagaggataagtaatggattgactggtttggatttgggtcctgtccatcttgatgagtacacgcctttctggatggttaagtgtgacaactatagtgatccaaatcactgggtttcatttgtccgcaggagaaaatatatcaagagaaggttaatgattggagcagatcattttaacagggatccaaagaaggggttagagtttctccaaggcacacatcttttgcctgacaaactcgatccccaaagtgttgcttgcttttttagatatactgctgggcttgataagaaccttgttggggattttcttggaaatcatgacgaattttgtgttcaagttctcaatgagtttgctgggactttcgatttccagtacatgaatctggatactgcactccgactcttcttggaaaccttcaggttgcctggagaatcccagaaaatacagagagtgcttgaggcgttctctgaaagatactatatgcaatctcctgagattctggccaacaaggatgctgctcttgtgttatcatactctattatcatgcttaacactgatcagcacaacgttcaagtaaagaaaaagatgacagaagaggatttcattcgcaataataggcatatcaatggaggaaatgatctacctcgagaattcttgtctgaactctttcactccatctgcaacaatgagatcaggactactccagaacaaggtgcaggctttcctgaaatgactcccagccgttggattgatttgatgcataaatcaaagaaaactgctccatatattctggctgattcaagggcttatcttgaccatgatatgtttgctatcatgtctggtccaaccattgctgccatatcagtcgtttttgaccatgcagaacatgaagacgtttaccagacatgcatcgatggattcttggctatagctaaaatttctgcctgtcatcatcttgaagatgtgcttgatgatctggttgtctctctctgcaaattcacaactctgttgaatccatcatctgttgatgaacctgttcttgcatttggtgatgacgcaaaagcaaggatggctactatcacaatttttaccattgcaaacaaatatggagattatatacgtacgggttggaggaacatattggactgtatcttacggctacataaacttggacttctgccagctcgtgtagctagtgatgcagctgatgaatcagaacattcatctgagcaagggcaaggaaagccccttgcgaattccctatcttcagctcatctacagtcaatgggaactccgaggagatcttccggattgatgggaagatttagtcagcttctttcacttgatacagaagagccaagatcacagcctactgagcaacagcttgcagctcatcaacgaacacttcaaacaattcagaaatgtcacattgacagcatatttaccgaaagcaagtttctacaagctgaatctttgttgcagcttgcgcgtgctctcatttgggctgcaggtaggccacagaaaggaaccagttctccagaggatgaggatactgcggttttctgtctggaattgcttattgcaatcactctaaacaacagagacaggatcgttctcctatggcaaggcgtctatgaacatatagctacaattgctcagtcaacggtgatgccctgcaacttagtggataaagctatttttggtctacttcggatctgccagagactacttccttataaagaaagcctagctgatgagcttttgagatctcttcagcttgtgctgaaactggatgcacgtgttgcagatgcctattgtgagcaaattgcaattgaagtcagccgtcttgtgaaagccaatgctaatcacatcaggtctcaggcgggttggagaacaatcacatccttactctccatcacagcgcggcacccagaagcttctgaatcaggatttgatgccgtatcctttgttatgtctgaaggaactcacctgtatccagccaattatgtactctgtgttgatgctgcaagacagtttgctgaatcccgcgtgggacagtccgaacggtctatccgtgcccttgatctaatgggagattcattagaatatttggctaaatgggcactctcagctaaggaaaacatgggagaagaagattacgggaagatgtcacaagatattggggaaatgtggttaaggcttgttcaaggactaagaaaagtgtgtttagaccagagggaggatgtccgaaaccacgcgttacagtcattacagaagtgtttaggcggagtagacgggatcaacctagctcatagcatgtggtctcaatgctttgacaaagtaatcttcacggttttggatgacttacttgagatagctgctgggtcacagaaagactaccgaaacatggaaggcacattgcttctcgcaatcaaacttctctccaaagtgtttcttcagcaactccaagagctatctcagttatcaaccttctgcaagctatggctaggtgttctaactcgaatggagaaatacatgaaagtgaaagtaagaggcaaaaaaagcgacaagcttcaagaatcagtgccagagcttctcaaaaatatattgctggtgatgaagacgaaaggcgtgctattgcaaagaagtgctcttggtggagatagcttatgggagctaacatggcttcatgtgaataacattgcaccttctatgcgactggagctattccctgatcaagaatccacacaacttggtgatgatgaaaccgtatcgaatggcttatcttctcctgaaaacacaactggttcgtgaccttacaagtgagatcattaggtg

SEQ ID NO: 2480 - DNA, 1435 bp, Arabidopsis thaliana
tagctcgttgatgatggaggcgcttctttatgtcatcactctcttctctctctcagccctaaccgttacattaggagaaagtataagcatcgactgtggatcaaccggatcttacgtggactccaacaatgtaacatgggtcggagataaaggcttcgtcaccaacggcgagcccatgaagattccggacgttgtcaaaaagccaatcaacactctccggtacttcccaactggtcaaaccaactgctacaccaacattccggtgacaaaaggccagaaaaccctcgtgaggacgaagttttactatgagaactacgacgcgaagttctcgccgccatcttttgatgtgatttatgacgggaaacaccgtgattctattgtaattaccgagtcgttgctaaatgatgaagaaacgttctatttctcggaggtgatatatgttccggagaataagaatatcagcgtctgtctcttacgtacgtctccgtccgacaacccatttatatcgtccattgaagtttatagtttggacactggcatgtacgacgatcttggtcctaacgaaggtctcattctccacgacagaattgcatacggtgccaaagagcttataagctacccgttagacccctacggtagggtatggttagcgttaggatcccaagactccacactgaccgatctaacgacctcagccccatcaatagacatcaccggggcgtcgaacaagccaccagagattgctatgtcaaaggcattatcaggagtcggcttagtactctcagaccagactctacccctaaccggagtaccagtatacttggttctttacttctcagagcctcaaagtctaggtcgaacccagagacgatcgttcaacgttttcttggacaacactcaagtgggttcgcgtcccatcgtaccggtttttgggaaagcaactcaattcattttgagagatgtagtggccacatcggcgtcccagatagtctttcagtcaacggatgactccgttttgccacccctcatcaacggattggagctgtactcgataagtaataccagtccagacagtggaggcggcggtggagaccaaggcggcggtagtacggatgattcggaaggttctggaggagcgaaacaagcaaaaaatttgggaaaaggtggggcaaaaagcagtggagggaagaagaataacaaattaccactcattcttggcgttacgttcgcctccgcctttgcagttctcgcgtcagcgtttgcagctatttggaaaaagcgtcaaaatgctaagtcacagtcgaacagtactgtaccaaatacgtccacagagcatggaacaggcacagggatgtcgcctctagttggacagcaatttgccagcgatatgactgattcatatgttgttgaagatggacatcattgacatggataa

SEQ ID NO: 2481 - DNA, 1590 bp, Oryza sativa
ggatccctagctatgaagaaggccgccgctgggggcatggctccactgcctccctcgagcagcccaccatcttgcaaggctgggggcggaggaggctctccgcgctggtcactccttcacggcggagggggggagtggggcgtcgttgtgcgcagaaacgtggtgaagtcctccagcctcctgctcctcgtgttcagcaccttcttcgtgttctccgtgctcaggtcctctcagacctctctcgtcccaccgccaccacctgcggctgcgggaccaggagagccggcccttgcccagtccggccatgatgttgccggcgacgatggcggcgagcacgtggccgtggccgtgaacaacgtggccgccgagacacagtccaccccggacgacatctccctcccgtccaccaactcctccgccgctgccgtgccgaccaccaccaacaaggccgagcagcagcagaccggcgccaacaacatggaagaaaagtgcgacatgtccatgggcaagtgggtgcgcgagccgaagggcccagtgtacaccaataccacctgcccgaccctcccggatttcaagaactgccaaaagcacggcaaggacccaggccatctctattggaggtggcagccacatggctgcgatctcccgaggttctccccagatcgcttcctcgccgctgtgcgcggcaagaggctcgccttcatcggcgatagcctcgcccgcaaccagatggattccctcctgtgcctcctgtcgcaggcggagacaccaaccgaggtgtaccgcgacgcccatgataagttccagacctggcgcttcgccgcccatgagttcaccctcatggtgatgtggaccgagttctacgtgcatgccgagccagttgttggcgccgatggcaagccaaccccgtccttcgatatccacctcgacaggctgtcggcgaactggaccaggaggctcccagagctggattatgcggtcattagcgggggcaactggttcaacaggccgaactacctgtgggagggcggcaggagagtcggttgcgtcaagtgcggaggggctgccaatctgactgatgtgggcgtgccatacgctgtgagaagggttgtgagggccgccgtggagggcattgctaggtgcacgggctgcaaggccggcctggtggccttcctcaggaccttctccccggatcatttcgagcatggcgcctggttttctggcggctactgcaataggaccaggccactcgaggaggatgaagtcagcccagattccgccgcctgggagctgcggagggtgcaacgcgaggaggtgatgagggttaaggagactgctgcggctgcggcagcggcttcggggaatgccaggcgcttcgaggtgctcgatgtgaccaaggccatgatgctcagggctgatggccatccaggcgccgcgatcgataagcgctggcaaaagaacatcgtgtccgactgcctccattggtgcatgccaggcccggtggatatgtggaacgagatgctcctccagaggctcacggagatctccaccctcgatcaggatgcctctatcttcgaggccccgtaatga

SEQ ID NO: 2482 - DNA, 1280 bp, Gossypium hirsutum
catacacacacagtgagaggtaggtttgcagttggcaaaagcttatgggaaagaagcttgctgcatttcttggacgaggcttcaagccttccaagttcaaatcactagtcactcttgccatttctcgtcttgctgttttcaagaaccagcgtcagattcgctgcaaccaagctcgttccgatgttgtacagctccttcaactttcccatcatgatcgggctcttcttagagttgaccaggtgatcaaggagcaaaacatgttggacgtctttgttatacttgaagggtattgtaatctcgttattgaacgactccatctcattgagcaggacagagtgtgccctgacgagctcaatgaggctataaccggcttgctctttgcatcttcaaggtgtggggattttcccgagcttctagagattcgtgctgtttttacatctcattacggcaaagaattcgctgctcgtgcaatcgagctgcgcaacaattgtggagtgaacgctaagattatacagaagctgtcaaccagacaaccagacttgcagagcagaaggaatgtgctcaaccagattgctgccgagtacggcattgctttacaactcgaggaaaccactgattccagcgagggaaatctggatgtaagcaagaagcaggagacatcaattaaggcaagtcatgatgcaggagatgatgatgagttctctgattcaataaaaacaaggagaaaatacagggatgtagctgatgcagctcaagcagcctttgagtcagctgcctatgcagcagcagctgcaagagcagctgtggaactctctcggtctgattcctatgatcctgatgatcagaatggtcccaatactcgacagaacacagtgtctgacaaacaagaagcaaattctaaagatatggaaaatcatggtagtcaagcagtggagttgaatcataccaagaagataccagaaatcaagatgtctagtccttcttcaagtgaaggatcagcagaggaaatcatagaccttaggacaatgtcattcaatgaagtggacccactcaagctattggagaaggaagtggttatttatgagagtgatgatgataaatatgattcccgtggttcaagttttgatttgaatgcaaggaagcttaaaggcaaggtcctaaatacagataatggtggtgagcactcagaaaagaaacttgactgatatttccttcaagctttcatgttggcttgaaggtggagactcgacctgaaaacccactgcacacatggatgaaag

SEQ ID NO: 2483 - DNA, 1398 bp, Gossypium hirsutum
aggttatggggaagaagctagacgcgttgcttggaagagggttcaagccctacaagttgaaatcagttattagtgttgccctttctcgtctttccgttttcaagaatcagcgtcagattcgcagcaaccaagctcgctctgatgttgtgcagctccttcagctcggccaccatgatcgtgctcttcttagagcggagcaggtggtgaaggagaagaacatgttggacgtgtttgttatcctggaagggtattgtaatctgcttattgaaagactccatctcattgagcaagacagagaatgccctgatgagctgaaggaggcaatatctggcttgctctttgcatcttcaaggtgtggagattttcccgagcttcaagagattcgtgcaatcttcacgtctcgctatggcaaagaattcgttgctcgtgccattgagttgcgcaacaattgtggagtcaacactaagattatacagaaactctcaaccaaacaaccagacttgcagagcagatggaatgtgctcaatgagattgctgctgagcatagcattgccctacaactccgtgaaacctctgtttccgctaccctggaaaatttggacggaagcaagaatcatagccagcccaagttaggcacaataggtaaggcaagtaaccatgcagtcctagtagatgacaacgagttctctgattcaacaaaagcaaggaaaaaatataaggatgtagctgatgccgctcaagcagcctttgagtctgctgcgaatgcggccgcagcagcaagagcagccgtggaactctctcggtctgatttccatgatcctgatgatgatgatgatgatgatgatgatcaaaacagtcccaatagtcaaagaaaaagagtgcttgagagacaggaaccaaattctgaagataaagaaactcaacaaggcaatcaagcagaggacttgaaacagacaccagaaatcaagatttcgagcccttcttcaagtaaagattcatcacaaggaaacctggacattaggacagtgtcgttggatgacgtggaccctatcaagctattggaaaaggaagtagtaattcatgagagcgacgatgagaattatgattcccatgattccagttttcatatgaacacaagcatgtttaaagtcagggcccaagatgaagataagaattacgagtgcacagagaaaactgcactgatgtttcagaactcatctgataagcaaatcccctcaagccttcgtgctggcttgaaggtggaggctgtacctgaaaaccccacagaacatgtggctcaaagttctgggacgaaaggtaaacgaccctttaccattaataaggcgccgttttctgtaaggactagacaagttcgtggctactgatgatctagaatac

SEQ ID NO: 2484 - DNA, 1007 bp, Sorghum bicolor
ggatccgagccatgtggaacagcatctaccgcttcctctgcggcctgtgcgccccaagcagcagcgagcacggcctgcacggcgcccacccagtggccgccctgggcagggacatcctgagcttccagagcaccagccaggtgccggacgagctgtccaggcacgtggtgtccagcaagaaggcccaggccaactggtacaagaagctgctggtcgcctggaagaaggccaggccgccaccaaagaccccagaggaggccgctgccttcgtggtccagaccctgaagaaccaccagaaggccgacgtcgagggcctgctgtccttctacggcctgccgcacccaaacgccgctgccggcaccccagccgccccaccaccgccgaagaagccgcagggcgccaagttcgagctgcacaccctgccgatcgacccgaagtccgtggccgacggcgacaccgtgaacgtgtacgtggacaccgccgacccacgcgaggccggcagcgtgccacgcgaggtccagaaggccgctgccgagagggccaaggccagggccgcgaagaactaccagaaggcggacgccctccagaagatcatcgttgacgccggctaccgcccagtgccaaacgccaggggcgaggaggtgctggccaagaagtaccgcatccgcctgaggggcatcgacgccccagagtccgccatgccctacggcaaggaggcgaaggaggccctgctgaagctggtccagggcaagagcctgaaggtgtacgtgtacgacgaggaccgctacggccgctgtgtgggcgacatctactgcgacggcgtgttcgtccaagagcagatgctgaagaagggcttcgcctggcactacaccgcctacgaccagaggcccgagctggccaagtgggagaagcaggcccagaccggcaggaagggcctctgggccagcagcaagccgcaaaagccctgggagtggcgcaaggacaagcgcaacggcaccgcctgatga

SEQ ID NO: 2485 - DNA, 916 bp, Sorghum bicolor
gtcctaatactatactcgcaatccctcccaccgactcgcttcgatccgccgccctcgcgccgccatggggtacgcgcagctcgtcatcggccccgctgggagcggcaagtcaacttattgctccagtttgtacgaccattgccagactgtgggcaggacaattcatattgtcaatctcgatccagctgctgagcactttgactatcctgtagatatggatatcagagagctgatttcattggatgatgttatggaggacattgggctggggccaaatggtggtctcatctactgcatggagcacctagaagacagcttggatgattggtttgatgaacagctagagaactacttggatgatgactatcttgtgtttgattgccctggccagattgaactcttcacgcatgttccagttttgcggaactttgttgagcacctgaaacgaaaaaatttcaatgtttgcgctgtttaccttcttgattcacagtttgtcagtgatgtaacgaaatacatcagtggttgcatggcttctctatcagctatgattcagcttgaacttcctcatatcaacatcctttcaaagatggatctagtctccaacaaaaaagaagtagaagagtacctggacccgaacgcacaggttcttctttcacagctgaatcgacagatggcacctcgatttggcaagttgaacaagtgtttagctgaactggttgatgattacagcatggttaatttcataccacttgatttgagaaaggaaagcagcatacaatatgtgctgtcgtatatcgacacctgtatccagtacggggaagatgctgatgtgaaggtcagggactttgagcccatcgaagacgaagactaaaattgcctcattggatgccgaaggagctgcaaactagttggttga

SEQ ID NO: 2486 - DNA, 1460 bp, Sorghum bicolor
tccctagctagcaagctctagccttcctgtagcgcgtcggagatgggcgcctccaccaccacgtcgctggcggcggcggcggcagcgctgctgctgctcgtgtcgctcgccgcggcggcggacatgtcgatcatctcctacggggagcggagcgaggaggagacgcggcggatgtacgcggagtggatggcgacgcacggccggacctacaacgccatcggcgaggaggagaggcggtatcaggtgttcagggacaacctccgcatcatcgacgagcacaacgccgccgccgacgcgggcgtccactccttccgcctggggctcaaccgcttcgccgacctcaccaacgaagagtaccgcgccacctacctcggcgtcaggaccaagccgcagagggagaggaagctcagcgccaggtaccacgccgacgataacgaggacctgccggagtccgttgattggaggaccaagggcgccgtcgcggaggtcaaggaccagggcagctgcgggagttgctgggctttctcaacaatagcagctgtggaaggcatcaaccagattgttacgggcgacttgatctccttgtctgagcaggagcttgtcgactgtgacacttcatacaaccaggggtgcaatggaggtctgatggactatgcgtttgagttcatcatcaacaatggtggaatcgacacagagtctgattacccttacaagggcacagatggccggtgtgatgccaacaagaaaaacgcgaaggttgttactatcgacagctatgaagatgtaccagcgaacagtgagaagagtctgcagaaagcagttgcaaaccagcccgtcagtgttgctattgaggctggtggcaatgcatttcagctctacagctcgggtatcttcactggaaagtgtggaacagcgttggaccatggtgtcacggccgtcggctatggcacagagaatggaaaggactactggatcgttaagaactcatggggcagcagctggggcgagtccggttacatcaggatggagcgcaacatcaaggactccagcggcaagtgcggtatcgccgttgagccatcgtaccccctgaaggagggcgccaaccccccgaaccctggcccgactccgccgtcccccaccccagagcccagcgtctgcgacaactactactcgtgccctgagagcaccacctgctgctgcatctacgagtatggcaagtactgcttcgcctggggctgctgcccgctcgagggcgccacctgctgtgacgatcactacagctgctgcccccatgactaccccatctgcaacgtccagcagggaacctgcctcatgggcaaggacagcccactgtcagtgaaggctacgaagcgcaccctggccaagccgcactgggctttctctggcaacactgatggcatgaagagcagcgcttgagaaaacgcagcatggcattaagg

SEQ ID NO: 2487 - DNA, 1365 bp, Brassica napus
ctatcaagagacgatgaaggttgaaaccataaaaccatcttccacaaccccagatgatctccgaactctccaactctctatctatgatcacttcctccctcccatttacacagtcgcctatctcttctacaccaaagatgagttgatgatctcaccagaacacacttcccacaaactcaaaacttctctgtccgaaaccttgaccaaattctacccccttgccggaagaatcaacggagtcactgtcgactgtaacgacgaaggagctgttttcgtcgacgctcgtgtcgataactgttccctctctggttttctcgcatctccagatctcaatgccctccaacagttgcttcctctagacgccgtccagaacccatacgaggctgcttccacatggcctctgttgctcgtgaaggcgacttacttccaatgcggaggcatggccatcggagtctgcatcactcacaaaatcgccgacgcagcctccatgtcgactttcattcggacttggtctgctgaggctcgaggagaggccgggaacacggtgatggatcctaagttttccgcagcgaatttttacccaccagccaatgatacctataagcttccggtggacgaaaaagccaacaagagaagcagcatcacgaagagattcgtcttcggtgcatctaagttggaagagctcaggaccaaagccactagtccagaatccgcagacatacctacgcgcgtagagagcgtcactgcccttctctggaagtgcttcgtctttgcttcatccttagacacttgtggtcgcaaagttctgatccagctcgctgacttgcgctccaagctaccgtcccttctcccagaaagcctgatcgggaacgtcatgttctcctctgtggtattaagtactgctcaaggggaggaagtgaaaattgaagaggccactagagacttacgaaagaagagggaggacttgcaaactatgatccaagacgaggatggttcatcttcgatgatcggttctaaactggcgaatcttatgctcactaattatgcccggatgagctacgagacacacgagccctacacagtgagtagctggtgcagattaccactttacgaggctagctttggatggggataccctgtttgggttgttggaaatgtggctcccacgtttgaaaacattgccatgctgatcgattccaaggacggacatgggattgaagcttttgtcacgctgcctgaagagaacatgtcctcgctcgagcaaaactcggaacttctcgcctttgcttccttgaatccttgtgtcttggtctaaactctaaattatgtactcaaatcaaatctgctgtttcgttaataaagatt

SEQ ID NO: 2488 - DNA, 1950 bp, Hordeum vulgare
gttgatcagtcagcccacttcggcgctaccggctctccctccccgatccatccgactcctcccccttccgtcgccggccgtcgtacccgcagcagcagaaggggattcgcgcgggcgccgacgaggcggacaggtcaccggcagccatggtcgggcggagctctctcccggatggggccctcttcctcggactcgacagctccacccagtctgtgaaagctactgtgctcagcaatgagttaataatagtcgcttctgaaactgttaattttgactctgagttaccgcactacaaaaccgagggtggggtttacagagatcctacagatgacggccgtatttattcaccaaccataatgtgggtggaggctttggaactgctgcttgagaaactaaaaccgaagatcaacttcagtagggttgtggccgtttctgggagtgggcaacaacatggcagcgtttactggaagaagggcagtcaagctgtgctgtcttccctggatcctggtaagagcttggtatcccagcttaaggatgccttttctaccatggactcgccaatatggatggacagtagcactaccaagcagtgcagagaaatagaaaatgctgttggaggagcattggagttatctaagctgacagggtctcgtgcgtatgagagattcactgggccccagatacgaaagatctaccaaacagcaccacatatttatgaaaataccgagagaatatctttggtgagctcattcatggcatctatccttgttggatgctatgcaagtattgatgaaactgatggcgctgggatgaacttgatggatataaacaagaggacctggtcaaaagttgttttagaggccactgctcctgatcttgaacagaagctgggaaatctggcaccggcatatgcagctgcaggtcgaatttcttcatattttgtagaaaggcatcagtttgacaagaactgtttggttattcagtggtcaggtgacaatcccaatagcctggcaggtttaacactgaatacacctggagatcttgcaatcagccttggtactagtgacacagtttttgggattactgccgaagctaaaccaagccttgaaggccatgtttttcccaaccctgttgaaccggatggttacatggtgatgctatgttacaaaaatggctcattgacccgggaagatgtgcggaatcagtgtgcagaaaaatcgtgggatattttcaacagctacctagagaaaacaccccctctgaatggtggtaggttaggattctactacaaagaccatgaaatcctgcctcctcttccagttggttttcaccggtacattgtcgagaatttcaacgacgcctcctctgaaaatctgacagagcgtgaggtgcaagaatttgatccacaatctgaggtccgtgccatcgtcgagggtcagatgctgtcgatgcgagggcatgctgagcggtttggcatgcccaatcccccgaagaggatcatagcaaccggtggggcatcctccaacgagagcatcctcaagttgatcgcacaaatctttggctgccctgtcttcacagttgagagaccggattcggcctcactgggtgcagccctgagagccgcccacggatggctgtgcaaggaggaaggaggctttgttcccatctcccgcatgtacgtgggcaacctggagaagacctcgctgggcgcaaagctggcggtcccggcgcccgaggaggagggcagggagctcctgaagaagtacaccgcgctcacgaggaagaggatggagatcgagagacggctggtggagaagatcgggcgtgcgtagagatactaggacacaccatacggcgcttgggaaatgggtatagggattattagtaggaggtaataatcattagttcaattgataatgtcgcgcgtgtcaaccgttgatggattatgtc

SEQ ID NO: 2489 - DNA, 656 bp, Hordeum vulgare
tctagagacacggaccgaacagctagctagcgcgcggcgatcgacaatggcggtcaagaagatcgggagcgagatgggcgtggtgctggggctggacgttgcgcggtacatggggcggtggtacgagatcgcgtccttccccaacttcttccagccgcgcgacgggcgcgacacgcgggcgacctacgagctcatggaggacggcgccacggtgcacgtgctcaacgagacgtggagcaaaggcaagcgcgactacatcgagggcaccgcctacaaggccgacccggccagcgacgaggccaagctcaaggtcaagttctacgtcccgccgttcctccccatcatccccgtcgtcggcgactactgggtcctctatgtcgacgacgactaccagtatgccctcgtcggtgagccccgccgaaaaagcctatggatcttgtgcaggaagacgcacatcgaggaggaggtgtacaaccagctgctggagaaggccaaggaggaaggctacgacgtggccaagctgcacaagacgccgcagagcgacccgccgccggagggcgatgctgcgcccaccgacagcaaaggggcctggtggttcaagtcgctctttggtaaatgataggttcatccgtctgtatatgaagtcgcccgggctc

SEQ ID NO: 2490 - DNA, 765 bp, Sorghum bicolor
ctccgtctctagggtttgagattttagccgccgccgcagctcatctcacttccccgagaagtcgcagccgacgacgtactcctcgccgatacgatggccgtcttctccgacctccacaccgccgacggcctcaagaccctggaggcgcacctagcgggcaagacctatgtttcaggtgatgcgatcactaaggatgacattaaggtctttgctgcggtgccatcaaagcctggcgctgagtttcctaatgctgcccgctggtacgagaccatctctgcggctgtagcctcaagattccctggtaagcctgttggtgtaaatctgcctgcgggatcagctcctgcagcagctgctcctgctgctgaggctgaggatgatgatgaccttgatcttttcggggatgaaaccgaggaggacaagaaggctgctgatgagcgtgctgctgccaaggcctcttccaaaaagaaagaaagtggtaaatcctctgtccttatggatgtcaaaccatgggacgatgaaactgatatgaagaagctggaagaggctgttcgtagtgtccagatggagggtctcacttggggagcatcaaagcttgtgcctgttgggtacggcatcaagaagatgactattatgttgacgattgtcgacgatcttgtgtccgtcgacagcctaattgaggaccaccttacggaagagcccatcaacgagtacgttcagagttgcgacattgtcgctttcaacaagatctagagttccaatcactga

SEQ ID NO: 2491 - DNA, 1062 bp, Oryza sativa
gaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtgactacaaggaagggtattatataggtattgagataccagaagatgatccacaagcaaacagaccattctatggtccaaatcagtggccatccgatgaagtattgccaagatggaggaaggtgatggaacagtatcatagcgaggccctgagggtggcaaaatcaattgcaaggattattgcccttgctctaaacctagaagaggacttctttgataaaccagaaatgcttggcgagcccatagccacattaaggctcctgcattatgaaggtggacaaaaaacaggtaaagtatcaaatcctgcagagggagtttttggagcaggtgcccattctgattatggcctaatcactctactggcaaccgatgatgtagttggtctccaaatatgcaaggacaggaatgctcagcctcaagtatgggaatatgtagctcctgtaaaaggaggttttattgtcaatcttggcgatatgctcgaacggtggagtaactgtattttcaggtcaaccttacatcgagtggtcttagatggacgagaacgtcattctattgcgttctttgtggaaccaagccacgattgcgtagtcgagtgcctgccaacctgcaaatctgaatcaaatcctccaaagttccctccgatcacttgctcggcatacctatcgcagcggtacaaggatacgcatgccgatctgaccgcttacagcagcaacaaggcctagaagtag

SEQ ID NO: 2492 - DNA, 469 bp, Oryza sativa
aacaatgtccgggaggaagaagacacgggagcccaaggaggagaacgtcaccctcggcccgaccgtgcgcgagggcgagtacgtcttcggcgtcgcccacatcttcgcctccttcaacgacaccttcatccatgtcaccgatctgtccgggagggagacgctcgtccacatcactggtggcatgaaggttaaagctgatcgcgacgaatcttccccttatgctgctatgcttgcttcacaggatgttgctcaaagatgcaaggagcttggaataactgctttgcatatcaagctccgtgctactggtggtaacaagacaaaaacccctggtcctggtgctcagtccgcacttagagcacttgctcgatctggcatgaagattggtcgtattgaggatgttactccagtgccgactgatagcacacgcagaaagggtggtagaaggggtaggaggctgtaatcttcataa

SEQ ID NO: 2493 - DNA, 698 bp, Oryza sativa
tcacagcaacacaatcaccacgacgacgatggcggcggcggcggtggagaagaagagcgggagcgagatgacggtggtgcgggggctggacgtggcgaggtacatgggccggtggtacgagatcgcgtcgctgcccaacttcttccagccccgggacggccgggacacgcgggcgacgtacgcgctgcggcccgacggcgcgacggtggacgtgctgaacgagacgtggaccagcagcgggaagcgcgactacatcaagggcaccgcctacaaggccgacccggccagcgacgaggccaagctcaaggtcaagttctacctgccccccttcctccccgtcatccccgtcgtcggcgactactgggtgctctacgtcgacgacgactaccagtacgcgctcgtcggcgagccgcggcgcaaggacctgtggatcctgtgccggcagacgagcatggacgacgaggtgtacgggcggctgctggagaaggccaaggaggaagggtacgacgtcgagaagctgcgcaagacgccgcaggacgacccgccgccggagagcgacgccgcgcccaccgacaccaaggggacgtggtggttcaagtcgctcttcggcaaatgatcgagaaattctcagcggccgatggatggatcagaggacgacgatgtatagctatagtatgaatttgccttcagtagcagtg

SEQ ID NO: 2494 - DNA, 674 bp, Zea mays
ggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgtag

SEQ ID NO: 2495 - DNA, 1589 bp, Arabidopsis thaliana
gatttggggaaaagctatggtggtctgattaatctctgtctgtctttggtgagatgggtttggatgctgttaaagctaaagggaattggaaatcggagaaacctaaagagactgagaataagaatcacaagaagaagaatggtgatgataataaaagtagaaatgaagaagaagaagaaggagaagcaagtggttgctgggtcaaatttaggtttatgattggttgcataccttcaaaatcagaccttgatgcttcttcttcttctatctatggctctaactgcactgttacaacaatggaaagtaaatcggcaaatgagaaatcaaatgatcaaccagttggtcaagtttcctccacaacaacaactagcaatgcagaaagctcttcatctactccagtcatcagtgaagaacttaacatttcttctcacctccggaagtttactttcaatgatcttaagctatctactagaaatttcagacccgagagtcttcttggagaaggtggttttggttgtgtctttaaaggatggatcgaagaaaacggtactgctcctgttaaacctggtactggtcttacggttgcagtcaaaaccttaaatcctgatggacttcaaggtcacaaagaatggcttgctgagattaatttccttggtaaccttctccatccaaatctagttaagcttgttggttattgcattgaagatgatcaaaggttgcttgtgtatgagtttatgcctagaggaagtctggagaatcaccttttcagaaggtccttgcctcttccttggtctatccggatgaagattgcattaggtgctgcaaaaggtctcagtttcctccatgaagaagctttgaagcctgttatatatcgagatttcaaaacatcaaacattttacttgatgcagactacaatgcaaaactatcagattttggacttgccaaagatgctcctgatgaaggcaaaacccatgtttctactagggttatgggtacatatggctatgctgctcccgaatatgtaatgaccggtcacttgacatcaaagagcgatgtttatagttttggggtggttctacttgaaatgttgactggacgacgatctatggacaaaaaccgcccaaatggtgagcacaacttagtggaatgggcaagaccgcatcttcttgacaagagaaggttttaccggttacttgatccgaggcttgagggccatttttcaatcaaaggtgctcaaaaagtgactcagcttgctgcacaatgtcttagccgtgaccccaagattaggccaaagatgagtgatgttgtggaagcacttaaaccacttccgcatctgaaagacatggcaagctcttcttactacttccagacaatgcaagctgaacgtttgaaaaatgggtcaggtcgatcccaaggatttggatcaagaaacgggcaacaccaacccgtgtttcgaacactgtctagtcctcatggttcttcgccttatcgacatcagattccttcgccaaagcctaaaggagcaactacatagctcttacgtggtggaaataggccacaaacgaacagagctagaaggctcaagtag

SEQ ID NO: 2496 - DNA, 2074 bp, Arabidopsis thaliana
cttccatcatgctcccaaagatataaaagacaaaaacagaaactaagctcttagtttctaaaaccgtcgatcaaaaatcatgtctcgtacaatcggctcacgggtcattttcttgatccttgctctcttctgttgtactgaaaactcccgtggcaaactggttatgcagggatccgctggattttttaaaggttacaggacgttgacgagcaccaagaagcacgcatatggtcaagccttcgaggacgagatagtccctttcaagaattcggccaacgatacagttacttctttctctgtcacgttcttctttgctatcgcccctgaggataagcacaaaggcgctcatggtatggccttcgtgatctctcccacaagaggcattactggtgcctccgctgatcagtaccttggaatctttaacaaagcaaacaacggggatagctcaaatcatgtcatcgctgtggagctcgatataaataaagatgaggaatttggcgacattaacgataaccatgttggtatcaacataaacggaatgaggtctatcaaatttgctcctgctggttattatgatcaagaaggtcaatttaaagatctttctttgataagtggaagtctactccgagtcacgattttgtatagccagatggaaaaacagcttaatgtcaccttatcatcaccagaggaggcttattacccgaacaagcctcttctttcattgaaccaagatctatcaccctatattttggagaacatgtatgtgggcttctcagcctcaacggggtctgttagagcaatgcattacatgttgagttggtttgtacatggcggcgttgatgttccaaacctggacttgggaataccaacatttcctccatatcccaaggaaaaatctctggtttatcggattgttttggtgaccagcttggcattggttctctttgttgcgcttgttgcatcagctttaagtatctttttctacaggagacataaaaaggttaaagaggttctagaggaatgggagatccaatgtgggcctcataggtttgcttacaaagaactctttaaagccacaaaaggtttcaaacaacttctaggcaaaggagggtttggtcaggtctttaagggtacacttccaggttctgatgcagagattgccgttaaacgaatttcacatgattcaaaacaaggaatgcaggaattcttggctgagatatcgacaattggtcggcttagacaccagaacctagtcaggcttcagggttattgtaggtacaaggaggaactctacttggtttatgactttatgcccaatggaagtcttgacaagtacctctaccacagagcgaatcaagagcaactcacttggaatcaacgtttcaagatcatcaaagacatagcctctgcactctgctatttgcatcatgaatgggtacaagttgtaattcatcgagacatcaagccggcaaatgtcctgattgaccaccaaatgaatgcaaggctcggggattttgggttggctaagttgtacgatcagggttatgatcctcagacatctagagttgctgggacattctggtacattgcaccggagctcataagaagcggaagagcaaccacagggacagacgtctatgccttcgggctgtttatgctagaagtctcttgcggtaggaggctgatagagcgaagaacagcctccgacgaggtcgtcctagctgaatggacattaaagtgctgggaaaacggagatattctcgaggcagtcaatgatggaatccgtcacgaagacaatagagaacagctcgagcttgttttgaaattgggagtgttgtgttcgcaccaggctgtagcaattaggccagacatgtctaaggtggtccagatcttgggtggtgatctgcagcttccagataatctactcgatatagtcaaagcagagaaggtcagaatgtggtctgagacatctgagagtgtacttggtgttttgacatcacaagggtccattggtaccttgacgttaacggaaccttttacctcccggggacgctgagacgtgatgctgagttga

SEQ ID NO: 2497 - DNA, 1049 bp, Arabidopsis thaliana
aatccatggctgaagcttgcagagttaggaggatgaagctaggaagccaaggccttgaggtatctgcgcaaggccttggctgcatggccctctccgctcgatacggtgctcccaagccggaaactgacgccatcgctctcctccaccatgctattaactccggtgttactttctttgacacctctgacatgtatggtcctgaaaccaacgagttgctcctcggaaaggctctgaaagatggggtgaaggagaaagtggagcttgcgaccaaatttggattctttatagtagagggggaaatttctgaggtaagaggagatcctgagtatgtaagggcagcgtgtgaggctagtttaaagaggctagatattgcctgcattgatctttattatcagcatcgaatcgatactcgtgtccctatcgaaatcactatgagagaactgaagaagctagttgaagagggtaagataaagtatattggtctgtcagaagcttcagcttcaactatcagaagagcacatgctgttcacccgataactgcggtgcaaatagaatggtccttatggtcgagagacgcggaagaagatatcattcctatctgcagggaacttgggattggaatcgtagcttatagccctctaggaagaggcttcttagcagcaggacccaaacttgctgagaatctggaaaacgatgacttcagaaagactctaccaagattccaacaagaaaacgtagaccacaacaagattctctttgagaaagtttctgcaatggctgagaagaaagggtgcactccagcacaactagccttagcatgggttcatcaccagggagatgatgtttgccccattccaggaaccactaagattgaaaacctcaaccagaacattagagctttgtcagtaaaactcactcctgaagaaatatctgagctcgactcccttgccaaaccagagtctgtgaaaggagaaagatacatggcctcaatgtccaccttcaagaactccaacactccaccgttgtcttcctggaaagccacttaatga

SEQ ID NO: 2498 - DNA, 696 bp, Arabidopsis thaliana
acaaatccgccaatggaagcggctctgagcatcttcaagctctcgttccttctcacccttctctccggcggttcagaccttatcgactcgttgccgccgaattgtaaccgagccgagtgtccgagttatgaggttgtccacgccgggaatggctacgagattcatcgctacaacaccaccgtttggatttctaccgaaccaattcaagatatctctctcaacgaagcttctggcaacggttggaaccaattgtctgattacatgaacgggaacaacgattatcaccagaggatagagatagcacttccttatatcacccaagtctctcagaacttgagcaccttcatagtctctttcttcgttcccaaggcattccaacctgatccacctccgggaaacaacctccacgtacagagatgggactcgaggtacgtggcggtgaagcaaattagtggatatgttgcggatcataaaattggaaaacaagtggctgagctgaaggcgagcctacaaggtaccgtatgggccaaggcaattgagaaaagcagagaaaccggcggtgtcggatcggcttgggcttacacggtggcgcaatttagctggccgttccagtggagtcagcgggtcaatgagatttggtttccgtttgaaatggaagatgaagaaactgttagtatcgttactcagtgaacatga

SEQ ID NO: 2499 - DNA, 2100 bp, Arabidopsis thaliana
gctactgcttcttctgttcaccaaaagaagccttttttggtttcttcttctgtttcatgtcgaggaacttagacagtcctgttcagacacaaatggcagtggcagttttcaagactcctcttactggagctagtaagatggaagggaagcagcatcataagcatcagcatttacagaggcaatcatcggggaggagagttttcgtgcagactgaaactggttgtgttttggggatggagttggatcgtagtgataatgttcatactgttaaaaggaggcttcagattgctcttaatttccctactgaagagagttctttgacttatggtgatatggtgttgacgaatgatttgagtgctgtgaggaacgattctccgcttctgctgaaacggaactttatgcatcgaagctcgtctactccttgtctttcgcctactgggagggatttgcaacagaaagatcgaagtggtcctattgagatactaggccattcggattgcttttcgattgttaaacatatggttaaggacattgttaaggcgatgaagatgggtgttgaaccgcttcctgttcatagcgggcttggaggtgcttactattttaggaacaaaaggggtgagagtgttgccattgtcaagccgacggatgaagagccgtttgcacctaacaaccctaaaggctttgttgggaaagcccttgggcaacctggattgaagtcttcggtgcgagttggggaaacggggtttagagaagttgctgcttatcttcttgattatggtcgctttgctaatgtccctccaactgctcttgtgaagataactcattctgtattcaatgtcaacgatggggtgaaggggaacaagcctcgggagaagaagctggttagtaagattgcttctttccagaagtttgtggctcatgatttcgatgcaagtgatcatggtacttcaagcttccctgtaacttctgtgcaccgcattggtattttggacataaggatcttcaacacagaccgtcatggtgggaatcttttggtgaagaagctcgatggagttggtatgtttggtcaagtggagcttattccaatagaccatggcctctgcctgccagaaacacttgaggatccttattttgagtggattcattggcctcaggcatcattaccattctctgatgaagaggttgactacatacaaagtcttgatccagtgaaagactgtgacatgcttagaagggaacttccaatgattagagaggcgtgtcttcgggttcttgttctctgtactattttccttaaagaagcttctgcatatggtctgtgtcttgccgagattggcgagatgatgactcgggaatttcgtcctggagaagaggagccaagtgaactggaggttgtgtgtattgaagccaagagatcagtcactgaacgagatgttttctctccaaggtcagatgtagtaggagaagcagagtttcagtttgatctagactgtgatgatttggagtcagtctacagttctaagatacaactaaccgatgactatttcaccaaaaaccctttttcaaatggacgttcttcgctcgggaagcttgaagaaagcatcaaggaagaagaagaagatgaagaagaagaagaggacaaaactgaaaatactgtccctatgatcattatgaaagacagtttttttagttcagctgcttttcatgacaaggctccatctctttcaaagctttccacttcaatgaagaacacacatcttagtgacacgacacgtaaaaacccaaaacccttaaccagaggcaaatccgagaacacatcgtctggtcacaaaagcgcaaacgaacagcttccagtgagtgcaagctttgtgaaagtagcagacatgaaagaagacgagtgggttctcttcctcgagaggttccaagagttacttggaccggctttcgcaaaacgcaaaaccgcaacgttgagtaagagacagagacttggcacttcatgccagttttgagagtcgtatagtaaaaagtaaaactcgagaagttaaaagagacagtatggagtaaaaaactgaagacttcttcttcagttctatggtagta

SEQ ID NO: 2500 - DNA, 1476 bp, Arabidopsis thaliana
taagcacaaatggcgactctttatagtcaagttccttctgtatcagcagttttctctctttacacatctttttccgcaatcacgatgctttttcgaacaatcctcaacgagattgtgcctaaaagaatcagagagtacatagctatgaaagctgtagacttcttctcttcttactttcaatctgatttcacttttgtgatagagcaacgttgggagtttgttgagaatcagacgttccgtgctgctgaagtttacttacctacctgtctcgccggactttctacaggcaaacttcttgtgggttcaagtaatcttaagaatccagctgctgagccaaaacttggtatccctgtgaacactaagatcattgataactttgaagggattcatctagaatggactcttcactctgttgaaactaagaagtatctacccgaaaaacggtactttcatttgacatgtaagaaggagtttcgtgagaagataatgacggattacttcacttacttagcgaaatcagcggagaagataatgagccatcgcgagaatctcaagatctatacttataaccaagaccggtctaaatgggaatctgctatcttcgagcatcacacgacctttgagacgttagctgttgagccagacctaaagaagactttgattgacgatcttgatgctttctctaaaggaaaagacttcttcaagagcgtaggacgtgcttggaagcgaggatatcttctttacggtccaccgggaaccgggaagtcttctatggtagctgccattgctaatcatatgaagtatcatatctatgatcttcagattcaaagtgttagagatgatggtgagttgcgggagattcttacttcgaccaagaaccggtcgattcttcttattgaagatattgattgtggagctgatgcttctcgtagacgtcagagtaagaagaaggaagaagatggtggagaagatgatggtgagccacaaaagaggaagaagaagtttgaagttgggatatctttgtctggtctattgaactttgttgatggactttggtcaagttgtggagaagagaaaatcataattttcactactaatcacaaggagaagctcgacccggcgttgcttagaccaggacggatggatgttcatattctcatggacaattgtactccctttgtgttcaagaagcttgtggctttgtaccttaaaaccgatgagcatgtcttgtttgatcccattgagaagctcattcttgaagtgagttcgactcccgctgaagtcacgcagcagctcatggcgagtaagaacgctgatatcgcgcttaaaggccttgctgaattcttggagaacaagaagttgaaaaagggagaagattctagtgtggaggaagagggagagattgaagatgctgagactaaagaagcagaaacataagactttattagaagtaactctagtgtttcagctccttga

SEQ ID NO: 2501 - DNA, 1496 bp, Arabidopsis thaliana
ttcacatgggaaaggataagactttgccgttgcttgaccctcgtgagccaccggaactcaccggaaccaagtcggcgtcaaaagtatgggccaaagagttcggcgaagagtcgaagcggctttgggagttagcaggaccagcgattttcactgccataagtcaatactctcttggtgctctcactcagactttctccggccgtctcggtgaacttgagctcgccgccgtctcagttgaaaactctgttatctccggtcttgccttcggtgtcatgttagggatggggagtgcattggagacgttgtgtggacaagcatatggcgcgggacagattaggatgatgggaatatatatgcaacgttcatgggtcattctctttactactgctttgtttttgcttcccgtctacatttgggctcctcctattctttccttcttcggcgaggctcctcacatctctaaagccgcggggaagttcgcattgtggatgatcccgcaactatttgcctatgcagccaacttcccgatacagaaattcttgcagtcacagaggaaagttcttgtgatggcttggatctctggagtggttttagttatacatgcagtttttagctggctcttcattctttactttaagtggggacttgtaggtgcagctatcactctcaatacctcgtggtggttgattgttattggtcagcttttgtatatcttaatcaccaaatcagacggtgcgtggactggattttctatgctagcgtttcgggacctctatggatttgtcaaactttccttagcctctgctcttatgctttgtttggagttttggtacttgatggttctggttgttgttaccggtctccttcctaacccgttgataccagtcgatgccatctccatttgcatgaatatagaagggtggactgccatgatttcgatcgggtttaacgctgcgattagtgtgagagtatcgaatgagctgggtgcaggaaacgcagcgttagccaaattctcagtgatagtcgtctccataacttcaactcttatcgggatagtgtgcatgattgttgtcttagccacaaaagacagcttcccttatcttttcacttcaagcgaagctgtggcagcagaaaccacgagaatagccgtcttgttgggcttcactgtcctcttgaacagcctccagcccgtcttgtcaggggttgcggttggagcggggtggcaggctctggttgcatacgtgaacattgcgtgttattacattatcggactacctgctggtcttgttcttggattcacactagacctcggcgttcagggaatatggggaggtatggtagctggaatatgcttgcagacacttatattgattggaatcatctacttcactaactggaacaaagaggctgagcaagcggagagtcgagttcagagatggggaggaacggcgcaggagtgatcaacaactcccttaggacgtggactatatcagtga

SEQ ID NO: 2502 - DNA, 1406 bp, Arabidopsis thaliana
tacatcgtcttcacctaattttccattaatgggtatctcaaaagacaggatcaaattcaacgttggtggacgactcttcgaaacgacggcgacgacgttagcaaacgcaggtcgtgattctttcttcggagcattgttcgacgacgaatggaatctttcaccacttgaagattccattcttttcgtagacagaaactcagattgcttcgcagttcttcttgatcttctccgtacgggagaccttaacgttccggccaacatccctgagcgtctccttcatagagaagcttctttctacggtttacttgaccatgtacggaccgctaaatggggtccgtttgatggtaaccgtcttcgtctatcggattctgttaaaggaattgctcccggagacggaaccgccatcagggcaggtcctgatggcggttgttgcgtcgcgcacgggagtgttgttcatgtttttgattggatgttggaagaacattctccgatcaaccttgattaccagagagtaaacgatgttggctggattgattcagacaacatcgtactctctgcttgtgagaaattgggaagaggagatggaggaatgggactgttcagttcatcttccggtgatcttcggtataagtttcaggtctgtcatgagaatcaggtgaagagttatacagctggagctttgagtttttcgccggattatgagatttttgcgagctgcaaaggtcggagtaatgagtatggaatcggagtttgggatcagataactggaaagcaaaccgatttcttctacgagagtcctggttggtcacttggtgatgctgacaagcttcaatggctgaatggtaagaactgtcttcttgtggctacattgtttccaagaaaggacaactgttacattagtttgttggattttcgggacaagaacatggtttggtcatggtcggatattgggtctcctatggcgatagacgagaagagagtgagagatgcaatagctatggaagatagcaattcgatttgtgtggtgaatgagtttgaggatttggggtttattgatctgaggatgtatggaggaagcgtgaggtggagttcgagaagtaaactgatgaagagtaagatgcctgatgagccttgttacccgaaactagctttgcatgaaggccagcttttctcatcaatgaatgattctatctctgtgttctgtggaccagactgggtcttaacttctaggctaagaagaagctatggtggctcaatctgtgatttctccattggtggcgaccgcctttttgcattgcatagcgaggagaatgtgtttgatgtctgggagactccgccttgtccgatcatataattcactaccttaatactctggtttgcttttgttcacgtttagtttgcttgtt

SEQ ID NO: 2503 - DNA, 1405 bp, Arabidopsis thaliana
cccgggagacgatgacgatgaaggttgaaaccattagtaaagaaatcataaagccatcttcgccaactccaaataatctccaaactctccaactctcaatttacgatcacatccttcctccagtttacacagtagcctttctcttctacaccaaaaatgatttgatctctcaagaacacacttcccacaaactcaagacttctctgtctgaaaccctgaccaagttctaccctcttgccggaagaatcaccggagtaaccgtcgattgtaccgatgaaggagctatctttgtcgatgctcgtgtcaataactgtcctctcactgaatttctcaagtgccctgatttcgacgccctccaacagttgcttcctctagatgttgtagacaacccatacgtggctgctgccacgtggcctttgctgctcgtgaaggcaacttacttcggatgcggaggcatggccataggaatctgcatcactcacaaaatcgcggacgcagcctccatctcgactttcattcggtcctgggccgccacggctcgaggagagaacgatgccgctgcgatggaaagtcctgtatttgctggtgcgaatttctacccaccagccaatgaggcttttaagctacctgcggacgaacaagccggcaagagaagcagcattacaaagagatttgtgttcgaagcttctaaggtggaagatctcaggaccaaagccgctagtgaagaaacagtagaccaacctacgcgggtggagagcgttactgcgctcatctggaaatgcttcgtcgcatcctcaaagacaactacttgtgatcacaaagtgctggtccagcttgctaacttgcggtccaagataccttcccttctgcaagaaagctctatcggaaatctcatgttctcttctgtggtcttgagtattggtcgaggaggggaagttaaaattgaagaggccgttagagacttacgaaaaaaaaaggaggagttaggaactgtgatcctagacgagggtgggtcatctgactcatcttccatgatcggttcgaaactagcaaatctgatgctcaccaactattctcggttgagctatgagactcatgaaccctataccgtgagtagctggtgtaagctacctctttacgaggctagctttggatgggattctccggtttgggttgttgggaatgtgtcccccgtgttaggcaacttggccatgttgatagattccaaggacggacaaggaattgaagcgttcgtcacactgcctgaagagaacatgtcgtccttcgagcagaacccagagttgctcgcctttgctaccatgaaccctagtgtcttggtttaaatcctgtactgagagctcgggagacgatgacgatgaaggtttaaatcctgtactgagagctc

SEQ ID NO: 2504 - DNA, 1654 bp, Oryza sativa
tgcagaattcgcccttaccggggatacaaagaattcgctttgcgttcgccactcgagaaagattttgtttttttttttttggttaacggataattaagcgccgtcgacgtcgatggcggccaagtgggcgatgaagaagaagctcgtcggcggcgacgccgggtacgtgctcgaggacgtgccccacctcacggactacctgcccgagcttccgacttacccgaatcctctgcaagacaacccggcttattcagtcgtcaagcaatacttcgtcaacactgacgacaccgtcacgcaaaagatcgttgttcataagaccagtgctaggggcacccatttccggcgagccgggccgcggcagcgggtgtacttccagtccgatgaggtcaacgcggccattgtcacctgcggtggcctctgccctggacttaacactgttatccgcgagcttgtgtgcggcttgtatgatatgtatggcgtcaccagcgtcgttggcatagagggtggatacaagggtttctattctagaaacaccgtcgcactgacaccgaaatcggtgaatgacatccacaagagaggtgggactgttcttggaacctccagaggaggccatgacaccggcaaaatagttgacagtattaaggatcgcggtattaaccaggtgtatattattggaggtgatggtacccagaaaggtgcttccgtaatttatgaggaagttcggaggcgaggcctcaaatgttctgtggttggtgtcccaaagaccatagataacgacattgcggtgatcgacaagtcctttggttttgacactgcggtggaggaggctcagagggccatcaatgctgctcatgttgaggctgagagtgcagagaatggcattggtgttgtgaaactaatggggcgcaacagtgggttcatcgcaatgtatgctactctggctagtcgcgatgtggattgttgcttaatcccagagtctccattctatctagaaggaaaaggtggactccttgaattcatcgagaaacggctcaaggacaatggccatatggtcattgtagtggctgagggtgctgggcaagatctcattgcgaaaagcatgaattttgtggatactcaagatgcttctggaaataagctacttctggatgttggcctttggctctcccagaagatcaaggatcatttcaagaagaagcgcaacttccccatcactctcaagtacatcgacccgacatacatgatccgtgccgtcaggtcaaacgcatccgacaacgtctactgcaccctgctagctcacagcgccctccacggcgccatggcggggtacaccggcttcaccgtcgcgccggtcaacggcaggcacgcttatatcccgttctacagaatcacggagaagcagaacaaggtggtgatcacggacaggatgtgggcgagggtgctgtgctcgacgaaccagccatgcttcctgagccacgaggacgtcgagcacctcaagcacgacgacgacgagcaccacctgcacaacacgcagctcctcgaaggcgagagctcgccggtgaaggactcctccaagtgcaacgggacagcagcgccagtgtgagaaccaacgagaatatatatatataaaagcatgtaattgtagctttctttt

SEQ ID NO: 2505 - DNA, 1544 bp, Oryza sativa
ccaaacaccaaaccctcgccgccgccgccgccgccgccgccgccatgcggatccccacgacggagacggagacggggacggggacacgcagccacaggcggcgcaagggatcgtccgacggttcgcgggccgtacaccggaccgacgcatcccgtcgcggaccaacgccgaccaaggaaacggagattcccgggcggccgccgaagcgatcctccttaaccctatcgttggacgacgcgggcgcctccaatccagcctcaacctgggcgatcctgaatcggtacggcgcccggagggattccttccgcggcgacgaccgcgaccgcaccacgtcggcggtctcctacacctccggcggcgaccagatctccgtctccttcgagctcgtgaagccgccggagacctccctcctcaccctcgactggccgcaggggccccgcccgtcggcgggaaccacatcctacccatacgtcatcgccgcgcacgacaacgtcgtcctgttccagatcatctcccccgacaagtacgctcgcccttccgccatcgactacttcgtctacaatgccaacagcagcagcagcagcaaccaccacccctccttgacgcggctgcccgtctcctactggaggaggagagacacccttcgcccgcgcatcatgagcagggaaggcacatgtattctgtcctgcagcaacaattctccttcgttcgttgtggctgagctcgagagaagatcatgccaatcttccgaaaccaacatctacctctttgcttctggctccgatgactggagagtcttcaggaatgtgccgatccgccatggcgacggcctcgctcacctgtgctggtggacaactgatgcagtgttgtcgtaccacaatcgctacatgatctgggtggactacttggtagcagggatgatcgtcgccaaagtggcacatccaggaagggttgacccaccggagcctgttctatggtacgtgccgcttcctgtcgatccagttgatgggaacccttatgacattgaccgtgggcgaggatgccctcaagcctcccgtagtgtgtgtgccacccaccatggcatcaagttcgtcaatgttaaccaacatggcggcggcagcagcagcagcagcagcagcagcagaagcttcagcatcaccctgtggtcgtggcgcgaggaggatcaaacatggggagaagatgcaacattggatgctgaccaacttcgggacctcgattctgagaaccgccttccaaatatccaacctgaattccccgttgttgacatggaaaacccttacgccgtttgcttcttgttgaacgagcgctaccacactgctgaccccaatgccacaacgtggatgatcaaggtgcacatgaagaagaaggttctactagattgtaccggatattccaacaaaggaagcccttctactgccagaaggatgtctgaggggctctccttcatctccagcgaaatgccatcttacctgtctagaaaaaccatcaaaaggcaggaggttgataagctaggaatatgatga

SEQ ID NO: 2506 - DNA, 1128 bp, Oryza sativa
caacaaccacacacactcacagctttggtcatggaggtcacccccaaccacacgcagaccgtctccggctgggccgccatggacgagtccggcaagatcgtgcccttcgtcttcaagagaagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcttggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctagactcatgctacttag

SEQ ID NO: 2507 - DNA, 1375 bp, Arabidopsis thaliana
agtttatcttgttttgggtttggttgtcttggatgggaggaagtagctctaaagagtcgcctagaggaggtggaagtggtcgtaggtatgaacgtagtgtgtctgggagctcatcttattcgtctgcttgggaccagagcagctattatcagacaccaaaccatccatctgcgtctcctgtttcatcctataattctgggagacaaacaccgaagaatcttgagaggaagtattcacggattgctgataactaccgttccattgatgaggttaccgctgctctttcacatgccggtttggagtcctcgaatctcattgttggtatagatgtcaccaagagcaacgagtggacaggggcgagatcatttggtaggaagagtctgcatttcattggaactactccaaacccttatcaacaagctatttccatcattggaaagactttatcggtttttgatgaggataatttgatcccctgttatggatttggagatgctacaactcatgatcaggatgtcttcagtttcaatcccaatgatacatattgtaacgggtttgaagaagttctcatgtgttacagagagattgttccccagcttcgtctctcaggtccgacatcttttgcacctatcatcgaaagggccatgacaattgtggaagaaagtggtggccagtaccatgttcttctcattatcgctgatggacaggtgacaagaagtgttgatacagataacggtggattcagtccacaagagcagcagactattgatgccattgttagagcaagtgaatatcctttgtctattgttcttgttggtgttggagatggtccctgggacaccatgagacagtttgatgacaacatccccgctcgtgcctttgacaatttccagtttgtgaatttcacggatataatgtcaaagaacattgatccagcaagaaaagaggcagaattcgcgctttctgccttgatggagatcccgtctcagtataaagccaccctcgaactaggcttacttggacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccagcaacagttttgccccgtatgtctagtgagtgcaaagaacatggctttcaattgtggtcatcagacttgcgctggatgtggggaagacctccatgtgtgtcccatttgccggagctcaatctcggttcgtatcaagctttattaagataagtctctcaagaactgaaggaacccgaggtggtctga

SEQ ID NO: 2508 - DNA, 436 bp, Triticum aestivum
agcggagaagaggaaggagagagagatgactgcgtccgtctcctacgggctgcgagctcttccgacgtggtccagctctgtgtccggtgacgaccactgctcggcgctggccatgtcggtgtcggcgcgggggccccggtcgacgcggccccttcggacgccggcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgatcaccgagttctgtaagaccatcggcgctgaccccaagcagaggcagggcttgatccgcctcgccaagaagaacggagagaagctcggattccttgcttgacccgcctcacaatccccccttccttctcctaccttttcttag

SEQ ID NO: 2509 - DNA, 1015 bp, Arabidopsis thaliana
tctcaaaaccctaactgtttccaagataatggcaaaaactgaagctcctagtttggtggggaagctagagacagaagtggagatcaaagcttcggctggacagtttcatcacatgtttgccgggaagccacaccatgtctccaaagcaagtccaggcaacattcagagctgtgatctgcacgaaggcgactggggcactgtcggctctatcgtcttctggaattacgttcacgatggggaggcaaaggtggcgaaggagagaatcgaggcggtggagccggagaagaacttgatcacgtttagggttatagaaggtgatctgatgaaagagtacaagagctttttgatcacgatccaggtgacccctaagcatggagggcctggaagtattgtgcattggcaccttgagtatgagaaaatcagcgacgaggtagctcatcccgaaactctcctccaattctgtgttgaggtctcccaagagatcgacgaacatctcttatccgaggaagaagaggtgaagtcaacagagacacttgagacagaggtggagatcaaagcttccgctgagaagttccatcacatgttcgccgggaaaccacaccatgtctctaaagcaactccaggaaacattcagagctgtgatctgcacgaaggtgactggggcacagtcggctctatcgtcttctggaactacgttcatgatggggaggcaaaggtggcaaaggagaggattgaggcggtgtatccagagaaaaacttgatcacgttcagggttatagaaggtgatctgatgaaagagtacaagagcttcgtaatcacaatccaagtgactcctaagcatggaggttcagggagtgtggtgcattggcacttcgagtatgagaaaataaacgaggaggtggctcatcctgagactctcctccagtttgccgtcgaagtctccaaagaaatcgacgaacatctcttggccgaggaatagaggagaatatacctcgtgtgactatctattatcctg

SEQ ID NO: 2510 - DNA, 1367 bp, Arabidopsis thaliana
cggaatatacatttgctttgtgtggatttggaagttgtccctgaatggcgtccgaggatttgaatattgttgcggaatcaaagaaaggggaagagaatgttattgttgataattccaaggacatgaatagacctgagaatcttgacttatctactgagaaaactgatactgccaatgagaatggtccaaaagatgaagcttctaagctggtaaaggaagcagacctccctgagtctggtacttcagtgaagagtaaaacagctaaggataataaacctgttaagagaaagtcagggacgttttctcggagcccgagattcatgtctcagagctcttcatttccaactaaaggagcttatactgatattactagaaagagcattgatgccacaacatcaaagactagtcttaaacccgtcgttgctggtggatccaaaccaaaagccactccatcttcaagcagcggtgtttccgcaaagcgcaccagtttagtatctgcgcctctcaaaaagcaaactatgcctgtgaaaaccatttctaaggatgcagcttcaggccctacttccaaattaggagatgaaggttctaaatccatcaaagaagaaactgcggggaaggatgtcgaggaggctggatcaaccaccgctgtggtggcagataaagtatctaacccgttgaaagctgaaatggcaagcaaggacgacgaagacactcgttcaactaccacttcaacttctacacctcgtgggcggagaagcagtgttggatcggcatctggattttcgttcaggttggaggaacgggctgaaaaacggaaggagttttatatgaaactagaagagaagatccatgcaaaggaagtagagaagaccaatttgcaggcgaaatcaaaggagagccaggaagaagagatcaaaaggttgaggaagagcttgacgttcaaggctggtcccatgcccagtttctacaaagaacccccacctaaggttgaattgaagaagataccaactactcgtcctaagtctccaaagctaggacgcagaaagagtagcagtgatgcaacaggaggtgaagccgctcctcgcgtgacaaaaccaaaagactcatcatcatctacagtgaagaaaccaataacaaagtctcagccaaagcttgaaactcaagagaaatcagtgaaggccaaagaaaagaaaaaggaagtgaagaaagaagaagcagagaagagaggagaagaagagaaggctactgccgtggctgcgaaacctgaagagcagaaaccaaactccaataacatccaagtgaaggctgagataatggcgagtgaggttgtagtgggaggctgaagcaaagagagcattcagcagtag

SEQ ID NO: 2511 - DNA, 429 bp, Arabidopsis thaliana
ggtaaaatatctttcttgtgcagaacagaagaaaaagaaacacccatggctctgttttctagcttctcagtttctgcgtttctcttgatcgttgtatcggttcaatggactctggtttgcagtgaatccacaatcttagcttctcctgctgttttaccgtatatcaatgcaccagatatgtcttcatttttcccttctccgaccaaagactggccaatagagacagcgacatctcctgttccagaaccagaagcgcctggtccaagctcagggcagcttaatgggaagatttcaggcagatcaatgcggctccatcctgatatttccttggttctagccattgttgggatctgtacctttctatgttttaatgaaccaatacttgttaggtttctacactattgatgttgtaatcttttgtggttctaa

SEQ ID NO: 2512 - DNA, 966 bp, Sorghum bicolor
aatcatccttccccaacctccctccctccccgcagcatctccacgccgtcacacctcgtcgcgtcgtcaccggcgagaagatggtcgggccgggcctctacgccgagatcggcaagaagaccaaggatctgctgtacaaggactaccagactgaccacaagttcaccctcactacctacacctccaatggcgtcgctgtcactgcttctagcacaaagaaagctgacctgatctttggtgagatccaatcacagataaagaacaagaacattaccgtagatgtgaaagcaaactcagagtcaaatatcattactacagttactgttgatgagattgcaacaccaggactgaaaaccatccttagctttgctgttcctgatcagaggtctggaaaggttgagcttcagtatttgcatgattatgctggagttaatgcaagcattggtctgacagccaatcctgtcgtcaacctctctgctgcctttggcactaaggctcttgcagttggtgcagatgtctcacttgatactgccactggaaacttaaccaaatacaatgctggactgaggttcactcatgaagacctcatcgcatccctgagcctgaacaacaggggagacagtcttactggagcttactaccacaaggtgagcgaattgaccaacacagctgttggggcagagcttacccacagcttctcgaccaatgaaaacaccgtcacctttggcgggcagcacgctctggacccactaaccgtcttgaaggcccgcatcaacaactctggcaaggccagcgccctcatccagcacgagtggaggccaaagtctctggtcaccatctcggccgaggtcgacaccaagaccatcgagaagagctcgaaggtcgggatcgccgtggccctcaagccctgattggttataagaccatttttttttccttctaagctcctagcatgactgtttgggt

SEQ ID NO: 2513 - DNA, 1477 bp, Oryza sativa
aacaatgccttgggtttatcatccgcaacttgaattgctggccgttccgcaacaacctgaatcgtgtcccatggctgcggcggttacgcagcctgaatcgccggccatggctggggttgatcgtctccgcttggacggtgccatgcccccctcgtatccctcctcctggtctgtgctgccgcgggaggtcgtggttgtcgacgagatcgacgacggggaggagctacgccggtggaacatcctgagatgcgatcgcagggccggctacggcgtctgcgaggcagtggtggagggcgtgaagctcggtgcgcgcatcgtctccgaccggggcttctccgccctgtgcatcatcgtgagcaaagccgcgcgggctgggacgagaggccaagtctgcgccgcggtgctggctatcaagaatcatgtcatcgtcctctccgtcgcctttcccagaggtgatttgttccactccctcaagtgtgcgtgttcatccttctacctggtctacgacgcctccgacgcgtccatcaccatgatccccgacctgcaattctcctttcaccaccacaaagtgtcttctgctgtcaccaaggaacctctcccaatcgcttgtggtgttgcacattacctcgtcctcctaggccgtgccatgacgattaaggggatggatcagcacatagaagatcgtgtctgcctgagtccgctgcagcagtcatctttggctcatccatcgccatcgtccagcaccaactgcagtctgtggatgaccaagtcggccatcttccccaaagaggtggtgacgagaggcttttctgcaaataagatgctctcgttcgatggcttggctatgtgggttgacttgcatcaaggaatcctcttctgccaacactacgacttgttctccaattccaatgacagtggctctgtgccgttctactttgttgatctgccaccgggctgttgtaatgatgacatcaccacccgcccgctttctgactcctatccaccagagatgtaccgttctatcgtgtgtgtcggagacagcatcaagttcgtcaccattgaaggctacctccgcgacagcactgcccctatcgaggatcggatggtgactatgtggagcctgagaccccaggaatcttggtcgtggaggaaagaccgtgacctcagcattggaggcatatgcgcgcagcttttcaagaagattcctatatgcgcaacgatgctggagccgatgccgaatatggcaccgcagagtcctatcctgagcacggaggatggcagcctccatctccttatcgtgaatgataacagcaatgaaatgctcgagaatcagaatattatggtcactgttgacatgtccaagggctacgtaatctccgcttgtttgctccctactgactttggcgatcagctgcctgggttgtatggtgtcatgctgccgcgtatgctgggctccaacttcttccggttctgatga

SEQ ID NO: 2514 - DNA, 1125 bp, Sorghum bicolor
aaggttggagattgtgaaattgacttaagcatgctaacaagggaggataagatagcatctggatcgtctgcagatttatatcgaggaacttataaaggccatgatgttgctataaagtgtctcagatctgcaaatctcagcaatccttcacaagttgagttcctgcaggaagtgcttattctaaggggtgttaaccatgaaaatattctgcaattttatggggcatgcactaagcatccaaactattgcattgtaacagaatacatgcctggagggaatatatatgactttcttcacaagcaaaataacttcttggaactccataaaattctaagatttgctatcgatatctcaaaaggaatggattatctgcaccagaataacattatacacagagatttgaagtctgcaaatcttctgctaggctatgatcaagttgtaaagatcgcagactttggtgtggcgcgacttggaagtcaggaggggcagatgactgctgaaactggaacataccgatggatggcaccagagataattaatcataagccatatgactacaaagcggatgtattcagctttgccattgttctttgggagctggcaacttcaaaggtcccatatgacaacatgacacccttgcaggctgcattaggagtaaggcagggactgcgcttggacattccagccagcgtgcacccaagattgaccaaactgattcgacagtgttgggatgaagatcctgatctgcgtccgacttttgcagagatcatgatagaactccaagatattctacactatattcaggcaccgaagggacccagtcgtcgttctagagcaaagatgcagaagaaatcagagggatgaaaaatacatatgcgtacccaaggcgaaggggtcccagttcgtttttttgggtggggtggggggttatacacaacttatagtacaagtggttttagcaatgggagcagatatttatgtggtgccgtgctggtgtacagatgtgtcagtataggctgtttgtgcttgggcatttgcagctgataaatcatcacgctggactgtattgtgcttgggcatttgcggccgataaatcatcatggtccacacgggaacgtagagtat

SEQ ID NO: 2515 - DNA, 1137 bp, Arabidopsis thaliana
gtctgggtcgaagttaaataggaaaaagatttcgaattggcttgagaatggcggaatctagtggaagttggagagattcttataaaggaatgtcgtctgataacatcaagggtttggttttagcgttgtcttctagtttgttcattggtgctagtttcattgttaagaagaaagggcttaagaaagctgcgagtactggtactagggcaggtgttggtgggtattcttatctctacgagcctctttggtggattggcatgacgacaatgttacttggtgaaattgccaatttcgctgcttatgcatttgcgcctgctatacttgtcactcctctaggtgctgtcagtatcattatcagtgctgtcttagctcatattatattacgggaaaaactacatatctttggaattcttggctgtgccttatgtgttgtgggttccacaacaattgtcttacatgcccctcaagaacgtgaaattgactctgtgattgaagtttggaatcttgcaactgaaccagcattcatgttctatgcgagtctggtaattggggctgctgtatttctcattatccgttttgtgccccaatatgggcaaacaaatgtaatggtttacattggtatttgttcgctcgtgggatcattatcggtaatgagtgtaaaagcacttggaatagcattaaagctgaccttttcaggaacaaatcagttattttatcctcaaacatggatattcaccttggtcgtacttacttgtgtggtaacccaactgaactacttaaacaaggctcttgatacattcaatacagctatagtatctcctatatactacgtgatgttcacatctctaactattttggctagtgtcatcatgtttaaggactgggatcggcaaaacggtactcaaattgttacagaaatatgtggatttgttacaatactttcaggcacttttcttctccacagaacaaaggacatggtcgagggttcgtcggtaatattaccgttgcggataagcaagcatataaatgaagaagaaggcattccactcagacgccaagaatctctccggtcaccttaaaagctttttcgctctgtttcctggtccactgcgataactgcaaactaatctagaatac

SEQ ID NO: 2516 - DNA, 2372 bp, Arabidopsis thaliana
gtttaacatagttggggctaggaattttcatggtttctgttggttctaaatcattgccatctaggaggcacaggaccattgaggaagatagcttgatgggtgaacgaggaaagtctagtaacaatcacagtgaaaggaataagggaatgcgtaggaaggaccataagggtaaccgtggatttgatggagatagcagcaagaagaaccaatccggtggtgcccccaatgtaaagccagcatcaaagaaacactccgaattcgaacatcagaatcaatttgtcaggaaagagattgatccagagacttcaaagtatttctctgagattgccaatctctttgatagtaatgaagttgaattagaggaacgttcagtaatatgtggaaatgtccttgaagaaacaagagggagggagtatgaaattgctacagactatatcataagtcatgtcttgcaaactctacttgagggatgtgaacttgaccaactctgcagtttcatacgaaattctgctagtgtgttcccagccattgcaatggatagatctggttctcatgtcacagagtctgctctcaaatccttggccacacatctagaaaatccagacgcctattctgttattgaggaggctttgcattctatatgcaaggtgattgtggataatcctcttgatatgatgtgcaactgctatggttcgcatgtactacgaaggcttctttgtctttgcaaaggagtctctttagattcccctgagctttatggcgcaaaatcatcaaaagctctggccaaacgtttgaatctgaagatgtctcagctagatgacaataatttagaaatccctcatcaagggtttccaggtatgctcacgtaccttttatctgggctattaagttgtagcagagaggacatgaagtatcttcaagtcgatcagtatagcagtttggtcttacagacggctctcagactaatgctgaaacaagatgagcagttgcttgaaatcattccgcttattctgcgctgcaactctactaataaaaaagtagaagggtttcatatagagactaatgttgccaaagaaattttagagtcgatgaaggataattcattcagtcatctggtggaggttattttggaagtggcccctgaaagtttgtataacgaaatgttcaacaaagttttcaagaattctttatttgagctttcagttgatcggtgtgcaaattttgttattcaagcattaatctcccatgcaagagaccaagagcagatgggtattatgtgggaagaattagctccaagattcaaggatcttcttgagcaagggaagtcaggtgttgtggcttctctgatagcggttagccaaaggcttcaaagtcatgaaaataagtgttgtgaggcccttgttggtgcagtatgctccacaaatgaatcccgtatctccattcttccacggttgctgtttcttgattactactttggttgtcgagataagtctacatgggagtgggcacctggtgcaaagatgcatgtcatgggttgtttgatacttcaggggatttttaagttttctagtgatcatatacagccatacataacaagcttaacttctatgaaagctgagtatatcactgaaacggcaaaagattccagtggagcacgtgtcatcgaggcctttcttgcctcagatgctgctacaaaacagaaacgcagactaattataaaattacgtggacattttggcgagctctcattacacacgtctggttcatttacagttgagaagtgcttcgatgcatgtaatttgacactaagggaagccatagcatctgaactgttggatgtgaaagttgatctctcgaaaacaaagcaagggccttatctgcttaggaaacttgatatcgatggttatgccagcagacctgatcagtggaaatcaagacaagaagctaagcaatcaacatataacgaattttgctctgcatttgggtccaacaaatcaaattttccaaagaacacctttgtctctgacgcatctgaggatgcagctcaggaaatagaagtaaagaatacaaggaaagagattgaccatcatcctacttccgggtttaagcgtcaccgagaaaaacatgcaaaggataaggatgaaccttttgcaggtgaaaaaagatcgaaacagaagaagaataaaactagtgaagcaacagataaaccaaaactagctggcagcaaaagacctttcctttctggtgagatgactggaaagaatcggcattcaaataaaatgagaatttgaagggctggagccagtccttgggattcttcggaagctatctttttcacctcttagagactctcctttcatctcctggcttat

SEQ ID NO: 2517 - DNA, 1180 bp, Sorghum bicolor
aaaggcttggaaaggaaggtaattatctgacatggatgagcacatgggaagacgaacagttggcggcctcctcttcaccaagggaggctcaattcttctcttcagagaagacggttcgcgccccaagtccaagaactgctgctcgcgccatggctgtagtggtcagcattctgctgacaaagccaaaggcaaggaggtgcacagggcggcggcgcccaatgaatcaacgccagccacccctgggagatcacagatttttcggaagcccaacagaaagcctccacatgaaagcagtgcttcaggcagcatcagcagggatgcaggaggctcttgtagcgaaaccggcaacaggtcaagagacactcctgggcccgggcgtgatctactggctaggcttaaggagagggtcaacacatcaaggaaacgatcgttgaacagggagaacagcccacagtcaccgagtggattcagtgctggttccccgagcaatagtcgatcggtctcaaggccgtcgcatcgggcagcttcgaggataagaaaagctgatgaaggtgcagcaaatgcaggagctgacggtgtgcgcagaaatggtgctggagatgctaggaggagttcagagaggagtgacgacgacttgctgctagttgagcaggtaacaagaaaccatgtgccttctgaagggtttctttctggattcatggcgagatacagaagcggccttcagggagacctttcatctctggacgacagcatggaggactcaaatggatacttgcgctttgatgtgggtggaatagaagagcttgagaactacttcatattcaatgatcggcatagaggaatgaggatggatatcgacggcatgtcctacgaagagctgcttgctttgggagagcgaattggtactgtaaacactggtctttcagacaatgcattgtccacgtgcctgaacaggagcctctacatgcccacagcttcaggttctcatgaagattgtgaaagaaaatgcagcatatgccaggaggagtatttagccggcgaggaggtgggaaagatggcatgtaagcactactaccacctttcctgcatacagcattggcttcggcagaagaactggtgtcctatctgcaaatctgttgccctgaaaatcaactagcaactcatttcatgtttgaaataa

SEQ ID NO: 2518 - DNA, 1238 bp, Oryza sativa
gatcgaaaagagaagaggagcggcggcgagatccaattccaatcgatccttgtgctgctgctgctgctgcgctcgacgatcccatccggatctcgatggcggccatggctcgccatctccctgctattcttcttctctcgtcggcgctgctcctcgcccttgcctccgcctccgcttccgctgctgctccggcgctggccgccttcgtcgatgccgcgtcgcgccgctacctgcgggatcagcaacaccacgaccaggccgcttcaatgtcactagaccaagtttctgcggctgtttctgtcttgcttggttttgcaccaccaccctcgctacctgcacaatcttcttcaaagttagacaagctgttactccctaacccatttgacagaccacgggctgttttcttgctgcaaatcgatggattccatgcctccgttgaaagcatcacatctgaagctggtagcatcttcaaaaccactattgatggtctaagcgattctgctacagggcttacagataaggatgatctagttattgttcattcagatgaatctccagctgttgattcaggttctgagtattttgatagtgatctcactgacttggcaaactggcttggtgggtcctatgagaaggttgatggcaaattgatcattcccttggagagtggagaaagtcttactttgcttattacaaaggaagcagacatggaatttgcatccagcttgatctcccttcgtaaaactataaaaaggggtattcaggttcatgaagatttctcaggaggtgtcatgagccctgcagagttattagtatgccacttcaaaggcattaaggctttggaagaagaatatggttccacagaaattgttaagcagggaactgatgtagtccggacagctgtcaccaaagcatttgatttactacgtggagcatataatggaaaaattgttgggttagtaatatccacaaaggaggcttcaccatccttagtgggtccagcatcttcactgcacatttcgagatggctaaaagagacaagccaaactaacactacaatagcctcttctgagatacttgttagaaagagtttggcatggattacagggatcattcttcttgtctctactctcattggggtttgcttgcttatgaatatgccacttaccagggacaccctcctgtattcgaatgtgaagatcgattagatggaattaggagggagggagagagattag

SEQ ID NO: 2519 - DNA, 765 bp, Sorghum bicolor
tgcaagcaatcaccagtttgtcgaacagcagaggcgatcgtcgattggcgggcgcgccggcagctcgcaaagacgatggcggcggaggcagggaagacggcggcgacgaagagcggcggcgggcagatcatgacggtggtgcggggcctggacgtggcgcggtacatggggcggtggtacgagatcgcgtcgttcccgtccttcttccagccccgggacgggcgggacacgcgcgccacctaccggctgctggaggacggcgccacggtgcacgtcctcaacgagacgtggagcaaggggaagcgcgactacatcgagggcaccgcctacaaggccgacccgaacagcgacgaggccaagctcaaggtcaagttctacctcccgcccttcctccccgtcatccccgtcgtcggcgactactgggtgctctacgtcgacgacgactaccagtacgcgctcgtcggcgagccgcgccgcaagaacctctggattctgtgcaggaagacgagcatcgacgaggaggtgtacaaccagctggtggagcgggcaaaggaggaaggctacgacgtgagcaagctgcacaggacgccgcaggacgacccgccgccggagagcgacgccgcgcccactgacaccaagggagtatggtggttcaagtcgctctttgggaaatgatgactgtacacatcaccgcacgcgtactccggtgcttgctgatagtactagtagtatataatctgcgctgcacgcagcaaataaaatgag

SEQ ID NO: 2520 - DNA, 533 bp, Sorghum bicolor
ggatccgcgacatgagctaccgcctcggcgaggccgctggtcgcgaggaaggcgacgaggaaccattcgagactgccagcagcgtgtccagcggcgacagcgactctgacgacgaggaagaaggcgatcagttcccaggcggcggtggtggctctgtggctggcggcgaggcctcttgcgaccaccaggaccgcagggccttcgtgccacagccgctccgccgcatgaacagcgacagcatctacgacatgaccagcatgatgagccagctcccggccaagaagggcctcagccgctactacgagggcaagagccagagcttcgcctgcatgagcgaagtgcgctgcctcgaggacctccgcaagaaggacaacccgtacaagcagaagatcaagagctgcaagagctacgtggccctcggcggcatgatggccaagaagcagccggccagcaccagctgcgtgaacctcgacctcgtggccgccaacggcttcaggaccccgccgatccgcaacggctaccaccagtgatga

SEQ ID NO: 2521 - DNA, 1801 bp, Sorghum bicolor
agaattcgcagggatgccagattggagggtgcgtgagtttgaaggtaaattcactgatgagtttgcccacagtaatggcaaggaacatgaaggtggagttgaggctccaggtgtcactagtagtaagaagttgaagcatgcagtcgccaatgagaaagcccaaggtcccatccccagaacgaatagctcagattcacagaaatgtaatttagaggacaaccaatgtgagaacgggatagtatcccagaatataaacagtgccgctgactgcataggagactgcaaaaatggttccaatgcctttctttcaagagaagaaaatacaatcgttgaaaccagatgtccaacagataactggaactcctgtcagtttgcactgagcaatggttcgtccattctcaataaccacagtgctccacaggatagcctcacttatggagataatgatctaaactacatcgattggcctggcattgataattttgaggatgtcgacacattattcaggtcatctgattccacatatggtcagcagcagctggagaatgcagatgggttatcttggattccttcttcagatgctgtttactcttctgatgttgctatgcagcaagggtttgactcgtcttattcagattatggtattttggatgatctctcagcattccattgtgcagaagataaatcactaccctcagttgatccttcatcagctttatgtgataatcaattcaatgatacctacctgttcagtgagcaaaagaatgtgaatgcatatggtgaacagatataccaagaggatgtgatggagttgttgcccactgaccagatatgcagtggacatgaaaacattgatatgttgcaggttggaaaccagtattcatctgaaaatgcaattcaaggtattgaagacaagaaattctctatagcgtcaacttctcagctgagctcctctcagaatttactgaatcaaaggcaccacttaaattccagttcaccaagcaacattacttctgagtcctatgcagaaaagttcggtccatctagcggttcttttgcacaaaggaattcaaaagcgcagaagaaaactttgaacatgcaaccaagacagccaacaaatgataatgacataaacagacatcctcaaacattgacaagaagagcttcttatccttgtgagaactatgaaactgaaagaaaaggattagggaaaagaactctgggggatcctcaagttacaatgggtacttcaatggtagtggatggctcatttgtatcatctgtgtcctctgataactcagttgaagaaagcagctttcgacaactgcaggatgctgttagtcagctggatgtgcaaaccaaattgtgcattagggatggtttataccgattggcacgaagtgcgcaacataggcaagtttttccaaatatgatgaacaacaatggagatagccaggatgtaaaggatttgcagaatgcagaaacttcacacaagttcgtcgatccccggagcatcgagacgcagacaaacccgatcgatcggtctatagctctgctacttttccaccagtcatcggaccaggcggctgtagctgtcgacgatgcctcgtcactaaaatcccctgctggtaacaaacagcacccgggccctgcctctaaccaaggcctgatgccagcttcatcggtgtattccccaggaggtcaggggacccccaaggatgtacagtccctggacaagtactgaatttgtggcgctgctctccatgacctggttaaagcgccatgatgtggagcgttcaac

SEQ ID NO: 2522 - DNA, 530 bp, Arabidopsis thaliana
ggatccgattaatggaggcttctgtgcacaactactctaggtcacctggtttctacgtggagaagatcctcaaggtgtccatcaagaggatcgagaagaagaaggagaacagatacgtcaccgctttcttctctactctcctcttcacttgccgtaacatcatcgggtacaccttctctaactctaaggaggtggtcgattacgtcgctgatatctctccactcctctgcctttctttcatcctcgatggtcttactgctgtgctcaacggtgttgctagaggttgtggatggcagcatatcggtgctctcatcaacgtggtggcttactaccttgttggtgctccagttggtgtttacctcgctttcagcagagagtggaacggaaagggactttggtgcggtgttatggtgggttctgctgttcaggctactctcctcgctatcgtgactgcttctatgaactggaaggagcaggctgagaaggctagaaagaggatcatcagcactaagaacgggcttgtgtgatga

SEQ ID NO: 2523 - protein, 356 aa, Gossypium hirsutum
MDGYCSRRVIMFLVFAFAAISRGYGQESTTLVPAIITFGDSVVDVGNNDYLPTIFKANYPPYGRDFANKKPTGRFCNGKLATDITAETLGFTTYPPAYLSPEASGKNLLLGANFASAGSGYDDKAAMVNHAITLTQQLEYFKEYQAKLAKVAGSTKSASITKDALYVLSAGSGDFLQNYYVNPLLNHAYTPDQYGSFLIDTFTNFVKNLYGLGARKIGVTSLPPLGCVPLARTLFGYHEKGCISRFNTDAQQFNKKLNAAAANLQKQHPGLKIVVFDIFKALYDIVKSPSNYGFVEATKGCCGTGTVETTAFLCNPKAPGTCSNASQYVFWDSVHPSQAANQVLADALIVQGIALI

SEQ ID NO: 2524 - protein, 223 aa, Gossypium hirsutum
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHLSDKKILHLG

SEQ ID NO: 2525 - protein, 645 aa, Gossypium hirsutum
MEASSSTSHDPALFHAPLLYHPRRRSSRPLKGFAVIIGSVVFLLSLVTLIVNQSPEPLASNPSSVTEAGSYSMAAQPRGIAEGVSAKSNPSLFDKVGFNWTNAMFYWQRTAYHFQPQKNWMNDPDGPLYHKGWYHLFYQYNPDSAIWGNITWGHAVSTDLIHWFYLPLAMVPDQWYDINGCWTGSATLLPDGRIVMLYTGSTNDSVQVQNLAYPANLSDPLLLQWLKYPGNPVVVPPTGIEDEEFRDPTTAWLGPDGSWRIVVGTRFNTTIGTALVFQTTNFSDYELLDGVLHAVPGTGMWECVDFYPVAINGSVGLDTTALGPGIKHVLKASLDDTKVDHYAIGTYDMITDKWTPDNPEEDVGIGLKVDYGRYYASKTFFDQSKQRRILYGWVNETDSEADDLEKGWASIQTIPRSVLYDNKTGTHLLQWPVEEVESLRLNATVFKDVVVEAGSVVPLDIGTATQLDILAEFEIETLVLNSTEDEVSDCGDGAVDRSTYGPFGVLVIADDSLSELTPIYFRPLNTSDGSLETYFCADETRSSKAPDVTKRVYGGKIPVLDDENYNMRVLVDHSVVESFGGGGRTVITSRVYPTEAIYGAARLFLFNNASGVNVKATLKIWEMNSAFIRPFPFEETLFQEMVAST

SEQ ID NO: 2526 - protein, 310 aa, Gossypium hirsutum
MDVTSTPNRKEMDRIKGPWSPEEDDLLQQLVQKHGPRNWSLISKSIPGRSGKSCRLRWCNQLSPQVEHRAFTPEEDETIIRAHARFGNKWATIARLLNGRTDNAIKNHWNSTLKRKCLPVGEECNFVANGGYDGNLGGEERQPLKRSVSAGLYMSPGSPSGSDVSDSSVPVLSSSYVYKPIPRTGGVNVDVNVTPAGVEAASSSNDPPTSLSLSLPGVESCEVVSTQPITESTQNRSEERGGGVMGFSAEFMAVMQEMIRVEVRNYMTQMQQQQQQQNGAVPGGAGMGMCLDGGFRNLMAVNPVGMSKIE

SEQ ID NO: 2527 - protein, 593 aa, Gossypium hirsutum
MGGPPYDCLANPLGAVRLTFEKAIWSESETPPIHPSAFNGKDWGALELFRHFLFQGSGLSQVPILNPKTLRWVQPNSLVRYRGMIQDMLGNEFYAGAYKDGNLWRTNKFMDVSQYPMGSSPDMCIWERRLLYCVPVPGQNSWTEPSSEMEPNWSSQTREKRRRMDDEDNDPMDLVPDDEIKSSPITKKMREDGLPSPSQSRDTKTTSSSSITSTFQSVDEDNLPCLVKIYDSPESELKLNDVFEFIGVLTFDSELAVEKDDNDELSNSFYDDALVHLPPNKVPRLHCLIHRKLAVQDFLPGSPIIEPKPHLVKETREALFRHLTAVLGNDEVAAHFVLLHLLSKVHARVDDVAVGKLSLNLTGLNKESVSVFGTRLSDTFKNLLPFTNCMPLTLEYLNIASLAPQKDYQANRLVPGVLQLPEGSHLMVDETRLESGSLNSTGIENTKLLKNLIEFQKVEYDFQYYKVEMATDVQLLIFSEGKSNIVPADVIVPFQPSCLESTEMPVAEALEAWRWYLATVRSLPHSIGSEIQKVVEDDLVAARQMDRSLGSRDFSRWLTMARLISSSFGETSLSKEHWEMAKEMERLRRERLK

SEQ ID NO: 2528 - protein, 628 aa, Gossypium hirsutum
MSTGVQHQERVPMNLKKQLALAVRNIQWSYAIFWSISTRQPGVLEWGEGYYNGDIKTRKTVQSVELNTDQLSLQRSEQLRQLYESLSAGESSPQAKRPSAALSPEDLTDTEWYYLVCMSFVFNIGQGLPGRTLSTGQPVWLCNAHCADSKVFGRSLLAKSASIQTAVCFPFSGGVVELGVTDLVFEDLSLIQRVKTLLLDDPQPIVSKRSIQVDGMNNDLACPALDPLILATKLSPILGCEQLETVSPDDSPDGLEPKQSREDSLLIEGINGGASQVQSWQFMDEEFCNCVHHSLNSSDCISQTIADHRKVVPLYRGENDNGLQDVEECNQTKLTSFDRQNDDRHFHEVLSALFKSSHPLILGPQFRNSNKESSFIRWQKNGLVKPQKERDETPQKLLKKILFLVPHMHDRGLIESPETNAVRDAAWRPEADEICGNHVLSERKRREKINERLMMLKSLVPANNKADKVSILDVTIEYLQTLERRVAELESCRKSEARTKIERTSDNYGNNKTNNGKKSSLSKRKAYDVVDEADQEIGYVASKDGSTDKVTLSMNNKELLIEFKCPWREGILLEVMDALSILNLDCHSVQSSTTEGILSLTIKSKYKGSSVAKAGPIEQALQRIASKC

SEQ ID NO: 2529 - protein, 468 aa, Gossypium hirsutum
MASLPFIFFLSFFIISTTLTSAGAAAATIKLSLSPFPHPSSSHPYQILNNLVTSSVARAHHLKHPKAKADNTTSSLLRAPLFSHSYGGYTISLKFGTPPQTLPFVMDTGSSLSWFPCTSRYLCSQCAFPNVDPAKIPTFAPKLSSSSKLVGCRNPKCSWLFGPDVESRCQDCEPTSENCTQTCPPYIIQYGLGSTAGLLLVENLAFPQKTFQDFLVGCSILSNRQPAGIAGFGRSAESIPSQLGLKKFSYCLVSRRFDDTGVSSNMLLETGSGSGDAKTPGLSYTPFYRNQVASNPVFKEFYYVTLRKILVGDKHVKVPYSYLVPGSDGNGGTIVDSGSTFTFMERPVFEVVSKEFEKQMGNYRRVREIENRSGLAPCFNTSGYTSIEIPELSFQFKGGAKMALPLVNYFSFDGDDKVVCLMIVSNNVVGQGSHSGPAIILGSFQQQNYYIEFDIANNRFGWAERSCA

SEQ ID NO: 2530 - protein, 196 aa, Gossypium hirsutum
MMKRGFIVLALTVVFAATVVTAADESGLANECSKDFQSVMTCLSFAQGKAASPSKECCNSVAGIKENKPKCLCYILQQTQTSGAQNLKSLGVQEDKLFQLPSACQLKNASVSDCPKLLGLSPSSPDAAIFTNSSSKATTPSTSTTTATPSSAADKTDSKSSGIKLGPHFVGSTAALLVATAAVFFLVFPAGFASIV

SEQ ID NO: 2531 - protein, 628 aa, Gossypium hirsutum
MPVVDFVCVFLVSVVMFNLRVSTEPVEDKQALLAFISGIRHADRVKWNSSTSACDWFGVQCDANRSFVYTLRLPGAALIGSIPPNTIGRLNRLRVLSLRANRLSGEIPADFYNLTQLRSLYLQGNEFTGPFPPSVTRLTRLTRLDLSSNNFTGPIPLGVNNLTQLTRLFLQNNKFSGSLPSIDSDGLNDFNVSNNNLKGSIPDSLSKFPESSFAGNIGLCGGPLRPCNPFPPSPSPTEPIPPKTSGQSSKSLPTGAIIAIAVGSAIVALLLLLFLIICFRKWKRKSPRRQKAIPSTTHAVPVEEAGTSSSKDDITGGSTEIERMMNNKLMFFKGGVYSFDLEDLMRASAEMLGKGSTGTSYRVVLAVGTTVAVKRLKDVAVSKREFVMKMGMLGKIMHENVVPLRAFYYSDEEKLLVYDYMHGGSLFALLHGSRSSARTPLEWDPRMKIALGVARGLAHLHSSQNMVHGNIKSSNILLRPDHEACISEFGLNSLFNTNTPPSRIAGYQAPEVIQTHKVTVKSDVYSFGVLLLELLTGRAPIQPSITEEAFDLPRWVQSVVREEWAAEVFDAELMAYHDIEEEMVQALQIAMVCVSTVPDQRPVMSEVVRMIGDMIDRGGTNDGTAAAI

SEQ ID NO: 2532 - protein, 508 aa, Gossypium hirsutum
MQILPFRGGALVCFIASLLFVASFCNADAKTVEVVGAGECADCAENNLEISQAFSGLRVSIDCKPENGKNFKTRGSGELDKQGNFKVFVPEDLVENGELKEECYAQLHSVSAAPCPAHDGLESAKLVLKSRSDGKHGFGLKGKLRFSPLTCASAFFWPHFKFPPLPKWNHPPLPKFPLPPFKGFHHHYPIIPPIYKKPLPPPSPVYKPPPVPVNPPVPIYKPPPVPVYKPPPVPVKPLPPPVPIYKPPPVEKPHPPPVPVYKPPPVPVYKKPCPPPVPVYKSPPVPVYKKPHPPPVPVYKKPHPPPVPVYKKPCPPPVPVYKSPPVPEPHPPPVPVYKKPHPPPVPVYKKPCPPPVPVYKSPPVPEPHPPPVPVHKPPPVPVYKKRVPPPVPIYKPPPVPVYNKPLPPPVPVYTKPLPPPVPTYKPKPLPPIPYKPLPPLPKIPPFPKKPCPPLPKLPPLPKIPPKYFHHHPPLPKLPPLPKIPPKYFHHHPKFGKWPSLPPFAPHHP

SEQ ID NO: 2533 - protein, 175 aa, Solanum lycopersicum
MAGEATRVMVAVNESTIKGYPHASISSKGAFEWTLNKIVRSNTSGFKLLFLHVQVPDEDGFEDMDSIFASPDDFKGMKNRNKIRGLHLLEYFVNRCHEIGVPCEAWIKKGDPKEVICHEVKRVQPDLLVVGCRGLGPFQRVFVGTVSEFCLKHAECPVVTIKRSAAETPQDPIDD

SEQ ID NO: 2534 - protein, 206 aa, Solanum lycopersicum
MFGGFNVFFYGLGVAVYAFEGIGMVLPLESETRDKDKFGKILGLAMGFISLLFGAFGVLGYFAFGEDTKDIITTNLGQGLLSTFVQLGLCINLFFSFPLMMNPVYEVMERRFWEGRYCVWLRWLVVLAVTFVALAVPNFADFLSLVGSSVCIVLGFVLPSLFHLIAFKDELRWYGFASDAALIVMGTIFAVYGTSSSLMEIFAKKA

SEQ ID NO: 2535 - protein, 410 aa, Zea mays
MARMISRPAVLLSPLAMIVVAAAVMALAPAPVVATKYNITKILAPYKEYSKFNDMLSKTRLAYDINRRQTITVLAVDNSAMSALDHYSLQTIRHILELHVLVDYYGDKKLKKLAHGSTASSSMFQATGSASGMSGYVNITRKDGKVSFMTEDADDTAKPSRYVKSVKEFPYDIAVLQVSSIISSAEAEAPVPPPAPVDLVELLSKRYCKSFASLLSANAEVFRAVNETKDNGLTLFCPVDSAVAAFAATYKNLTAKAKAAILLYHAVPDYFSLQLLKSNNGMVTTLATASDKKMDYSYDVKNKGETVTLQTRVVTSSVTATVGDMEPLAVYAVNKFLQPKELFKVVEAPAPAPEPSKKKKAGRGGSDDDSSDDSGDSTADAEKGDAAPALLVRWLVTAVATAGVAYALMG

SEQ ID NO: 2536 - protein, 355 aa, Solanum lycopersicum
MEANSNSAVPLCTPYKLGRFKLTHRIVFPALTRNRSQNNTPQPHVTEYYSQRATNGGLIISEAAAASDISKECPNLPGIWNEEQVEAWKPVVNGVHEKGGVFFCQIWHSGRLSVPTVSALFFSIGIGWSTRPDDKVYAKPTPLPLESDKIPCIVNDFRIAARNAIKAGFDGIEINASSGGYLIDEFMNDQVHGWTDEYDESIKDRCRLALEIVEAVANEIGADKIGIKLSPFDGKKDSNSEALATYMANELSKLGVLYLHVMEPRETVNRSLLPIRKAFKGTLIASGGYGKSDGDKAIDENYADLISFGRMFLANPDLPKRFEINAPLNKYNRSTFYTNDPIIGYTDYPFLEVAS

SEQ ID NO: 2537 - protein, 171 aa, Oryza sativa
MLRAGGRRLLAPGLRRVLGGGAAAPVAVGGARAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 2538 - protein, 343 aa, Zea mays
MWESVALTLAGTAGNNIGKVLQKKGTLILPPLSLKLKVVKAYASNQLWISGFLMDMCGAALMLTALSQAPVSVVQPIAGCGLAILCVFSHFYLKEVMNGLDWIAITLAGLGTIGVGVGGEEQKVDQIPLLNIPWLVLSIVILFVLLNTWLHMYKKQRREQELTGPEVIEEIIYGLESGILFGISSVISKMGFVMSEMGFPKIVVPAAISCSVCCSAVGFVYQTRGLKHGRAIVVSTCTSVASIVSGVVAGMIALDEHLPKAPTARFFLLLGWFFIITGVILLVSSTRLIARLPRSVQKYLKSNIERTHSIRRPGSARGKDPIPTTTIHTSSLHLLASPTKEKA

SEQ ID NO: 2539 - protein, 336 aa, Zea mays
MSASASSPAAAAGDEKQEAAPVRRCKGVNDLDKVVLREVRGSSAEVYLYGGHVTSWKDEHGDELLFVSNKAIFKPPKAIRGGIPICFPQFSNFGNLEPHGFARNRTWSVDDDPPPFPVPTSNSAYVDLILKPTEDDLKIWPHSFEYRLRVALSPGGDLMLTSRIRNTNADGKPFSFTFAYHTYFKISDISEVRVEGLETLDYLDNLQDRARSTEQGDAIVFESELDRIYLGTPSKIAIIDHEKKRTFVVRKGGLPDAVVWNPWDKKAKAMSDFGDDEYKRMVCVEAAAIEKTVTLKPGEEWTGKLELSAVPSSYYSGQLDPDRVIQDSTVPEDSIS

SEQ ID NO: 2540 - protein, 582 aa, Oryza sativa
MRAKVELAVLLLVLVGVAAGTRPPSAPPPVTEDTLQKVAGSLEMYVDELPQMPKIYGFSMRHGHPSPIRLTIGMYQKKWKFHRDLPASTVFVFGTSAATATFPGPTIEAAQGVPLSVTWQNYLPARHILPWDPTVPTAIPRRGGVPTVVHLHGGAHPPQSDGSDFAWFTAGFGETGPAWSTPTYTYPNAQSPGVLWYHDHALGLTRANLLAGLLGAYVIRNPAVEAPLGLPCGDEFDRVLMLADRSFYADGSIYMNYTGIIPNIHPQWQPEYFGEAITVNGKAWPFLAVARRRYRFRIINTSNARYFNLSLTNGLPFTVVGSDTNYLSKPVTAASLLVSVAETFDVVVDFSQSTSSEAELVNTAPYPYPDGQAPNDLNGKVMKFVISPAKAKDTSRVPAKLLDYVAVAEEEAVQRRYIVMYEYEDAATGNPTHLYINGKRLEDPATETPRPGTTEVWEVINLTPDNHPLHLHLATFQATRVRGLVDEDAFKGCMAKLNDAVRCNVSRHAVGEEVAVPEHEKGWKNVVKIAPGYMTTIVVKFFMVDSGKPYPFDATAEPGYVYHCHILDHEDNAMIRPLKLIK

SEQ ID NO: 2541 - protein, 286 aa, Gossypium hirsutum
MMAIGLMNMVGSSTSCYITTGAFSRSAVNHNAGAKSAVSNIVMSITVMVTLLFLMPLFQYTPNVVLGAIIVSAVVGLIDIPAACQIWKIDKFDFIVMLCAFFGVIFISVQDGLAMAVGMSIFKILQQITRPKTVMLGNIPGTDIFRDLHHYKESMKIPGFLILSIEAPINFANSTYLNERILRWIEEYEAEDHKKQSNLQFVVLVMSAVSTIDTSGVSIFKELKKTVEKKGAELVLVNPLGEVMEKLQKSDEAGDFMRPDCLFLTVGEAVATLTATIKSQVSNHVV

SEQ ID NO: 2542 - protein, 540 aa, Zea mays
MAPEKPRKEQEEELMLEDGGIEESPRRSFEDCGDSEEDRGEGDDEEERDSDRDGVGSTRSFLPQKWPQSYRETTDTYTIAASPSFGYLGSSTSKYSLLDLGRSILGSDLKSPLISAKADSVRNLPKTLGSMRDGRVSFQLQHTGEIYISQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTTIFPKAGVDWFGIHVDGKHFFGVLTAILVLPTVWLRDLRVLSYLSAGGVIATLLVFLSVGLVGATDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGTYSSVKKIVENY

SEQ ID NO: 2543 - protein, 373 aa, Zea mays
MLEEYKPCAAMVVTQCIYAALALLSKAAFTGGMSPLVFVVYRQAVATIVLVPVVIAANRKKMKEMTTGLGLTGFSLVFVASLVGATVNQCMYYQGVNLGSSSMATAMTNLIPAITFVMAASVGLERVEARRPRSLAKIFGTAVCVSGAMAMAFFKGPKLLGDGPNALQLLLHAGGGGRWVAGALFLVGSSSCWSLWLILQVPICKSYVEPLALSAWMCVLSTLQSALLVSFLLPDPSAWRIHSLFELSCCVFSGVFGYGVTFYLQSWCISVRGPLYSAMFNPLCTVITTVFAAAVLREELHVGSLLGAIAVIAGLYVVLWGKAGDANKGGVEPEHHSDDLEKTSSARSDPNSTAGVGSGIAEPLLAGGDPTEK

SEQ ID NO: 2544 - protein, 281 aa, Zea mays
MVGVLSNRVDRDDLKAGDHIYTWRAAYIYAHHGIYAGDGMVIHFTRAAGHEIGTGTFLDWFLYSSSPAATEGPPCQKCGHLVKSDGVITSCLDCFLDGGSLYLFDYAVSPAFFLAKARGGTCTLAASDPSDVVIHRARYLLDNGFGMYSLFKNNCEDFAIYCKTGLLVETAFSVGRSGQLASLTAAFSAVASSPLRFLTTSAGGLAIVTSGMYCFGRYVSDIGVRRDVVKVPVERLVEQNVTWIPQCVATETDIAAGAPQQQLEVPCAVAEEASVIQPAAP

SEQ ID NO: 2545 - protein, 532 aa, Arabidopsis thaliana
MDATSGTPSLQYINLPEQPVSTTSPPVSPFQRPKRHCFGDTTPGEFPLAANPSIVLHVLTECRLDPRDLANLEATCSFFSQPANFAPDINLSLSELAALDMCNKRVIFKPMNEEERQEMKRRCGGSWKLVLRFLLAGEACCRREKSQAVAGPGHSVAVTSKGEVYTFGYNNSGQLGHGHTEDEARIQPVRSLQGVRIIQAAAGAARTMLISDDGKVYACGKESFGEAEYGGQGTKPVTTPQLVTSLKNIFVVQAAIGNYFTAVLSREGKVYTFSWGNDGRLGHQTEAADVEPRPLLGPLENVPVVQIAAGYCYLLALACQPNGMSVYSVGCGLGGKLGHGSRTDEKYPRVIEQFQILNLQPRVVAAGAWHAAVVGQDGRVCTWGWGRYGCLGHGNEECESVPKVVEGLSHVKAVHVATGDYTTFVVSDDGDVYSFGCGESASLGHHPSFDEQGNRHANVLSPTVVTSLKQVNERMVQISLTNSIYWNAHTFALTESGKLFAFGAGDQGQLGTELGKNQKERCVPEKVDIDLS

SEQ ID NO: 2546 - protein, 220 aa, Glycine max; identical to SEQ ID NO: 1756

SEQ ID NO: 2547 - protein, 258 aa, Arabidopsis thaliana
MRMLVLRTPTGPVSAVRFITKSKPSPFSSPDSWLLPAPNTHRSRPRVVLALSNPDGSVNSKPSTSASQIPSSGDETVFVGQENVPLEGVIQFDKPSSTSSSNITKWGRVALLAGGDVLALLIFSAIGRFSHGFPVFSIDTLHTADPFIAGWFLSAYFLGGYAEEGRGMKGKSKAVVAAAKSWIVGTPLGIIIRSASSGHIPAYSFVLVTMGSTAVLLIGWRALLFSVLPTESKKKDDTYRKGSAFELFELLTSLIRRW

SEQ ID NO: 2548 - protein, 340 aa, Triticum aestivum; identical to SEQ ID NO: 1771

SEQ ID NO: 2549 - protein, 529 aa, Sorghum bicolor; identical to SEQ ID NO: 267

SEQ ID NO: 2550 - protein, 1451 aa, Arabidopsis thaliana
MGRLKLHSGIKAIEEEPEDFECTDSSNTTTLACMIDTEIAAVLAVMRRNVRWGGRYMSGDDQLEHSLIQSLKALRKQVFSWNQPWHTISPMLYLQPFLDVIRSDETGAPITSIALSSVYKILNLNVIDQNTANIEDAMHLVVDSVTSCRFEVTDPASEEVVLMKILQVLLACMKNKASVMLSNQHVCTVVNTCFRVVHQAGMKGELLQRVARHTMHELVRCIFSHLPDVERTETTLVNRAGSIKQEKAGVDSDYAIVSKPVEDGNANSEYDVENSMATFATGAQSLMDDGPVGPGSRKPASPYDLHIMTEPYGVPSMVEIFHFLCSLLNVVEHVGMGSRSNTIAFDEDVPLFALNLINSAIELGGSSIRHHPRLLSLIQDELFRNLMQFGLSMSPLILSMVCSIVLNLYQHLRTELKLQLEAFFSCVILRLAQGKYGPSYQQQEVAMEALVNFCRQKSFMVEMYANLDCDITCSNVFEELSNLLSKSTFPVNCPLSAMHILALDGLIAVIQGMAERISNGLTGLDLGPVHLDEYTPFWMVKCDNYSDPNHWVSFVRRRKYIKRRLMIGADHFNRDPKKGLEFLQGTHLLPDKLDPQSVACFFRYTAGLDKNLVGDFLGNHDEFCVQVLNEFAGTFDFQYMNLDTALRLFLETFRLPGESQKIQRVLEAFSERYYMQSPEILANKDAALVLSYSIIMLNTDQHNVQVKKKMTEEDFIRNNRHINGGNDLPREFLSELFHSICNNEIRTTPEQGAGFPEMTPSRWIDLMHKSKKTAPYILADSRAYLDHDMFAIMSGPTIAAISVVFDHAEHEDVYQTCIDGFLAIAKISACHHLEDVLDDLVVSLCKFTTLLNPSSVDEPVLAFGDDAKARMATITIFTIANKYGDYIRTGWRNILDCILRLHKLGLLPARVASDAADESEHSSEQGQGKPLANSLSSAHLQSMGTPRRSSGLMGRFSQLLSLDTEEPRSQPTEQQLAAHQRTLQTIQKCHIDSIFTESKFLQAESLLQLARALIWAAGRPQKGTSSPEDEDTAVFCLELLIAITLNNRDRIVLLWQGVYEHIATIAQSTVMPCNLVDKAIFGLLRICQRLLPYKESLADELLRSLQLVLKLDARVADAYCEQIAIEVSRLVKANANHIRSQAGWRTITSLLSITARHPEASESGFDAVSFVMSEGTHLYPANYVLCVDAARQFAESRVGQSERSIRALDLMGDSLEYLAKWALSAKENMGEEDYGKMSQDIGEMWLRLVQGLRKVCLDQREDVRNHALQSLQKCLGGVDGINLAHSMWSQCFDKVIFTVLDDLLEIAAGSQKDYRNMEGTLLLAIKLLSKVFLQQLQELSQLSTFCKLWLGVLTRMEKYMKVKVRGKKSDKLQESVPELLKNILLVMKTKGVLLQRSALGGDSLWELTWLHVNNIAPSMRLELFPDQESTQLGDDETVSNGLSSPENTTGS

SEQ ID NO: 2551 - protein, 471 aa, Arabidopsis thaliana
MMEALLYVITLFSLSALTVTLGESISIDCGSTGSYVDSNNVTWVGDKGFVTNGEPMKIPDVVKKPINTLRYFPTGQTNCYTNIPVTKGQKTLVRTKFYYENYDAKFSPPSFDVIYDGKHRDSIVITESLLNDEETFYFSEVIYVPENKNISVCLLRTSPSDNPFISSIEVYSLDTGMYDDLGPNEGLILHDRIAYGAKELISYPLDPYGRVWLALGSQDSTLTDLTTSAPSIDITGASNKPPEIAMSKALSGVGLVLSDQTLPLTGVPVYLVLYFSEPQSLGRTQRRSFNVFLDNTQVGSRPIVPVFGKATQFILRDVVATSASQIVFQSTDDSVLPPLINGLELYSISNTSPDSGGGGGDQGGGSTDDSEGSGGAKQAKNLGKGGAKSSGGKKNNKLPLILGVTFASAFAVLASAFAAIWKKRQNAKSQSNSTVPNTSTEHGTGTGMSPLVGQQFASDMTDSYVVEDGHH

SEQ ID NO: 2552 - protein, 386 aa, Gossypium hirsutum
MGKKLAAFLGRGFKPSKFKSLVTLAISRLAVFKNQRQIRCNQARSDVVQLLQLSHHDRALLRVDQVIKEQNMLDVFVILEGYCNLVIERLHLIEQDRVCPDELNEAITGLLFASSRCGDFPELLEIRAVFTSHYGKEFAARAIELRNNCGVNAKIIQKLSTRQPDLQSRRNVLNQIAAEYGIALQLEETTDSSEGNLDVSKKQETSIKASHDAGDDDEFSDSIKTRRKYRDVADAAQAAFESAAYAAAAARAAVELSRSDSYDPDDQNGPNTRQNTVSDKQEANSKDMENHGSQAVELNHTKKIPEIKMSSPSSSEGSAEEIIDLRTMSFNEVDPLKLLEKEVVIYESDDDKYDSRGSSFDLNARKLKGKVLNTDNGGEHSEKKLD

SEQ ID NO: 2553 - protein, 459 aa, Gossypium hirsutum
MGKKLDALLGRGFKPYKLKSVISVALSRLSVFKNQRQIRSNQARSDVVQLLQLGHHDRALLRAEQVVKEKNMLDVFVILEGYCNLLIERLHLIEQDRECPDELKEAISGLLFASSRCGDFPELQEIRAIFTSRYGKEFVARAIELRNNCGVNTKIIQKLSTKQPDLQSRWNVLNEIAAEHSIALQLRETSVSATLENLDGSKNHSQPKLGTIGKASNHAVLVDDNEFSDSTKARKKYKDVADAAQAAFESAANAAAAARAAVELSRSDFHDPDDDDDDDDDQNSPNSQRKRVLERQEPNSEDKETQQGNQAEDLKQTPEIKISSPSSSKDSSQGNLDIRTVSLDDVDPIKLLEKEVVIHESDDENYDSHDSSFHMNTSMFKVRAQDEDKNYECTEKTALMFQNSSDKQIPSSLRAGLKVEAVPENPTEHVAQSSGTKGKRPFTINKAPFSVRTRQVRGY

SEQ ID NO: 2554 - protein, 561 aa, Hordeum vulgare
MVGRSSLPDGALFLGLDSSTQSVKATVLSNELIIVASETVNFDSELPHYKTEGGVYRDPTDDGRIYSPTIMWVEALELLLEKLKPKINFSRVVAVSGSGQQHGSVYWKKGSQAVLSSLDPGKSLVSQLKDAFSTMDSPIWMDSSTTKQCREIENAVGGALELSKLTGSRAYERFTGPQIRKIYQTAPHIYENTERISLVSSFMASILVGCYASIDETDGAGMNLMDINKRTWSKVVLEATAPDLEQKLGNLAPAYAAAGRISSYFVERHQFDKNCLVIQWSGDNPNSLAGLTLNTPGDLAISLGTSDTVFGITAEAKPSLEGHVFPNPVEPDGYMVMLCYKNGSLTREDVRNQCAEKSWDIFNSYLEKTPPLNGGRLGFYYKDHEILPPLPVGFHRYIVENFNDASSENLTEREVQEFDPQSEVRAIVEGQMLSMRGHAERFGMPNPPKRIIATGGASSNESILKLIAQIFGCPVFTVERPDSASLGAALRAAHGWLCKEEGGFVPISRMYVGNLEKTSLGAKLAVPAPEEEGRELLKKYTALTRKRMEIERRLVEKIGRA

SEQ ID NO: 2555 - protein, 151 aa, Oryza sativa
MSGRKKTREPKEENVTLGPTVREGEYVFGVAHIFASFNDTFIHVTDLSGRETLVHITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 2556 - protein, 496 aa, Oryza sativa
MAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 2557 - protein, 360 aa, Oryza sativa
MEVTPNHTQTVSGWAAMDESGKIVPFVFKRRENGVDDVTIKVKYCGMCHTDLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGLVGLGGLGHVAVKFGKAFGLHVTVISTSPAKEREARENLKADNFVVSTDQKQMQAMTRSLDYIIDTVAATHSLGPILELLKVNGKLVLVGAPEKPVELPSFPLIFGKRTVSGSMTGGMKETQEMMDICGEHNITCDIEIVSTDRINDALARLARNDVRYRFVINVGGDSKL

SEQ ID NO: 2558 - protein, 316 aa, Arabidopsis thaliana
MAKTEAPSLVGKLETEVEIKASAGQFHHMFAGKPHHVSKASPGNIQSCDLHEGDWGTVGSIVFWNYVHDGEAKVAKERIEAVEPEKNLITFRVIEGDLMKEYKSFLITIQVTPKHGGPGSIVHWHLEYEKISDEVAHPETLLQFCVEVSQEIDEHLLSEEEEVKSTETLETEVEIKASAEKFHHMFAGKPHHVSKATPGNIQSCDLHEGDWGTVGSIVFWNYVHDGEAKVAKERIEAVYPEKNLITFRVIEGDLMKEYKSFVITIQVTPKHGGSGSVVHWHFEYEKINEEVAHPETLLQFAVEVSKEIDEHLLAEE

SEQ ID NO: 2559 - protein, 432 aa, Arabidopsis thaliana
MASEDLNIVAESKKGEENVIVDNSKDMNRPENLDLSTEKTDTANENGPKDEASKLVKEADLPESGTSVKSKTAKDNKPVKRKSGTFSRSPRFMSQSSSFPTKGAYTDITRKSIDATTSKTSLKPVVAGGSKPKATPSSSSGVSAKRTSLVSAPLKKQTMPVKTISKDAASGPTSKLGDEGSKSIKEETAGKDVEEAGSTTAVVADKVSNPLKAEMASKDDEDTRSTTTSTSTPRGRRSSVGSASGFSFRLEERAEKRKEFYMKLEEKIHAKEVEKTNLQAKSKESQEEEIKRLRKSLTFKAGPMPSFYKEPPPKVELKKIPTTRPKSPKLGRRKSSSDATGGEAAPRVTKPKDSSSSTVKKPITKSQPKLETQEKSVKAKEKKKEVKKEEAEKRGEEEKATAVAAKPEEQKPNSNNIQVKAEIMASEVVVGG

SEQ ID NO: 2560 - protein, 276 aa, Sorghum bicolor
MVGPGLYAEIGKKTKDLLYKDYQTDHKFTLTTYTSNGVAVTASSTKKADLIFGEIQSQIKNKNITVDVKANSESNIITTVTVDEIATPGLKTILSFAVPDQRSGKVELQYLHDYAGVNASIGLTANPVVNLSAAFGTKALAVGADVSLDTATGNLTKYNAGLRFTHEDLIASLSLNNRGDSLTGAYYHKVSELTNTAVGAELTHSFSTNENTVTFGGQHALDPLTVLKARINNSGKASALIQHEWRPKSLVTISAEVDTKTIEKSSKVGIAVALKP

SEQ ID NO: 2561 - protein, 277 aa, Sorghum bicolor; identical to SEQ ID NO: 269

SEQ ID NO: 2562 - protein, 753 aa, Arabidopsis thaliana
MVSVGSKSLPSRRHRTIEEDSLMGERGKSSNNHSERNKGMRRKDHKGNRGFDGDSSKKNQSGGAPNVKPASKKHSEFEHQNQFVRKEIDPETSKYFSEIANLFDSNEVELEERSVICGNVLEETRGREYEIATDYIISHVLQTLLEGCELDQLCSFIRNSASVFPAIAMDRSGSHVTESALKSLATHLENPDAYSVIEEALHSICKVIVDNPLDMMCNCYGSHVLRRLLCLCKGVSLDSPELYGAKSSKALAKRLNLKMSQLDDNNLEIPHQGFPGMLTYLLSGLLSCSREDMKYLQVDQYSSLVLQTALRLMLKQDEQLLEIIPLILRCNSTNKKVEGFHIETNVAKEILESMKDNSFSHLVEVILEVAPESLYNEMFNKVFKNSLFELSVDRCANFVIQALISHARDQEQMGIMWEELAPRFKDLLEQGKSGVVASLIAVSQRLQSHENKCCEALVGAVCSTNESRISILPRLLFLDYYFGCRDKSTWEWAPGAKMHVMGCLILQGIFKFSSDHIQPYITSLTSMKAEYITETAKDSSGARVIEAFLASDAATKQKRRLIIKLRGHFGELSLHTSGSFTVEKCFDACNLTLREAIASELLDVKVDLSKTKQGPYLLRKLDIDGYASRPDQWKSRQEAKQSTYNEFCSAFGSNKSNFPKNTFVSDASEDAAQEIEVKNTRKEIDHHPTSGFKRHREKHAKDKDEPFAGEKRSKQKKNKTSEATDKPKLAGSKRPFLSGEMTGKNRHSNKMRI

SEQ ID NO: 2563 - protein, 199 aa, Sorghum bicolor
MAAEAGKTAATKSGGGQIMTVVRGLDVARYMGRWYEIASFPSFFQPRDGRDTRATYRLLEDGATVHVLNETWSKGKRDYIEGTAYKADPNSDEAKLKVKFYLPPFLPVIPVVGDYWVLYVDDDYQYALVGEPRRKNLWILCRKTSIDEEVYNQLVERAKEEGYDVSKLHRTPQDDPPPESDAAPTDTKGVWWFKSLFGK

SEQ ID NO: 2564 - DNA, 32 bp, Artificial sequence
  Single strand DNA oligonucleotide
ttagtcgacagagaagaggcaagaacaactag

SEQ ID NO: 2565 - DNA, 29 bp, Artificial sequence
  Single strand DNA oligonucleotide
tatctagacgatcggtgtccactgtacag

SEQ ID NO: 2566 - DNA, 28 bp, Artificial sequence
  Single strand DNA oligonucleotide
ttagtcgacactagctgcatggcaatgg

SEQ ID NO: 2567 - DNA, 28 bp, Artificial sequence
  Single strand DNA oligonucleotide
ttagtcgacactagctgcatggcaatgg

SEQ ID NO: 2568 - DNA, 29 bp, Artificial sequence
  Single strand DNA oligonucleotide
ttagtcgacctcgaaatccttcccaagac

SEQ ID NO: 2569 - DNA, 34 bp, Artificial sequence
  Single strand DNA oligonucleotide
tatctagagtcacagaatagtacacgtacacaac

SEQ ID NO: 2570 - DNA, 27 bp, Artificial sequence
  Single strand DNA oligonucleotide
ttagtcgaccgcacgcttctccatttc

SEQ ID NO: 2571 - DNA, 33 bp, Artificial sequence
  Single strand DNA oligonucleotide
tatctagatcaaactaagtactccagtaacaac

SEQ ID NO: 2572 - DNA, 30 bp, Artificial sequence
  Single strand DNA oligonucleotide
aaagtcgaccctctctctcgtttcgattcc

SEQ ID NO: 2573 - DNA, 30 bp, Artificial sequence
  Single strand DNA oligonucleotide
attctagatcaaccacatagcctagagcac

SEQ ID NO: 2574 - DNA, 29 bp, Artificial sequence
  Single strand DNA oligonucleotide
aaagtcgacagattcgatccaaccaaacc

SEQ ID NO: 2575 - DNA, 30 bp, Artificial sequence
  Single strand DNA oligonucleotide
actctagaactctattaacaatgcacggag

SEQ ID NO: 2576 - DNA, 30 bp, Artificial sequence
  Single strand DNA oligonucleotide
aaagtcgacaattcttctttgtttgcttgc

SEQ ID NO: 2577 - DNA, 31 bp, Artificial sequence
  Single strand DNA oligonucleotide
attctagataaatgctgatataggacaaagc

SEQ ID NO: 2578 - DNA, 30 bp, Artificial sequence
  Single strand DNA oligonucleotide
aaagtcgacgaagaaaacccacaaaaccag

SEQ ID NO: 2579 - DNA, 31 bp, Artificial sequence
  Single strand DNA oligonucleotide
attctagatcacaatagaaacatcctccctc

SEQ ID NO: 2580 - DNA, 32 bp, Artificial sequence
  Single strand DNA oligonucleotide
tatctagagagaagagagagactttgaagatg

SEQ ID NO: 2581 - DNA, 31 bp, Artificial sequence
  Single strand DNA oligonucleotide
tgagctcttaagagtagacacaactcctgcg

SEQ ID NO: 2582 - DNA, 32 bp, Artificial sequence
  Single strand DNA oligonucleotide
ttagtcgactgaagatggaagcaaactctaac

SEQ ID NO: 2583 - DNA, 33 bp, Artificial sequence
  Single strand DNA oligonucleotide
tgagctcttattaggaagcaacttcaagaaatg

SEQ ID NO: 2584 - DNA, 28 bp, Artificial sequence
  Single strand DNA oligonucleotide
atgatatccctccaacctctctcccaac

SEQ ID NO: 2585 - DNA, 33 bp, Artificial sequence
  Single strand DNA oligonucleotide
tagatatcgattgcttcttgtactctgatcatc

SEQ ID NO: 2586 - DNA, 30 bp, Artificial sequence
  Single strand DNA oligonucleotide
atgatatccaagaattaaggtgtagcaacc

SEQ ID NO: 2587 - DNA, 31 bp, Artificial sequence
  Single strand DNA oligonucleotide
tagatatctcatcatttgatcagctttagcg

SEQ ID NO: 2588 - DNA, 30 bp, Artificial sequence
  Single strand DNA oligonucleotide
tatgtcgacacaaggaaatgatggctattg

SEQ ID NO: 2589 - DNA, 30 bp, Artificial sequence
  Single strand DNA oligonucleotide
tatctagacaccacaacatgatagcttttg

SEQ ID NO: 2590 - DNA, 28 bp, Artificial sequence
  Single strand DNA oligonucleotide
aaggtcgacctgggagctagctttggag

SEQ ID NO: 2591 - DNA, 30 bp, Artificial sequence
  Single strand DNA oligonucleotide
actctagatcacaccgattccacacataac

SEQ ID NO: 2592 - DNA, 28 bp, Artificial sequence
  Single strand DNA oligonucleotide
aaggtcgacctgggagctagctttggag

SEQ ID NO: 2593 - DNA, 32 bp, Artificial sequence
  Single strand DNA oligonucleotide
cgtctagatcagatcgtgttgagcacttgagc

SEQ ID NO: 2594 - DNA, 27 bp, Artificial sequence
  Single strand DNA oligonucleotide
tcccgggctccgtctctagggtttgag

SEQ ID NO: 2595 - DNA, 32 bp, Artificial sequence
  Single strand DNA oligonucleotide
tgagctctcagtgattggaactctagatcttg

SEQ ID NO: 2596 - DNA, 29 bp, Artificial sequence
  Single strand DNA oligonucleotide
tatctagacttgagctagggttttatcgc

SEQ ID NO: 2597 - DNA, 31 bp, Artificial sequence
  Single strand DNA oligonucleotide
tgagctcttaatgcagacggtaacatctagg

SEQ ID NO: 2598 - DNA, 32 bp, Artificial sequence
  Single strand DNA oligonucleotide
tatctagaaacaatgtccgggaggaagaagac

SEQ ID NO: 2599 - DNA, 31 bp, Artificial sequence
  Single strand DNA oligonucleotide
tgagctcttatgaagattacagcctcctacc

SEQ ID NO: 2600 - DNA, 30 bp, Artificial sequence
  Single strand DNA oligonucleotide
agagtcgacgtgacataaaatccatggctg

SEQ ID NO: 2601 - DNA, 31 bp, Artificial sequence
  Single strand DNA oligonucleotide
tatctagatcagcttacacaagcccttagca

SEQ ID NO: 2602 - DNA, 28 bp, Artificial sequence
  Single strand DNA oligonucleotide
gaggtcgacaatccatggctgaagcttg

SEQ ID NO: 2603 - DNA, 32 bp, Artificial sequence
  Single strand DNA oligonucleotide
acctctagatcattaagtggctttccaggaag

SEQ ID NO: 2604 - DNA, 27 bp, Artificial sequence
  Single strand DNA oligonucleotide
agagtcgaccgcaacggaaaacaaatc

SEQ ID NO: 2605 - DNA, 30 bp, Artificial sequence
  Single strand DNA oligonucleotide
tatctagaagataggcttatctcaatggct

SEQ ID NO: 2606 - DNA, 28 bp, Artificial sequence
  Single strand DNA oligonucleotide
taggtcgacacaaatccgccaatggaag

SEQ ID NO: 2607 - DNA, 37 bp, Artificial sequence
  Single strand DNA oligonucleotide
tatctagatcatgttcactgagtaacgatactaacag

SEQ ID NO: 2608 - DNA, 29 bp, Artificial sequence
  Single strand DNA oligonucleotide
taggtcgacgagagaaatccatggagacg

SEQ ID NO: 2609 - DNA, 30 bp, Artificial sequence
  Single strand DNA oligonucleotide
cgagctcaatttcagtacaggatttaaacc

SEQ ID NO: 2610 - DNA, 28 bp, Artificial sequence
  Single strand DNA oligonucleotide
acccgggagacgatgacgatgaaggttg

SEQ ID NO: 2611 - DNA, 32 bp, Artificial sequence
  Single strand DNA oligonucleotide
cgagctctcagtacaggatttaaaccaagaca

SEQ ID NO: 2612 - DNA, 26 bp, Artificial sequence
  Single strand DNA oligonucleotide
aagatatcccaaacaccaaaccctcg

SEQ ID NO: 2613 - DNA, 35 bp, Artificial sequence
  Single strand DNA oligonucleotide
tagatatctcatcatattcctagcttatcaacctc

SEQ ID NO: 2614 - DNA, 31 bp, Artificial sequence
  Single strand DNA oligonucleotide
aaagtcgaccgatttctgcttcgatctctac

SEQ ID NO: 2615 - DNA, 30 bp, Artificial sequence
  Single strand DNA oligonucleotide
attctagaccttcttcgatcttcttgaacc

SEQ ID NO: 2616 - DNA, 31 bp, Artificial sequence
  Single strand DNA oligonucleotide
aaagtcgacgtctgggtcgaagttaaatagg

SEQ ID NO: 2617 - DNA, 31 bp, Artificial sequence
  Single strand DNA oligonucleotide
attctagattagtttgcagttatcgcagtgg

SEQ ID NO: 2618 - DNA, 29 bp, Artificial sequence
  Single strand DNA oligonucleotide
aaagtcgacgttccattggaggagaatcg

SEQ ID NO: 2619 - DNA, 29 bp, Artificial sequence
  Single strand DNA oligonucleotide
attctagattcaaaaggaaaatggagagg

SEQ ID NO: 2620 - DNA, 28 bp, Artificial sequence
  Single strand DNA oligonucleotide
aaagtcgacaaaggcttggaaaggaagg

SEQ ID NO: 2621 - DNA, 33 bp, Artificial sequence
  Single strand DNA oligonucleotide
attctagattatttcaaacatgaaatgagttgc

SEQ ID NO: 2622 - DNA, 26 bp, Artificial sequence
  Single strand DNA oligonucleotide
agagctcaaccctaacgtttcgatcg

SEQ ID NO: 2623 - DNA, 28 bp, Artificial sequence
  Single strand DNA oligonucleotide
tgagctcttccagaagtagcatctttcg

SEQ ID NO: 2624 - DNA, 28 bp, Artificial sequence
  Single strand DNA oligonucleotide
aatgtcgacgaagcgtctgagccagtcc

SEQ ID NO: 2625 - DNA, 29 bp, Artificial sequence
  Single strand DNA oligonucleotide
tgagctctggccttcaccctctatatctc

SEQ ID NO: 2626 - DNA, 28 bp, Artificial sequence
  Single strand DNA oligonucleotide
attgtcgacgagtatgctttccgatggg

SEQ ID NO: 2627 - DNA, 32 bp, Artificial sequence
  Single strand DNA oligonucleotide
tttctagactatgaatgaatccgtgactcttg

SEQ ID NO: 2628 - DNA, 30 bp, Artificial sequence
  Single strand DNA oligonucleotide
attgtcgaccacgaccattcttcattttcc

SEQ ID NO: 2629 - DNA, 31 bp, Artificial sequence
  Single strand DNA oligonucleotide
tcccgggttagaactgagtctgaaaggatgg

SEQ ID NO: 2630 - DNA, 33 bp, Artificial sequence
  Single strand DNA oligonucleotide
aatgtcgacgtcctaatactatactcgcaatcc

SEQ ID NO: 2631 - DNA, 32 bp, Artificial sequence
  Single strand DNA oligonucleotide
aatctagatcaaccaactagtttgcagctcct

SEQ ID NO: 2632 - DNA, 30 bp, Artificial sequence
  Single strand DNA oligonucleotide
taagtcgaccaaacaacatgtctgcctgtg

SEQ ID NO: 2633 - DNA, 32 bp, Artificial sequence
  Single strand DNA oligonucleotide
attctagattaacacatcgtttggtgcatagc

SEQ ID NO: 2634 - DNA, 30 bp, Artificial sequence
  Single strand DNA oligonucleotide
aatgtcgacgttgatcagtcagcccacttc

SEQ ID NO: 2635 - DNA, 29 bp, Artificial sequence
  Single strand DNA oligonucleotide
tatctagagacataatccatcaacggttg

SEQ ID NO: 2636 - DNA, 28 bp, Artificial sequence
  Single strand DNA oligonucleotide
aatctagactcacgaatccaccgatcag

SEQ ID NO: 2637 - DNA, 29 bp, Artificial sequence
  Single strand DNA oligonucleotide
tcccgggacacacatcatggctgttacag

SEQ ID NO: 2638 - DNA, 28 bp, Artificial sequence
  Single strand DNA oligonucleotide
aatctagagacacggaccgaacagctag

SEQ ID NO: 2639 - DNA, 29 bp, Artificial sequence
  Single strand DNA oligonucleotide
tcccgggcgacttcatatacagacggatg

SEQ ID NO: 2640 - DNA, 29 bp, Artificial sequence
  Single strand DNA oligonucleotide
aatctagagattaggagcagggaccaatc

SEQ ID NO: 2641 - DNA, 32 bp, Artificial sequence
  Single strand DNA oligonucleotide
tgagctcttaggtacatgatgacatttcagca

SEQ ID NO: 2642 - DNA, 29 bp, Artificial sequence
  Single strand DNA oligonucleotide
aatctagacctattgctcatgatgtttga

SEQ ID NO: 2643 - DNA, 31 bp, Artificial sequence
  Single strand DNA oligonucleotide
tgagctcttacaaaggcaggaaatacagaag

SEQ ID NO: 2644 - DNA, 29 bp, Artificial sequence
  Single strand DNA oligonucleotide
tatctagaaatttagctcgttgatgatgg

SEQ ID NO: 2645 - DNA, 30 bp, Artificial sequence
  Single strand DNA oligonucleotide
tgagctcctagtgtccatgtcaatgatgtc

SEQ ID NO: 2646 - DNA, 28 bp, Artificial sequence
  Single strand DNA oligonucleotide
tatctagatagctcgttgatgatggagg

SEQ ID NO: 2647 - DNA, 31 bp, Artificial sequence
  Single strand DNA oligonucleotide
tgagctcttatccatgtcaatgatgtccatc

SEQ ID NO: 2648 - DNA, 31 bp, Artificial sequence
  Single strand DNA oligonucleotide
aaagtcgacgctactgcttcttctgttcacc

SEQ ID NO: 2649 - DNA, 34 bp, Artificial sequence
  Single strand DNA oligonucleotide
tgagctctactaccatagaactgaagaagaagtc

SEQ ID NO: 2650 - DNA, 30 bp, Artificial sequence
  Single strand DNA oligonucleotide
ttagtcgactagactgatgggaagtgttcc

SEQ ID NO: 2651 - DNA, 30 bp, Artificial sequence
  Single strand DNA oligonucleotide
tatctagactactacacggattgcccaaac

SEQ ID NO: 2652 - DNA, 30 bp, Artificial sequence
  Single strand DNA oligonucleotide
aatctagagtttatcttgttttgggtttgg

SEQ ID NO: 2653 - DNA, 29 bp, Artificial sequence
  Single strand DNA oligonucleotide
tcccggggtgaaagatctcagaccacctc

SEQ ID NO: 2654 - DNA, 29 bp, Artificial sequence
  Single strand DNA oligonucleotide
tatctagacttcttcctccatatcacacg

SEQ ID NO: 2655 - DNA, 28 bp, Artificial sequence
  Single strand DNA oligonucleotide
tcccgggtcacgtggcatgcatgatctg

SEQ ID NO: 2656 - DNA, 30 bp, Artificial sequence
  Single strand DNA oligonucleotide
tatctagaaacaatggatggggaggaggac

SEQ ID NO: 2657 - DNA, 29 bp, Artificial sequence
  Single strand DNA oligonucleotide
tcccgggtcatcactcgctctcgaattcc

SEQ ID NO: 2658 - DNA, 28 bp, Artificial sequence
  Single strand DNA oligonucleotide
tatctagacacgaatcaacccaccagag

SEQ ID NO: 2659 - DNA, 31 bp, Artificial sequence
  Single strand DNA oligonucleotide
tgagctctcaatgccgatcatcagtgctaag

SEQ ID NO: 2660 - DNA, 32 bp, Artificial sequence
  Single strand DNA oligonucleotide
tatctagaaacaatgccttgggtttatcatcc

SEQ ID NO: 2661 - DNA, 30 bp, Artificial sequence
  Single strand DNA oligonucleotide
tgagctctcatcagaaccggaagaagttgg

SEQ ID NO: 2662 - DNA, 27 bp, Artificial sequence
  Single strand DNA oligonucleotide
tatctagaattgagcagaggagccatg

SEQ ID NO: 2663 - DNA, 28 bp, Artificial sequence
  Single strand DNA oligonucleotide
tgagctcctacacagggtgccagatctc

SEQ ID NO: 2664 - DNA, 26 bp, Artificial sequence
  Single strand DNA oligonucleotide
tatctagaggagccatggccaaaatc

SEQ ID NO: 2665 - DNA, 33 bp, Artificial sequence
  Single strand DNA oligonucleotide
tgagctcttaagtgcaagttgtcaatcctattg

SEQ ID NO: 2666 - DNA, 29 bp, Artificial sequence
  Single strand DNA oligonucleotide
aatctagagatgatggtttgatgcagatg

SEQ ID NO: 2667 - DNA, 33 bp, Artificial sequence
  Single strand DNA oligonucleotide
tcccgggctaacgtagtttcttaccaaccaaac

SEQ ID NO: 2668 - DNA, 31 bp, Artificial sequence
  Single strand DNA oligonucleotide
aatgtcgacgagagaagggtgtaatgagctg

SEQ ID NO: 2669 - DNA, 32 bp, Artificial sequence
  Single strand DNA oligonucleotide
tatctagatcatcagtaggggttcctatgtgg

SEQ ID NO: 2670 - DNA, 31 bp, Artificial sequence
  Single strand DNA oligonucleotide
aaagtcgaccaagaggtagcacatcctctcc

SEQ ID NO: 2671 - DNA, 30 bp, Artificial sequence
  Single strand DNA oligonucleotide
attctagaccggattgaactaattaacgac

SEQ ID NO: 2672 - DNA, 31 bp, Artificial sequence
  Single strand DNA oligonucleotide
aaagtcgacaggaagattgtgagcattgaag

SEQ ID NO: 2673 - DNA, 32 bp, Artificial sequence
  Single strand DNA oligonucleotide
attctagacacctaatgatctcacttgtaagg

SEQ ID NO: 2674 - DNA, 28 bp, Artificial sequence
  Single strand DNA oligonucleotide
ttagtcgacagccttgccttgtttcttc

SEQ ID NO: 2675 - DNA, 30 bp, Artificial sequence
  Single strand DNA oligonucleotide
tcccgggcaacttatacactcaaccaaagc

SEQ ID NO: 2676 - DNA, 33 bp, Artificial sequence
  Single strand DNA oligonucleotide
ttagtcgaccatacacacacagtgagaggtagg

SEQ ID NO: 2677 - DNA, 28 bp, Artificial sequence
  Single strand DNA oligonucleotide
tcccgggctttcatccatgtgtgcagtg

SEQ ID NO: 2678 - DNA, 27 bp, Artificial sequence
  Single strand DNA oligonucleotide
aatctagaagaaacccagaggagcagc

SEQ ID NO: 2679 - DNA, 29 bp, Artificial sequence
  Single strand DNA oligonucleotide
cgagctcaagggattattattgcaggttg

SEQ ID NO: 2680 - DNA, 28 bp, Artificial sequence
  Single strand DNA oligonucleotide
aatctagagaagcaggaaggaagcagag

SEQ ID NO: 2681 - DNA, 30 bp, Artificial sequence
  Single strand DNA oligonucleotide
tgagctcctacttctaggccttgttgctgc

SEQ ID NO: 2682 - DNA, 30 bp, Artificial sequence
  Single strand DNA oligonucleotide
aatctagagataacatcagtagttcgcagc

SEQ ID NO: 2683 - DNA, 29 bp, Artificial sequence
  Single strand DNA oligonucleotide
cgagctcaacacactcacaccaaaagtcc

SEQ ID NO: 2684 - DNA, 29 bp, Artificial sequence
  Single strand DNA oligonucleotide
attctagatcacagcaacacaatcaccac

SEQ ID NO: 2685 - DNA, 29 bp, Artificial sequence
  Single strand DNA oligonucleotide
tgagctccactgctactgaaggcaaattc

SEQ ID NO: 2686 - DNA, 30 bp, Artificial sequence
  Single strand DNA oligonucleotide
attctagattttcctggattttgttttctc

SEQ ID NO: 2687 - DNA, 30 bp, Artificial sequence
  Single strand DNA oligonucleotide
tgagctctcaattaaagagttaccctaacg

SEQ ID NO: 2688 - DNA, 28 bp, Artificial sequence
  Single strand DNA oligonucleotide
attctagagatttggggaaaagctatgg

SEQ ID NO: 2689 - DNA, 32 bp, Artificial sequence
  Single strand DNA oligonucleotide
tgagctcctacttgagccttctagctctgttc

SEQ ID NO: 2690 - DNA, 35 bp, Artificial sequence
  Single strand DNA oligonucleotide
tacgtcgacttcacatgtcttgactagttcatatg

SEQ ID NO: 2691 - DNA, 32 bp, Artificial sequence
  Single strand DNA oligonucleotide
taagtcgacacgatacattcaatacaatcacc

SEQ ID NO: 2692 - DNA, 29 bp, Artificial sequence
  Single strand DNA oligonucleotide
ttagtcgaccttccatcatgctcccaaag

SEQ ID NO: 2693 - DNA, 32 bp, Artificial sequence
  Single strand DNA oligonucleotide
taagtcgactcaactcagcatcacgtctcagc

SEQ ID NO: 2694 - DNA, 31 bp, Artificial sequence
  Single strand DNA oligonucleotide
aatgtcgactcgtttctcctctaacgtcaac

SEQ ID NO: 2695 - DNA, 29 bp, Artificial sequence
  Single strand DNA oligonucleotide
tcccgggtcagcagctctctgtctgttac

SEQ ID NO: 2696 - DNA, 31 bp, Artificial sequence
  Single strand DNA oligonucleotide
atagtcgacgtttaacatagttggggctagg

SEQ ID NO: 2697 - DNA, 29 bp, Artificial sequence
  Single strand DNA oligonucleotide
ccccgggataagccaggagatgaaaggag

SEQ ID NO: 2698 - DNA, 30 bp, Artificial sequence
  Single strand DNA oligonucleotide
aaagtcgacgatcgaaaagagaagaggagc

SEQ ID NO: 2699 - DNA, 29 bp, Artificial sequence
  Single strand DNA oligonucleotide
attctagactaatctctctccctccctcc

SEQ ID NO: 2700 - DNA, 31 bp, Artificial sequence
  Single strand DNA oligonucleotide
attctagaatttacacagacttgtcgctctc

SEQ ID NO: 2701 - DNA, 31 bp, Artificial sequence
  Single strand DNA oligonucleotide
tatctagacttctgattcagtgactgtgagc

SEQ ID NO: 2702 - DNA, 30 bp, Artificial sequence
  Single strand DNA oligonucleotide
atagtcgacaacaatggacaaattttggac

SEQ ID NO: 2703 - DNA, 31 bp, Artificial sequence
  Single strand DNA oligonucleotide
tatctagatcatcagtgactgtgagcctcgt

SEQ ID NO: 2704 - DNA, 30 bp, Artificial sequence
  Single strand DNA oligonucleotide
aatctagactgaaagagagagaggtatggc

SEQ ID NO: 2705 - DNA, 30 bp, Artificial sequence
  Single strand DNA oligonucleotide
tgagctctgaattagtcatctattgggtcc

SEQ ID NO: 2706 - DNA, 31 bp, Artificial sequence
  Single strand DNA oligonucleotide
tatctagaaacaatggcaggtgaggcaactc

SEQ ID NO: 2707 - DNA, 33 bp, Artificial sequence
  Single strand DNA oligonucleotide
tgagctcttattagtcatctattgggtcctgag

SEQ ID NO: 2708 - DNA, 30 bp, Artificial sequence
  Single strand DNA oligonucleotide
aatgtcgactttgtgatgacccttttaagg

SEQ ID NO: 2709 - DNA, 29 bp, Artificial sequence
  Single strand DNA oligonucleotide
attctagaggtagttagccggtcatgttg

SEQ ID NO: 2710 - DNA, 32 bp, Artificial sequence
  Single strand DNA oligonucleotide
aatgtcgacaacaatggattgggaaaaacagc

SEQ ID NO: 2711 - DNA, 32 bp, Artificial sequence
  Single strand DNA oligonucleotide
attctagattattagccggtcatgttgtagtc

SEQ ID NO: 2712 - DNA, 30 bp, Artificial sequence
  Single strand DNA oligonucleotide
tgagtcgacgtcttgaaatgtttggtgggt

SEQ ID NO: 2713 - DNA, 30 bp, Artificial sequence
  Single strand DNA oligonucleotide
tatctagacttacttgccctttgcttatga

SEQ ID NO: 2714 - DNA, 34 bp, Artificial sequence
  Single strand DNA oligonucleotide
aatgtcgacaacaatgtttggtgggttcaatgtg

SEQ ID NO: 2715 - DNA, 35 bp, Artificial sequence
  Single strand DNA oligonucleotide
tgtctagactatgctatgaggaaaagaaactaagc

SEQ ID NO: 2716 - DNA, 30 bp, Artificial sequence
  Single strand DNA oligonucleotide
attctagaatatcataatgaaagggattcg

SEQ ID NO: 2717 - DNA, 28 bp, Artificial sequence
  Single strand DNA oligonucleotide
tgagctcccattagaaccgagactgaag

SEQ ID NO: 2718 - DNA, 30 bp, Artificial sequence
  Single strand DNA oligonucleotide
tatctagaaacaatgaaagggattcgctcc

SEQ ID NO: 2719 - DNA, 35 bp, Artificial sequence
  Single strand DNA oligonucleotide
tgagctcttattagaaccgagactgaagatactta

SEQ ID NO: 2720 - DNA, 29 bp, Artificial sequence
  Single strand DNA oligonucleotide
aagatatcaatgactttccccatctatcc

SEQ ID NO: 2721 - DNA, 31 bp, Artificial sequence
  Single strand DNA oligonucleotide
acgatatcaatcgaccaacaactaacattac

SEQ ID NO: 2722 - DNA, 30 bp, Artificial sequence
  Single strand DNA oligonucleotide
aagatatccttctaataatcaaccgacagg

SEQ ID NO: 2723 - DNA, 30 bp, Artificial sequence
  Single strand DNA oligonucleotide
atgatatccattacatgtgtgtatccgacg

SEQ ID NO: 2724 - DNA, 33 bp, Artificial sequence
  Single strand DNA oligonucleotide
atagtcgacgggaagtatcattagttcattacc

SEQ ID NO: 2725 - DNA, 35 bp, Artificial sequence
  Single strand DNA oligonucleotide
tatctagactagtatccctaacgtaacaaagactc

SEQ ID NO: 2726 - DNA, 32 bp, Artificial sequence
  Single strand DNA oligonucleotide
aatgtcgacttaccatgggagactataacatg

SEQ ID NO: 2727 - DNA, 35 bp, Artificial sequence
  Single strand DNA oligonucleotide
tatctagactactaacgtaacaaagactcttcaca

SEQ ID NO: 2728 - DNA, 28 bp, Artificial sequence
  Single strand DNA oligonucleotide
tatctagactgtctgtttgcctgtcgag

SEQ ID NO: 2729 - DNA, 31 bp, Artificial sequence
  Single strand DNA oligonucleotide
tcccgggatactcaaatcaaatgaaagtccg

SEQ ID NO: 2730 - DNA, 28 bp, Artificial sequence
  Single strand DNA oligonucleotide
catctagacaacaatggcgaggatgatc

SEQ ID NO: 2731 - DNA, 33 bp, Artificial sequence
  Single strand DNA oligonucleotide
tcccgggttagatagaagtttatcccatcaggg

SEQ ID NO: 2732 - DNA, 29 bp, Artificial sequence
  Single strand DNA oligonucleotide
aatgtcgacagtctgcactggaaggacag

SEQ ID NO: 2733 - DNA, 30 bp, Artificial sequence
  Single strand DNA oligonucleotide
tatctagacttgttgccagcatctcttatg

SEQ ID NO: 2734 - DNA, 28 bp, Artificial sequence
  Single strand DNA oligonucleotide
aatgtcgacctggaaggacagcatgtcg

SEQ ID NO: 2735 - DNA, 33 bp, Artificial sequence
  Single strand DNA oligonucleotide
tatctagactatgactagctgatggagtcctcc

SEQ ID NO: 2736 - DNA, 18 bp, Artificial sequence
  Single strand DNA oligonucleotide
cttcttcaatggcgacgg

SEQ ID NO: 2737 - DNA, 30 bp, Artificial sequence
  Single strand DNA oligonucleotide
tagtcatgcaaatatttaatcttggaaccc

SEQ ID NO: 2738 - DNA, 30 bp, Artificial sequence
  Single strand DNA oligonucleotide
ttagtcgacttaagatggccaaggttaacg

SEQ ID NO: 2739 - DNA, 33 bp, Artificial sequence
  Single strand DNA oligonucleotide
tatctagactaatgccgttgcttctagtaatag

SEQ ID NO: 2740 - DNA, 28 bp, Artificial sequence
  Single strand DNA oligonucleotide
tatctagatcctctccctagctagcaag

SEQ ID NO: 2741 - DNA, 28 bp, Artificial sequence
  Single strand DNA oligonucleotide
tgagctcctaatcaccctggctgttgac

SEQ ID NO: 2742 - DNA, 29 bp, Artificial sequence
  Single strand DNA oligonucleotide
tatctagatccctagctagcaagctctag

SEQ ID NO: 2743 - DNA, 25 bp, Artificial sequence
  Single strand DNA oligonucleotide
tgagctcccttaatgccatgctgcg

SEQ ID NO: 2744 - DNA, 31 bp, Artificial sequence
  Single strand DNA oligonucleotide
attctagatacatcgtcttcacctaattttc

SEQ ID NO: 2745 - DNA, 29 bp, Artificial sequence
  Single strand DNA oligonucleotide
cgagctcaacaagcaaactaaacgtgaac

SEQ ID NO: 2746 - DNA, 21 bp, Artificial sequence
  Single strand DNA oligonucleotide
atgatatcaaatccggtggac

SEQ ID NO: 2747 - DNA, 30 bp, Artificial sequence
  Single strand DNA oligonucleotide
tagatatccaacactcactagggagcacag

SEQ ID NO: 2748 - DNA, 26 bp, Artificial sequence
  Single strand DNA oligonucleotide
tagatatcagaattcgcagggatgcc

SEQ ID NO: 2749 - DNA, 28 bp, Artificial sequence
  Single strand DNA oligonucleotide
tagatatcgttgaacgctccacatcatg

SEQ ID NO: 2750 - DNA, 26 bp, Artificial sequence
  Single strand DNA oligonucleotide
gctctagaaggcgagatgtgggagtc

SEQ ID NO: 2751 - DNA, 30 bp, Artificial sequence
  Single strand DNA oligonucleotide
tgagctcctactaggccttctcctttgttg

SEQ ID NO: 2752 - DNA, 28 bp, Artificial sequence
  Single strand DNA oligonucleotide
aatctagacaactgcaactgcaactagc

SEQ ID NO: 2753 - DNA, 30 bp, Artificial sequence
  Single strand DNA oligonucleotide
cgagctcacagctaaacatcaatcctcttc

SEQ ID NO: 2754 - DNA, 27 bp, Artificial sequence
  Single strand DNA oligonucleotide
tgagctctgcaagcaatcaccagtttg

SEQ ID NO: 2755 - DNA, 27 bp, Artificial sequence
  Single strand DNA oligonucleotide
tgagctcctcattttatttgctgcgtg

SEQ ID NO: 2756 - DNA, 23 bp, Artificial sequence
  Single strand DNA oligonucleotide
agattagtcccaaagattattcg

SEQ ID NO: 2757 - DNA, 20 bp, Artificial sequence
  Single strand DNA oligonucleotide
gacattgtggggaagctact

SEQ ID NO: 2758 - DNA, 21 bp, Artificial sequence
  Single strand DNA oligonucleotide
gatacaaagaattcgctttgc

SEQ ID NO: 2759 - DNA, 23 bp, Artificial sequence
  Single strand DNA oligonucleotide
gcatgtaattgtagctttctttt

SEQ ID NO: 2760 - DNA, 28 bp, Artificial sequence
  Single strand DNA oligonucleotide
tatctagagtttgcttgcttaccaggag

SEQ ID NO: 2761 - DNA, 31 bp, Artificial sequence
  Single strand DNA oligonucleotide
tcccgggttagcagcatcgatcgtacactag

SEQ ID NO: 2762 - DNA, 31 bp, Artificial sequence
  Single strand DNA oligonucleotide
aatgtcgacgagtttacaagagacccagacg

SEQ ID NO: 2763 - DNA, 29 bp, Artificial sequence
  Single strand DNA oligonucleotide
actctagaattcagtcatagatcgccttg

SEQ ID NO: 2764 - DNA, 27 bp, Artificial sequence
  Single strand DNA oligonucleotide
tatctagattggtcacaggggataggc

SEQ ID NO: 2765 - DNA, 33 bp, Artificial sequence
  Single strand DNA oligonucleotide
tgagctcctaagatgctgctttctcagactatg

SEQ ID NO: 2766 - DNA, 30 bp, Artificial sequence
  Single strand DNA oligonucleotide
tatctagagaaattgtgtttgtttgatggg

SEQ ID NO: 2767 - DNA, 31 bp, Artificial sequence
  Single strand DNA oligonucleotide
tgagctcctactatgccaaagaaccttcatg

SEQ ID NO: 2768 - DNA, 31 bp, Artificial sequence
  Single strand DNA oligonucleotide
tatctagagagaaatgacaagtgtctggaag

SEQ ID NO: 2769 - DNA, 30 bp, Artificial sequence
  Single strand DNA oligonucleotide
tgagctcggagtgatcactactgcttctcc

SEQ ID NO: 2770 - DNA, 29 bp, Artificial sequence
  Single strand DNA oligonucleotide
aatgtcgactgaagatggctgacgatttg

SEQ ID NO: 2771 - DNA, 31 bp, Artificial sequence
  Single strand DNA oligonucleotide
tatctagactagtcttagccaccaccagaac

SEQ ID NO: 2772 - DNA, 31 bp, Artificial sequence
  Single strand DNA oligonucleotide
aatctagaggattgagacatgcacttaacag

SEQ ID NO: 2773 - DNA, 29 bp, Artificial sequence
  Single strand DNA oligonucleotide
tgagctcttttgagcacctcttatttagc

SEQ ID NO: 2774 - DNA, 30 bp, Artificial sequence
  Single strand DNA oligonucleotide
aatctagaactcatcagcaactacaacgtg

SEQ ID NO: 2775 - DNA, 33 bp, Artificial sequence
  Single strand DNA oligonucleotide
tgagctcctacaatacacctcttgacatccttc

SEQ ID NO: 2776 - DNA, 35 bp, Artificial sequence
  Single strand DNA oligonucleotide
taagtcgacgatacaatgagaatgttagttcttcg

SEQ ID NO: 2777 - DNA, 34 bp, Artificial sequence
  Single strand DNA oligonucleotide
tatctagatcatcaccatcgtcttatcaatgaag

SEQ ID NO: 2778 - DNA, 29 bp, Artificial sequence
  Single strand DNA oligonucleotide
acccgggtcgtctcatcaattcaagatcc

SEQ ID NO: 2779 - DNA, 29 bp, Artificial sequence
  Single strand DNA oligonucleotide
tgagctccccttcaaactaatcaatcttg

SEQ ID NO: 2780 - DNA, 27 bp, Artificial sequence
  Single strand DNA oligonucleotide
aatctagaaagagcaccaccagagcag

SEQ ID NO: 2781 - DNA, 31 bp, Artificial sequence
  Single strand DNA oligonucleotide
ttgatatcctttatgtcaccattcatctcag

SEQ ID NO: 2782 - DNA, 29 bp, Artificial sequence
  Single strand DNA oligonucleotide
aatctagactggtttaggagacgaaaagg

SEQ ID NO: 2783 - DNA, 30 bp, Artificial sequence
  Single strand DNA oligonucleotide
agagctcctatctcaactccatcgcctcag

SEQ ID NO: 2784 - DNA, 27 bp, Artificial sequence
  Single strand DNA oligonucleotide
aatctagaagtgctctccggtttgagg

SEQ ID NO: 2785 - DNA, 35 bp, Artificial sequence
  Single strand DNA oligonucleotide
agagctcctactactcaacttctctgatgattctc

SEQ ID NO: 2786 - DNA, 27 bp, Artificial sequence
  Single strand DNA oligonucleotide
attctagagccttctgattcccactcc

SEQ ID NO: 2787 - DNA, 30 bp, Artificial sequence
  Single strand DNA oligonucleotide
tgagctctggagtatctggtttagttcgtc

SEQ ID NO: 2788 - DNA, 31 bp, Artificial sequence
  Single strand DNA oligonucleotide
aatctagacctactatacttgcaacctctcc

SEQ ID NO: 2789 - DNA, 29 bp, Artificial sequence
  Single strand DNA oligonucleotide
cgagctcaaagtctcactccgcactacac

SEQ ID NO: 2790 - DNA, 32 bp, Artificial sequence
  Single strand DNA oligonucleotide
acccggggtaacactatcaagagacgatgaag

SEQ ID NO: 2791 - DNA, 32 bp, Artificial sequence
  Single strand DNA oligonucleotide
tcccggggtttacattgttctcgtttcaaatc

SEQ ID NO: 2792 - DNA, 30 bp, Artificial sequence
  Single strand DNA oligonucleotide
acccgggctatcaagagacgatgaaggttg

SEQ ID NO: 2793 - DNA, 30 bp, Artificial sequence
  Single strand DNA oligonucleotide
tcccgggaatctttattaacgaaacagcag

SEQ ID NO: 2794 - DNA, 27 bp, Artificial sequence
  Single strand DNA oligonucleotide
aatctagacttcaagcaggcagcacac

SEQ ID NO: 2795 - DNA, 29 bp, Artificial sequence
  Single strand DNA oligonucleotide
cgagctcaaagggtccatcataatcacag

SEQ ID NO: 2796 - DNA, 26 bp, Artificial sequence
  Single strand DNA oligonucleotide
tatctagaggaaaccttgagccatgg

SEQ ID NO: 2797 - DNA, 34 bp, Artificial sequence
  Single strand DNA oligonucleotide
tgagctcctacatgtcccttagattgctctattc

SEQ ID NO: 2798 - DNA, 31 bp, Artificial sequence
  Single strand DNA oligonucleotide
aaagtcgacaggaacagcaacaaaagtaagc

SEQ ID NO: 2799 - DNA, 29 bp, Artificial sequence
  Single strand DNA oligonucleotide
tcccgggctaaactgtcccattctgcgtg

SEQ ID NO: 2800 - DNA, 31 bp, Artificial sequence
  Single strand DNA oligonucleotide
aaagtcgaccaacaaccacacacactcacag

SEQ ID NO: 2801 - DNA, 33 bp, Artificial sequence
  Single strand DNA oligonucleotide
tcccgggctaagtagcatgagtctagagcttgg

SEQ ID NO: 2802 - DNA, 31 bp, Artificial sequence
  Single strand DNA oligonucleotide
aatgtcgactctcaaaaccctaactgtttcc

SEQ ID NO: 2803 - DNA, 33 bp, Artificial sequence
  Single strand DNA oligonucleotide
attctagacaggataatagatagtcacacgagg

SEQ ID NO: 2804 - DNA, 33 bp, Artificial sequence
  Single strand DNA oligonucleotide
aaagtcgaccaaaagaatctgtcttcttctctg

SEQ ID NO: 2805 - DNA, 31 bp, Artificial sequence
  Single strand DNA oligonucleotide
attctagactatccaagaaggaacaatgagg

SEQ ID NO: 2806 - DNA, 32 bp, Artificial sequence
  Single strand DNA oligonucleotide
aaagtcgacggtaaaatatctttcttgtgcag

SEQ ID NO: 2807 - DNA, 34 bp, Artificial sequence
  Single strand DNA oligonucleotide
actctagattagaaccacaaaagattacaacatc

SEQ ID NO: 2808 - DNA, 19 bp, Artificial sequence
  Single strand DNA oligonucleotide
gttccagttgagcgagcag

SEQ ID NO: 2809 - DNA, 30 bp, Artificial sequence
  Single strand DNA oligonucleotide
ttgatatcccagtctgtttattgcatcatc

SEQ ID NO: 2810 - DNA, 28 bp, Artificial sequence
  Single strand DNA oligonucleotide
aactgcaggatcatcctcacattgcgag

SEQ ID NO: 2811 - DNA, 32 bp, Artificial sequence
  Single strand DNA oligonucleotide
aagatatcgtgctaaactatacatcaaacgtg

SEQ ID NO: 2812 - DNA, 30 bp, Artificial sequence
  Single strand DNA oligonucleotide
tatgtcgacaggttatggggaagaagctag

SEQ ID NO: 2813 - DNA, 34 bp, Artificial sequence
  Single strand DNA oligonucleotide
tatctagatcatcagtagccacgaacttgtctag

SEQ ID NO: 2814 - DNA, 28 bp, Artificial sequence
  Single strand DNA oligonucleotide
ttcgtcgactaagcacaaatggcgactc

SEQ ID NO: 2815 - DNA, 34 bp, Artificial sequence
  Single strand DNA oligonucleotide
acccgggtcaaggagctgaaacactagagttact

SEQ ID NO: 2816 - DNA, 31 bp, Artificial sequence
  Single strand DNA oligonucleotide
gtagtcgacttcacatgggaaaggataagac

SEQ ID NO: 2817 - DNA, 34 bp, Artificial sequence
  Single strand DNA oligonucleotide
aatctagatcactgatatagtccacgtcctaagg

SEQ ID NO: 2818 - DNA, 30 bp, Artificial sequence
  Single strand DNA oligonucleotide
aatctagaatatcctcccattctcattctg

SEQ ID NO: 2819 - DNA, 30 bp, Artificial sequence
  Single strand DNA oligonucleotide
tcccgggctaatgcaatctccaactccaag

SEQ ID NO: 2820 - DNA, 27 bp, Artificial sequence
  Single strand DNA oligonucleotide
aatctagaagcggagaagaggaaggag

SEQ ID NO: 2821 - DNA, 32 bp, Artificial sequence
  Single strand DNA oligonucleotide
tcccgggctaagaaaaggtaggagaaggaagg

SEQ ID NO: 2822 - DNA, 30 bp, Artificial sequence
  Single strand DNA oligonucleotide
aatctagacggaatatacatttgctttgtg

SEQ ID NO: 2823 - DNA, 30 bp, Artificial sequence
  Single strand DNA oligonucleotide
tcccgggctactgctgaatgctctctttgc

SEQ ID NO: 2824 - DNA, 28 bp, Artificial sequence
  Single strand DNA oligonucleotide
aatctagaaatcatccttccccaacctc

SEQ ID NO: 2825 - DNA, 27 bp, Artificial sequence
  Single strand DNA oligonucleotide
ccccgggacccaaacagtcatgctagg

SEQ ID NO: 2826 - DNA, 31 bp, Artificial sequence
  Single strand DNA oligonucleotide
aaagtcgacaaggttggagattgtgaaattg

SEQ ID NO: 2827 - DNA, 28 bp, Artificial sequence
  Single strand DNA oligonucleotide
cgagctcatactctacgttcccgtgtgg

SEQ ID NO: 2828 - DNA, 20 bp, Artificial sequence
  Single strand DNA oligonucleotide
aagttgggtaacgccagggt

SEQ ID NO: 2829 - DNA, 22 bp, Artificial sequence
  Single strand DNA oligonucleotide
ggtggctcctacaaatgccatc

SEQ ID NO: 2830 - DNA, 20 bp, Artificial sequence
  Single strand DNA oligonucleotide
aagttgggtaacgccagggt

SEQ ID NO: 2831 - DNA, 22 bp, Artificial sequence
  Single strand DNA oligonucleotide
ggtggctcctacaaatgccatc

SEQ ID NO: 2832 - DNA, 20 bp, Artificial sequence
  Single strand DNA oligonucleotide
aagttgggtaacgccagggt

SEQ ID NO: 2833 - DNA, 20 bp, Artificial sequence
  Single strand DNA oligonucleotide
atggggcaacatcacttggg

SEQ ID NO: 2834 - DNA, 20 bp, Artificial sequence
  Single strand DNA oligonucleotide
aagttgggtaacgccagggt

SEQ ID NO: 2835 - DNA, 22 bp, Artificial sequence
  Single strand DNA oligonucleotide
ggtggctcctacaaatgccatc

SEQ ID NO: 2836 - DNA, 20 bp, Artificial sequence
  Single strand DNA oligonucleotide
aagttgggtaacgccagggt

SEQ ID NO: 2837 - DNA, 22 bp, Artificial sequence
  Single strand DNA oligonucleotide
ggtggctcctacaaatgccatc

SEQ ID NO: 2838 - DNA, 20 bp, Artificial sequence
  Single strand DNA oligonucleotide
aagttgggtaacgccagggt

SEQ ID NO: 2839 - DNA, 22 bp, Artificial sequence
  Single strand DNA oligonucleotide
ggtggctcctacaaatgccatc

SEQ ID NO: 2840 - DNA, 20 bp, Artificial sequence
  Single strand DNA oligonucleotide
aagttgggtaacgccagggt

SEQ ID NO: 2841 - DNA, 22 bp, Artificial sequence
  Single strand DNA oligonucleotide
ggtggctcctacaaatgccatc

SEQ ID NO: 2842 - DNA, 20 bp, Artificial sequence
  Single strand DNA oligonucleotide
aagttgggtaacgccagggt

SEQ ID NO: 2843 - DNA, 22 bp, Artificial sequence
  Single strand DNA oligonucleotide
ggtggctcctacaaatgccatc

SEQ ID NO: 2844 - DNA, 20 bp, Artificial sequence
  Single strand DNA oligonucleotide
aagttgggtaacgccagggt

SEQ ID NO: 2845 - DNA, 22 bp, Artificial sequence
  Single strand DNA oligonucleotide
ggtggctcctacaaatgccatc

SEQ ID NO: 2846 - DNA, 20 bp, Artificial sequence
  Single strand DNA oligonucleotide
aagttgggtaacgccagggt

SEQ ID NO: 2847 - DNA, 22 bp, Artificial sequence
  Single strand DNA oligonucleotide
ggtggctcctacaaatgccatc

SEQ ID NO: 2848 - DNA, 20 bp, Artificial sequence
  Single strand DNA oligonucleotide
aagttgggtaacgccagggt

SEQ ID NO: 2849 - DNA, 22 bp, Artificial sequence
  Single strand DNA oligonucleotide
ggtggctcctacaaatgccatc

SEQ ID NO: 2850 - DNA, 20 bp, Artificial sequence
  Single strand DNA oligonucleotide
aagttgggtaacgccagggt

SEQ ID NO: 2851 - DNA, 22 bp, Artificial sequence
  Single strand DNA oligonucleotide
ggtggctcctacaaatgccatc

SEQ ID NO: 2852 - DNA, 20 bp, Artificial sequence
  Single strand DNA oligonucleotide
aagttgggtaacgccagggt

SEQ ID NO: 2853 - DNA, 22 bp, Artificial sequence
  Single strand DNA oligonucleotide
ggtggctcctacaaatgccatc

SEQ ID NO: 2854 - DNA, 20 bp, Artificial sequence
  Single strand DNA oligonucleotide
aagttgggtaacgccagggt

SEQ ID NO: 2855 - DNA, 22 bp, Artificial sequence
  Single strand DNA oligonucleotide
ggtggctcctacaaatgccatc

SEQ ID NO: 2856 - DNA, 20 bp, Artificial sequence
  Single strand DNA oligonucleotide
aagttgggtaacgccagggt

SEQ ID NO: 2857 - DNA, 22 bp, Artificial sequence
  Single strand DNA oligonucleotide
ggtggctcctacaaatgccatc

SEQ ID NO: 2858 - DNA, 20 bp, Artificial sequence
  Single strand DNA oligonucleotide
aagttgggtaacgccagggt

SEQ ID NO: 2859 - DNA, 22 bp, Artificial sequence
  Single strand DNA oligonucleotide
ggtggctcctacaaatgccatc

SEQ ID NO: 2860 - DNA, 20 bp, Artificial sequence
  Single strand DNA oligonucleotide
gctatgaccatgattacgcc

SEQ ID NO: 2861 - DNA, 29 bp, Artificial sequence
  Single strand DNA oligonucleotide
tatctagattaacgcgttgatcgatcagc

SEQ ID NO: 2862 - DNA, 21 bp, Artificial sequence
  Single strand DNA oligonucleotide
ggagaggacaggcttcttgag

SEQ ID NO: 2863 - DNA, 30 bp, Artificial sequence; identical to SEQ ID NO: 2575
  Single strand DNA oligonucleotide

SEQ ID NO: 2864 - DNA, 21 bp, Artificial sequence
  Single strand DNA oligonucleotide
ggagaggacaggcttcttgag

SEQ ID NO: 2865 - DNA, 31 bp, Artificial sequence; identical to SEQ ID NO: 2579
  Single strand DNA oligonucleotide

SEQ ID NO: 2866 - DNA, 21 bp, Artificial sequence
  Single strand DNA oligonucleotide
ggacaggcttcttgagatcct

SEQ ID NO: 2867 - DNA, 33 bp, Artificial sequence; identical to SEQ ID NO: 2583
  Single strand DNA oligonucleotide

SEQ ID NO: 2868 - DNA, 21 bp, Artificial sequence
  Single strand DNA oligonucleotide
ggacaggcttcttgagatcct

SEQ ID NO: 2869 - DNA, 31 bp, Artificial sequence; identical to SEQ ID NO: 2587
  Single strand DNA oligonucleotide

SEQ ID NO: 2870 - DNA, 21 bp, Artificial sequence
  Single strand DNA oligonucleotide
ggagaggacaggcttcttgag

SEQ ID NO: 2871 - DNA, 30 bp, Artificial sequence; identical to SEQ ID NO: 2589
  Single strand DNA oligonucleotide

SEQ ID NO: 2872 - DNA, 21 bp, Artificial sequence
  Single strand DNA oligonucleotide
ggacaggcttcttgagatcct

SEQ ID NO: 2873 - DNA, 32 bp, Artificial sequence; identical to SEQ ID NO: 2593
  Single strand DNA oligonucleotide

SEQ ID NO: 2874 - DNA, 21 bp, Artificial sequence
  Single strand DNA oligonucleotide
ggagaggacaggcttcttgag

SEQ ID NO: 2875 - DNA, 32 bp, Artificial sequence; identical to SEQ ID NO: 2595
  Single strand DNA oligonucleotide

SEQ ID NO: 2876 - DNA, 21 bp, Artificial sequence
  Single strand DNA oligonucleotide
ggagaggacaggcttcttgag

SEQ ID NO: 2877 - DNA, 31 bp, Artificial sequence; identical to SEQ ID NO: 2599
  Single strand DNA oligonucleotide

SEQ ID NO: 2878 - DNA, 21 bp, Artificial sequence
  Single strand DNA oligonucleotide
ggagaggacaggcttcttgag

SEQ ID NO: 2879 - DNA, 32 bp, Artificial sequence; identical to SEQ ID NO: 2603
  Single strand DNA oligonucleotide

SEQ ID NO: 2880 - DNA, 21 bp, Artificial sequence
  Single strand DNA oligonucleotide
ggagaggacaggcttcttgag

SEQ ID NO: 2881 - DNA, 37 bp, Artificial sequence; identical to SEQ ID NO: 2607
  Single strand DNA oligonucleotide

SEQ ID NO: 2882 - DNA, 21 bp, Artificial sequence
  Single strand DNA oligonucleotide
ggagaggacaggcttcttgag

SEQ ID NO: 2883 - DNA, 32 bp, Artificial sequence; identical to SEQ ID NO: 2611
  Single strand DNA oligonucleotide

SEQ ID NO: 2884 - DNA, 26 bp, Artificial sequence
  Single strand DNA oligonucleotide
aagatatcccaaacaccaaaccctcg

SEQ ID NO: 2885 - DNA, 20 bp, Artificial sequence
  Single strand DNA oligonucleotide
aagttgggtaacgccagggt

SEQ ID NO: 2886 - DNA, 21 bp, Artificial sequence
  Single strand DNA oligonucleotide
ggagaggacaggcttcttgag

SEQ ID NO: 2887 - DNA, 31 bp, Artificial sequence; identical to SEQ ID NO: 2617
  Single strand DNA oligonucleotide

SEQ ID NO: 2888 - DNA, 21 bp, Artificial sequence
  Single strand DNA oligonucleotide
ggagaggacaggcttcttgag

SEQ ID NO: 2889 - DNA, 33 bp, Artificial sequence; identical to SEQ ID NO: 2621
  Single strand DNA oligonucleotide

SEQ ID NO: 2890 - DNA, 20 bp, Artificial sequence
  Single strand DNA oligonucleotide
gctatgaccatgattacgcc

SEQ ID NO: 2891 - DNA, 29 bp, Artificial sequence
  Single strand DNA oligonucleotide
tgagctctggccttcaccctctatatctc

SEQ ID NO: 2892 - DNA, 20 bp, Artificial sequence
  Single strand DNA oligonucleotide
gctatgaccatgattacgcc

SEQ ID NO: 2893 - DNA, 32 bp, Artificial sequence; identical to SEQ ID NO: 2627
  Single strand DNA oligonucleotide

SEQ ID NO: 2894 - DNA, 30 bp, Artificial sequence; identical to SEQ ID NO: 2628
  Single strand DNA oligonucleotide

SEQ ID NO: 2895 - DNA, 23 bp, Artificial sequence
  Single strand DNA oligonucleotide
gcgggactctaatcataaaaacc

SEQ ID NO: 2896 - DNA, 20 bp, Artificial sequence
  Single strand DNA oligonucleotide
gctatgaccatgattacgcc

SEQ ID NO: 2897 - DNA, 32 bp, Artificial sequence; identical to SEQ ID NO: 2631
  Single strand DNA oligonucleotide

SEQ ID NO: 2898 - DNA, 21 bp, Artificial sequence
  Single strand DNA oligonucleotide
gaaacaccatcttcgttcttg

SEQ ID NO: 2899 - DNA, 30 bp, Artificial sequence; identical to SEQ ID NO: 2632
  Single strand DNA oligonucleotide

SEQ ID NO: 2900 - DNA, 20 bp, Artificial sequence
  Single strand DNA oligonucleotide
gtcaagctgtgctgtcttcc

SEQ ID NO: 2901 - DNA, 21 bp, Artificial sequence
  Single strand DNA oligonucleotide
gaaacaccatcttcgttcttg

SEQ ID NO: 2902 - DNA, 28 bp, Artificial sequence
  Single strand DNA oligonucleotide
aatctagagacacggaccgaacagctag

SEQ ID NO: 2903 - DNA, 23 bp, Artificial sequence
  Single strand DNA oligonucleotide
gcgggactctaatcataaaaacc

SEQ ID NO: 2904 - DNA, 29 bp, Artificial sequence
  Single strand DNA oligonucleotide
aatctagagattaggagcagggaccaatc

SEQ ID NO: 2905 - DNA, 21 bp, Artificial sequence
  Single strand DNA oligonucleotide
gaaacaccatcttcgttcttg

SEQ ID NO: 2906 - DNA, 29 bp, Artificial sequence
  Single strand DNA oligonucleotide
aatctagacctattgctcatgatgtttga

SEQ ID NO: 2907 - DNA, 23 bp, Artificial sequence
  Single strand DNA oligonucleotide
gcgggactctaatcataaaaacc

SEQ ID NO: 2908 - DNA, 20 bp, Artificial sequence
  Single strand DNA oligonucleotide
gtacgtctccgtccgacaac

SEQ ID NO: 2909 - DNA, 21 bp, Artificial sequence
  Single strand DNA oligonucleotide
gaaacaccatcttcgttcttg

SEQ ID NO: 2910 - DNA, 21 bp, Artificial sequence
  Single strand DNA oligonucleotide
ggagaggacaggcttcttgag

SEQ ID NO: 2911 - DNA, 20 bp, Artificial sequence
  Single strand DNA oligonucleotide
gagatggagccttgtcatga

SEQ ID NO: 2912 - DNA, 21 bp, Artificial sequence
  Single strand DNA oligonucleotide
ggagaggacaggcttcttgag

SEQ ID NO: 2913 - DNA, 30 bp, Artificial sequence; identical to SEQ ID NO: 2651
  Single strand DNA oligonucleotide

SEQ ID NO: 2914 - DNA, 21 bp, Artificial sequence
  Single strand DNA oligonucleotide
ggagaggacaggcttcttgag

SEQ ID NO: 2915 - DNA, 29 bp, Artificial sequence
  Single strand DNA oligonucleotide
tcccggggtgaaagatctcagaccacctc

SEQ ID NO: 2916 - DNA, 21 bp, Artificial sequence
  Single strand DNA oligonucleotide
ggagaggacaggcttcttgag

SEQ ID NO: 2917 - DNA, 29 bp, Artificial sequence
  Single strand DNA oligonucleotide
tcccgggtcatcactcgctctcgaattcc

SEQ ID NO: 2918 - DNA, 21 bp, Artificial sequence
  Single strand DNA oligonucleotide
ggagaggacaggcttcttgag

SEQ ID NO: 2919 - DNA, 30 bp, Artificial sequence; identical to SEQ ID NO: 2661
  Single strand DNA oligonucleotide

SEQ ID NO: 2920 - DNA, 21 bp, Artificial sequence
  Single strand DNA oligonucleotide
ggagaggacaggcttcttgag

SEQ ID NO: 2921 - DNA, 33 bp, Artificial sequence; identical to SEQ ID NO: 2665
  Single strand DNA oligonucleotide

SEQ ID NO: 2922 - DNA, 21 bp, Artificial sequence
  Single strand DNA oligonucleotide
ggagaggacaggcttcttgag

SEQ ID NO: 2923 - DNA, 20 bp, Artificial sequence
  Single strand DNA oligonucleotide
cctgagagggcgatcatatc

SEQ ID NO: 2924 - DNA, 21 bp, Artificial sequence
  Single strand DNA oligonucleotide
ggagaggacaggcttcttgag

SEQ ID NO: 2925 - DNA, 21 bp, Artificial sequence
  Single strand DNA oligonucleotide
ctgctttgacatggcttagac

SEQ ID NO: 2926 - DNA, 21 bp, Artificial sequence
  Single strand DNA oligonucleotide
ggacaggcttcttgagatcct

SEQ ID NO: 2927 - DNA, 32 bp, Artificial sequence; identical to SEQ ID NO: 2669
  Single strand DNA oligonucleotide

SEQ ID NO: 2928 - DNA, 21 bp, Artificial sequence
  Single strand DNA oligonucleotide
ggagaggacaggcttcttgag

SEQ ID NO: 2929 - DNA, 30 bp, Artificial sequence; identical to SEQ ID NO: 2671
  Single strand DNA oligonucleotide

SEQ ID NO: 2930 - DNA, 21 bp, Artificial sequence
  Single strand DNA oligonucleotide
ggagaggacaggcttcttgag

SEQ ID NO: 2931 - DNA, 21 bp, Artificial sequence
  Single strand DNA oligonucleotide
cataccaacatgttcgaccac

SEQ ID NO: 2932 - DNA, 21 bp, Artificial sequence
  Single strand DNA oligonucleotide
ggagaggacaggcttcttgag

SEQ ID NO: 2933 - DNA, 28 bp, Artificial sequence
  Single strand DNA oligonucleotide
tcccgggctttcatccatgtgtgcagtg

SEQ ID NO: 2934 - DNA, 21 bp, Artificial sequence
  Single strand DNA oligonucleotide
ggagaggacaggcttcttgag

SEQ ID NO: 2935 - DNA, 30 bp, Artificial sequence; identical to SEQ ID NO: 2681
  Single strand DNA oligonucleotide

SEQ ID NO: 2936 - DNA, 29 bp, Artificial sequence
  Single strand DNA oligonucleotide
attctagatcacagcaacacaatcaccac

SEQ ID NO: 2937 - DNA, 20 bp, Artificial sequence
  Single strand DNA oligonucleotide
aagttgggtaacgccagggt

SEQ ID NO: 2938 - DNA, 21 bp, Artificial sequence
  Single strand DNA oligonucleotide
ggagaggacaggcttcttgag

SEQ ID NO: 2939 - DNA, 32 bp, Artificial sequence; identical to SEQ ID NO: 2689
  Single strand DNA oligonucleotide

SEQ ID NO: 2940 - DNA, 21 bp, Artificial sequence
  Single strand DNA oligonucleotide
ggagaggacaggcttcttgag

SEQ ID NO: 2941 - DNA, 20 bp, Artificial sequence
  Single strand DNA oligonucleotide
cgaaggcatagacgtctgtc

SEQ ID NO: 2942 - DNA, 21 bp, Artificial sequence
  Single strand DNA oligonucleotide
ggagaggacaggcttcttgag

SEQ ID NO: 2943 - DNA, 21 bp, Artificial sequence
  Single strand DNA oligonucleotide
catcgaagcacttctcaactg

SEQ ID NO: 2944 - DNA, 21 bp, Artificial sequence
  Single strand DNA oligonucleotide
ggagaggacaggcttcttgag

SEQ ID NO: 2945 - DNA, 29 bp, Artificial sequence
  Single strand DNA oligonucleotide
attctagactaatctctctccctccctcc

SEQ ID NO: 2946 - DNA, 21 bp, Artificial sequence
  Single strand DNA oligonucleotide
ggagaggacaggcttcttgag

SEQ ID NO: 2947 - DNA, 21 bp, Artificial sequence
  Single strand DNA oligonucleotide
ctcttgcagctcttgatcttc

SEQ ID NO: 2948 - DNA, 21 bp, Artificial sequence
  Single strand DNA oligonucleotide
ggagaggacaggcttcttgag

SEQ ID NO: 2949 - DNA, 31 bp, Artificial sequence; identical to SEQ ID NO: 2703
  Single strand DNA oligonucleotide

SEQ ID NO: 2950 - DNA, 21 bp, Artificial sequence
  Single strand DNA oligonucleotide
ggagaggacaggcttcttgag

SEQ ID NO: 2951 - DNA, 33 bp, Artificial sequence; identical to SEQ ID NO: 2707
  Single strand DNA oligonucleotide

SEQ ID NO: 2952 - DNA, 21 bp, Artificial sequence
  Single strand DNA oligonucleotide
ggagaggacaggcttcttgag

SEQ ID NO: 2953 - DNA, 32 bp, Artificial sequence; identical to SEQ ID NO: 2711
  Single strand DNA oligonucleotide

SEQ ID NO: 2954 - DNA, 21 bp, Artificial sequence
  Single strand DNA oligonucleotide
ggagaggacaggcttcttgag

SEQ ID NO: 2955 - DNA, 35 bp, Artificial sequence; identical to SEQ ID NO: 2715
  Single strand DNA oligonucleotide

SEQ ID NO: 2956 - DNA, 21 bp, Artificial sequence
  Single strand DNA oligonucleotide
ggagaggacaggcttcttgag

SEQ ID NO: 2957 - DNA, 23 bp, Artificial sequence
  Single strand DNA oligonucleotide
gcgggactctaatcataaaaacc

SEQ ID NO: 2958 - DNA, 21 bp, Artificial sequence
  Single strand DNA oligonucleotide
ggagaggacaggcttcttgag

SEQ ID NO: 2959 - DNA, 35 bp, Artificial sequence; identical to SEQ ID NO: 2719
  Single strand DNA oligonucleotide

SEQ ID NO: 2960 - DNA, 21 bp, Artificial sequence
  Single strand DNA oligonucleotide
ggagaggacaggcttcttgag

SEQ ID NO: 2961 - DNA, 30 bp, Artificial sequence; identical to SEQ ID NO: 2723
  Single strand DNA oligonucleotide

SEQ ID NO: 2962 - DNA, 22 bp, Artificial sequence
  Single strand DNA oligonucleotide
agttgcatcgatcttgatcttg

SEQ ID NO: 2963 - DNA, 20 bp, Artificial sequence
  Single strand DNA oligonucleotide
ctgcaaggcgattaagttgg

SEQ ID NO: 2964 - DNA, 20 bp, Artificial sequence
  Single strand DNA oligonucleotide
gcaaggttagcttcatgacg

SEQ ID NO: 2965 - DNA, 21 bp, Artificial sequence
  Single strand DNA oligonucleotide
gaaacaccatcttcgttcttg

SEQ ID NO: 2966 - DNA, 28 bp, Artificial sequence
  Single strand DNA oligonucleotide
aatgtcgacctggaaggacagcatgtcg

SEQ ID NO: 2967 - DNA, 20 bp, Artificial sequence
  Single strand DNA oligonucleotide
aagttgggtaacgccagggt

SEQ ID NO: 2968 - DNA, 18 bp, Artificial sequence
  Single strand DNA oligonucleotide
cttcttcaatggcgacgg

SEQ ID NO: 2969 - DNA, 21 bp, Artificial sequence
  Single strand DNA oligonucleotide
gaaacaccatcttcgttcttg

SEQ ID NO: 2970 - DNA, 30 bp, Artificial sequence; identical to SEQ ID NO: 2738
  Single strand DNA oligonucleotide

SEQ ID NO: 2971 - DNA, 20 bp, Artificial sequence
  Single strand DNA oligonucleotide
ctgcaaggcgattaagttgg

SEQ ID NO: 2972 - DNA, 20 bp, Artificial sequence
  Single strand DNA oligonucleotide
cagctgtggaaggcatcaac

SEQ ID NO: 2973 - DNA, 20 bp, Artificial sequence
  Single strand DNA oligonucleotide
aagttgggtaacgccagggt

SEQ ID NO: 2974 - DNA, 21 bp, Artificial sequence
  Single strand DNA oligonucleotide
ggagaggacaggcttcttgag

SEQ ID NO: 2975 - DNA, 29 bp, Artificial sequence
  Single strand DNA oligonucleotide
cgagctcaacaagcaaactaaacgtgaac

SEQ ID NO: 2976 - DNA, 21 bp, Artificial sequence
  Single strand DNA oligonucleotide
ggagaggacaggcttcttgag

SEQ ID NO: 2977 - DNA, 28 bp, Artificial sequence
  Single strand DNA oligonucleotide
tagatatcgttgaacgctccacatcatg

SEQ ID NO: 2978 - DNA, 26 bp, Artificial sequence
  Single strand DNA oligonucleotide
gctctagaaggcgagatgtgggagtc

SEQ ID NO: 2979 - DNA, 23 bp, Artificial sequence
  Single strand DNA oligonucleotide
gcgggactctaatcataaaaacc

SEQ ID NO: 2980 - DNA, 21 bp, Artificial sequence
  Single strand DNA oligonucleotide
ggagaggacaggcttcttgag

SEQ ID NO: 2981 - DNA, 27 bp, Artificial sequence
  Single strand DNA oligonucleotide
tgagctcctcattttatttgctgcgtg

SEQ ID NO: 2982 - DNA, 21 bp, Artificial sequence
  Single strand DNA oligonucleotide
ggagaggacaggcttcttgag

SEQ ID NO: 2983 - DNA, 21 bp, Artificial sequence
  Single strand DNA oligonucleotide
ctcggtgttcttgatggtcac

SEQ ID NO: 2984 - DNA, 21 bp, Artificial sequence
  Single strand DNA oligonucleotide
ggagaggacaggcttcttgag

SEQ ID NO: 2985 - DNA, 21 bp, Artificial sequence
  Single strand DNA oligonucleotide
ttcttgaccttggtcagcttg

SEQ ID NO: 2986 - DNA, 21 bp, Artificial sequence
  Single strand DNA oligonucleotide
ggagaggacaggcttcttgag

SEQ ID NO: 2987 - DNA, 23 bp, Artificial sequence
  Single strand DNA oligonucleotide
gcatgtaattgtagctttctttt

SEQ ID NO: 2988 - DNA, 21 bp, Artificial sequence
  Single strand DNA oligonucleotide
ggagaggacaggcttcttgag

SEQ ID NO: 2989 - DNA, 31 bp, Artificial sequence; identical to SEQ ID NO: 2761
  Single strand DNA oligonucleotide

SEQ ID NO: 2990 - DNA, 21 bp, Artificial sequence
  Single strand DNA oligonucleotide
ggagaggacaggcttcttgag

SEQ ID NO: 2991 - DNA, 29 bp, Artificial sequence
  Single strand DNA oligonucleotide
actctagaattcagtcatagatcgccttg

SEQ ID NO: 2992 - DNA, 21 bp, Artificial sequence
  Single strand DNA oligonucleotide
ggagaggacaggcttcttgag

SEQ ID NO: 2993 - DNA, 22 bp, Artificial sequence
  Single strand DNA oligonucleotide
ggatcttgatgtacacgtttgg

SEQ ID NO: 2994 - DNA, 21 bp, Artificial sequence
  Single strand DNA oligonucleotide
ggagaggacaggcttcttgag

SEQ ID NO: 2995 - DNA, 19 bp, Artificial sequence
  Single strand DNA oligonucleotide
cgatgttgcacctctttgg

SEQ ID NO: 2996 - DNA, 21 bp, Artificial sequence
  Single strand DNA oligonucleotide
ggagaggacaggcttcttgag

SEQ ID NO: 2997 - DNA, 20 bp, Artificial sequence
  Single strand DNA oligonucleotide
cgaaatcctctgggaatgac

SEQ ID NO: 2998 - DNA, 21 bp, Artificial sequence
  Single strand DNA oligonucleotide
ggagaggacaggcttcttgag

SEQ ID NO: 2999 - DNA, 23 bp, Artificial sequence
  Single strand DNA oligonucleotide
cctcagtagagagagactcgtcg

SEQ ID NO: 3000 - DNA, 21 bp, Artificial sequence
  Single strand DNA oligonucleotide
ggagaggacaggcttcttgag

SEQ ID NO: 3001 - DNA, 22 bp, Artificial sequence
  Single strand DNA oligonucleotide
caacacttgcatcaccctagtc

SEQ ID NO: 3002 - DNA, 21 bp, Artificial sequence
  Single strand DNA oligonucleotide
ggagaggacaggcttcttgag

SEQ ID NO: 3003 - DNA, 22 bp, Artificial sequence
  Single strand DNA oligonucleotide
ccacctcaagaacagtaacgag

SEQ ID NO: 3004 - DNA, 21 bp, Artificial sequence
  Single strand DNA oligonucleotide
ggagaggacaggcttcttgag

SEQ ID NO: 3005 - DNA, 20 bp, Artificial sequence
  Single strand DNA oligonucleotide
gaaggtagagtgcagcatgg

SEQ ID NO: 3006 - DNA, 21 bp, Artificial sequence
  Single strand DNA oligonucleotide
ggagaggacaggcttcttgag

SEQ ID NO: 3007 - DNA, 31 bp, Artificial sequence; identical to SEQ ID NO: 2767
  Single strand DNA oligonucleotide

SEQ ID NO: 3008 - DNA, 21 bp, Artificial sequence
  Single strand DNA oligonucleotide
ggagaggacaggcttcttgag

SEQ ID NO: 3009 - DNA, 30 bp, Artificial sequence; identical to SEQ ID NO: 2769
  Single strand DNA oligonucleotide

SEQ ID NO: 3010 - DNA, 21 bp, Artificial sequence
  Single strand DNA oligonucleotide
ggagaggacaggcttcttgag

SEQ ID NO: 3011 - DNA, 31 bp, Artificial sequence; identical to SEQ ID NO: 2771
  Single strand DNA oligonucleotide

SEQ ID NO: 3012 - DNA, 21 bp, Artificial sequence
  Single strand DNA oligonucleotide
ggagaggacaggcttcttgag

SEQ ID NO: 3013 - DNA, 33 bp, Artificial sequence; identical to SEQ ID NO: 2775
  Single strand DNA oligonucleotide

SEQ ID NO: 3014 - DNA, 21 bp, Artificial sequence
  Single strand DNA oligonucleotide
ggagaggacaggcttcttgag

SEQ ID NO: 3015 - DNA, 34 bp, Artificial sequence; identical to SEQ ID NO: 2777
  Single strand DNA oligonucleotide

SEQ ID NO: 3016 - DNA, 21 bp, Artificial sequence
  Single strand DNA oligonucleotide
ggagaggacaggcttcttgag

SEQ ID NO: 3017 - DNA, 29 bp, Artificial sequence
  Single strand DNA oligonucleotide
tgagctccccttcaaactaatcaatcttg

SEQ ID NO: 3018 - DNA, 21 bp, Artificial sequence
  Single strand DNA oligonucleotide
ggagaggacaggcttcttgag

SEQ ID NO: 3019 - DNA, 21 bp, Artificial sequence
  Single strand DNA oligonucleotide
gtactgaagctcgtcctggac

SEQ ID NO: 3020 - DNA, 21 bp, Artificial sequence
  Single strand DNA oligonucleotide
ggagaggacaggcttcttgag

SEQ ID NO: 3021 - DNA, 31 bp, Artificial sequence; identical to SEQ ID NO: 2781
  Single strand DNA oligonucleotide

SEQ ID NO: 3022 - DNA, 21 bp, Artificial sequence
  Single strand DNA oligonucleotide
ggagaggacaggcttcttgag

SEQ ID NO: 3023 - DNA, 35 bp, Artificial sequence; identical to SEQ ID NO: 2785
  Single strand DNA oligonucleotide

SEQ ID NO: 3024 - DNA, 21 bp, Artificial sequence
  Single strand DNA oligonucleotide
ggagaggacaggcttcttgag

SEQ ID NO: 3025 - DNA, 23 bp, Artificial sequence
  Single strand DNA oligonucleotide
ggttagacacgagcttctcagac

SEQ ID NO: 3026 - DNA, 21 bp, Artificial sequence
  Single strand DNA oligonucleotide
ggagaggacaggcttcttgag

SEQ ID NO: 3027 - DNA, 29 bp, Artificial sequence
  Single strand DNA oligonucleotide
cgagctcaaagtctcactccgcactacac

SEQ ID NO: 3028 - DNA, 21 bp, Artificial sequence
  Single strand DNA oligonucleotide
ggagaggacaggcttcttgag

SEQ ID NO: 3029 - DNA, 19 bp, Artificial sequence
  Single strand DNA oligonucleotide
gtgtgcagctcgaacttgg

SEQ ID NO: 3030 - DNA, 21 bp, Artificial sequence
  Single strand DNA oligonucleotide
ggacaggcttcttgagatcct

SEQ ID NO: 3031 - DNA, 30 bp, Artificial sequence; identical to SEQ ID NO: 2793
  Single strand DNA oligonucleotide

SEQ ID NO: 3032 - DNA, 21 bp, Artificial sequence
  Single strand DNA oligonucleotide
ggagaggacaggcttcttgag

SEQ ID NO: 3033 - DNA, 34 bp, Artificial sequence; identical to SEQ ID NO: 2797
  Single strand DNA oligonucleotide

SEQ ID NO: 3034 - DNA, 21 bp, Artificial sequence
  Single strand DNA oligonucleotide
ggagaggacaggcttcttgag

SEQ ID NO: 3035 - DNA, 33 bp, Artificial sequence; identical to SEQ ID NO: 2801
  Single strand DNA oligonucleotide

SEQ ID NO: 3036 - DNA, 21 bp, Artificial sequence
  Single strand DNA oligonucleotide
ggagaggacaggcttcttgag

SEQ ID NO: 3037 - DNA, 33 bp, Artificial sequence; identical to SEQ ID NO: 2803
  Single strand DNA oligonucleotide

SEQ ID NO: 3038 - DNA, 21 bp, Artificial sequence
  Single strand DNA oligonucleotide
ggagaggacaggcttcttgag

SEQ ID NO: 3039 - DNA, 34 bp, Artificial sequence; identical to SEQ ID NO: 2807
  Single strand DNA oligonucleotide

SEQ ID NO: 3040 - DNA, 20 bp, Artificial sequence
  Single strand DNA oligonucleotide
tcagccacccaaaccatgac

SEQ ID NO: 3041 - DNA, 22 bp, Artificial sequence
  Single strand DNA oligonucleotide
gaagtcctgagaccgttgatag

SEQ ID NO: 3042 - DNA, 20 bp, Artificial sequence
  Single strand DNA oligonucleotide
tacgactcactatagggcga

SEQ ID NO: 3043 - DNA, 32 bp, Artificial sequence; identical to SEQ ID NO: 2811
  Single strand DNA oligonucleotide

SEQ ID NO: 3044 - DNA, 21 bp, Artificial sequence
  Single strand DNA oligonucleotide
ggagaggacaggcttcttgag

SEQ ID NO: 3045 - DNA, 23 bp, Artificial sequence
  Single strand DNA oligonucleotide
gaagtaccaccagttgaagaagc

SEQ ID NO: 3046 - DNA, 22 bp, Artificial sequence
  Single strand DNA oligonucleotide
gcaacaattgtggagtcaacac

SEQ ID NO: 3047 - DNA, 20 bp, Artificial sequence
  Single strand DNA oligonucleotide
aagttgggtaacgccagggt

SEQ ID NO: 3048 - DNA, 22 bp, Artificial sequence
  Single strand DNA oligonucleotide
ctttgagacgttagctgttgag

SEQ ID NO: 3049 - DNA, 20 bp, Artificial sequence
  Single strand DNA oligonucleotide
aagttgggtaacgccagggt

SEQ ID NO: 3050 - DNA, 31 bp, Artificial sequence; identical to SEQ ID NO: 2816
  Single strand DNA oligonucleotide

SEQ ID NO: 3051 - DNA, 20 bp, Artificial sequence
  Single strand DNA oligonucleotide
aagttgggtaacgccagggt

SEQ ID NO: 3052 - DNA, 21 bp, Artificial sequence
  Single strand DNA oligonucleotide
ggagaggacaggcttcttgag

SEQ ID NO: 3053 - DNA, 32 bp, Artificial sequence; identical to SEQ ID NO: 2821
  Single strand DNA oligonucleotide

SEQ ID NO: 3054 - DNA, 21 bp, Artificial sequence
  Single strand DNA oligonucleotide
ggagaggacaggcttcttgag

SEQ ID NO: 3055 - DNA, 30 bp, Artificial sequence; identical to SEQ ID NO: 2823
  Single strand DNA oligonucleotide

SEQ ID NO: 3056 - DNA, 21 bp, Artificial sequence
  Single strand DNA oligonucleotide
ggagaggacaggcttcttgag

SEQ ID NO: 3057 - DNA, 27 bp, Artificial sequence
  Single strand DNA oligonucleotide
ccccgggacccaaacagtcatgctagg

SEQ ID NO: 3058 - DNA, 21 bp, Artificial sequence
  Single strand DNA oligonucleotide
ggagaggacaggcttcttgag

SEQ ID NO: 3059 - DNA, 28 bp, Artificial sequence
  Single strand DNA oligonucleotide
cgagctcatactctacgttcccgtgtgg

SEQ ID NO: 3060 - DNA, 21 bp, Artificial sequence
  Single strand DNA oligonucleotide
ggagaggacaggcttcttgag

SEQ ID NO: 3061 - DNA, 20 bp, Artificial sequence
  Single strand DNA oligonucleotide
gtagcctgaacagcagaacc

SEQ ID NO: 3062 - DNA, 277 bp, Artificial sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 3063 - DNA, 877 bp, Artificial sequence
  Cauliflower mosaic virus 35S promotor
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 3064 - DNA, 2322 bp, Artificial sequence
  Arabidopsis thaliana At6669 promotor
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

What is claimed is:

1. A method of increasing nitrogen use efficiency, and/or tolerance to nitrogen deficiency of a plant, comprising:
    (a) expressing within the plant an exogenous polynucleotide comprising a nucleic acid sequence encoding a polypeptide selected from the group consisting of SEQ ID NOs: 2557, 248, 2349, 2350, 2351, 2352 and 2353, and;
    (b) selecting plants resulting from step (a) for an increased nitrogen use efficiency, and/or increased tolerance to nitrogen deficiency as compared to a native plant of the same species, which is grown under the same growth conditions,
    thereby increasing the nitrogen use efficiency, and/or tolerance to nitrogen deficiency of the plant as compared to the native plant of the same species, which is grown under the same growth conditions.

2. The method of claim 1, wherein said polypeptide is set forth in SEQ ID NO: 2557 or 248.

3. The method of claim 1, wherein said nucleic acid sequence is set forth in SEQ ID NO: 2506, or 111.

4. The method of claim 1, further comprising growing the plant, which expresses said exogenous polynucleotide, under the nitrogen deficiency.

5. A method of growing a crop comprising growing a crop plant transformed with an exogenous polynucleotide comprising a nucleic acid sequence encoding a polypeptide selected from the group consisting of SEQ ID NOs: 2557, 248, 2349, 2350, 2351, 2352 and 2353, wherein said crop plant is derived from parent plants that have been transformed to express said exogenous polynucleotide and that have been selected for at least one trait selected from the group consisting of: increased nitrogen use efficiency, and an increased tolerance to nitrogen deficiency as compared to a native plant of the same species, which is grown under the same growth conditions, and said crop plant which comprises said exogenous polynucleotide having said increased nitrogen use efficiency, and/or said increased tolerance to nitrogen deficiency, thereby growing the crop.

6. The method of claim 5, wherein said polypeptide is set forth in SEQ ID NO: 2557 or 248.

7. The method of claim 5, wherein said nucleic acid sequence is set forth in SEQ ID NO: 2506, or 111.

8. The method of claim 5, wherein said nucleic acid sequence is selected from the group consisting of SEQ ID NOs: 1285, 1286, 1287, 1288 and 1289.

9. The method of claim 5, wherein said parent plants have been selected for increased tolerance to nitrogen deficiency as compared to a native plant of the same species, which is grown under the same growth conditions.

10. A method of selecting a plant having increased nitrogen use efficiency, and/or tolerance to nitrogen deficiency as compared to a native plant of the same species, which is grown under the same growth conditions, the method comprising:
    (a) providing plants transformed with an exogenous polynucleotide encoding a polypeptide selected from the group consisting of SEQ ID NOs: 2557, 248, 2349, 2350, 2351, 2352 and 2353,
    (b) selecting said plants of step (a) for increased nitrogen use efficiency, and/or tolerance to nitrogen deficiency as compared to a native plant of the same species, which is grown under the same growth condition, and
    (c) growing a crop of said plant selected in step (b),
    thereby selecting the plant having the increased nitrogen use efficiency, and/or tolerance to nitrogen deficiency as compared to the native plant of the same species, which is grown under the same growth conditions.

11. The method of claim 10, wherein said polypeptide is set forth in SEQ ID NO: 2557 or 248.

12. The method of claim 10, wherein said nucleic acid sequence is set forth in SEQ ID NO: 2506, or 111.

13. The method of claim 10, wherein said nucleic acid sequence is selected from the group consisting of SEQ ID NOs: 1285, 1286, 1287, 1288 and 1289.

14. The method of claim 1, wherein said nucleic acid sequence is selected from the group consisting of SEQ ID NOs: 1285, 1286, 1287, 1288 and 1289.

15. A method of growing a crop comprising growing a crop plant transformed with an exogenous polynucleotide comprising a nucleic acid sequence encoding a polypeptide selected from the group consisting of SEQ ID NOs: 2557, 248, 2349, 2350, 2351, 2352 and 2353, wherein said crop plant is derived from parent plants that have been transformed to express said exogenous polynucleotide and that have been selected for increased nitrogen use efficiency as compared to a native plant of the same species, which is grown under the same growth conditions, and said crop plant which comprises said exogenous polynucleotide having said increased nitrogen use efficiency, thereby growing the crop.

16. The method of claim 15, wherein said polypeptide is set forth in SEQ ID NO: 2557 or 248.

17. The method of claim 15, wherein said nucleic acid sequence is set forth in SEQ ID NO: 2506 or 111.

18. The method of claim 15, wherein said nucleic acid sequence is selected from the group consisting of SEQ ID NOs: 1285, 1286, 1287, 1288 and 1289.

* * * * *